United States Patent 9,061,059 (MODIFIED POLYNUCLEOTIDES FOR TREATING PROTEIN DEFICIENCY) - sequence listing, part 54

SEQ ID NO: 103126 - DNA, 1113 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtgggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatcgccctggactgccccagcgagctgtgcagactgtacacccagttccaggagccctacctgaaggaccccgccgcctaccccaagatccagatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103127 - DNA, 1020 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtgggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103128 - DNA, 1122 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggactgctacagagagacctacagaaccatcggcctgtactgggtgggcagcatcatcatgagcgtggtggtgttcgtgcccggcaacatcatcggcaagtacggcaccagaatctgccccgccttcttcctgagcatcccctacacctgcctgcccgtgtgggccggcttcagaatctacaaccagcccagcgagaactacaactaccccagcaaggtgatccaggaggcccaggccaaggacctgctgagaagacccttcgacctgatgctggtggtgtgcctgctgctggccaccggcttctgcctgttcagaggcctgatcgccctggactgccccagcgagctgtgcagactgtacacccagttccaggagccctacctgaaggaccccgccgcctaccccaagatccagatgctggcctacatgttctacagcgtgccctacttcgtgaccgccctgtacggcctggtggtgcccggctgcagctggatgcccgacatcaccctgatccacgccggcggcctggcccaggcccagttcagccacatcggcgccagcctgcacgccagaaccgcctacgtgtacagagtgcccgaggaggccaagatcctgttcctggccctgaacatcgcctacggcgtgctgccccagctgctggcctacagatgcatctacaagcccgagttcttcatcaagaccaaggccgaggagaaggtggagtag

SEQ ID NO: 103129 - DNA, 567 bp, Artificial Sequence
  Description of Artificial Sequence: Synthetic coding sequence
atgagcgccagcgccgccaccggcgtgttcgtgctgagcctgagcgccatccccgtgacctacgtgttcaaccacctggccgcccagcacgacagctggaccatcgtgggcgtggccgccctgatcctgttcctggtggccctgctggccagagtgctggtgaagagaaagccccccagagaccccctgttctacgtgtacgccgtgttcggcttcaccagcgtggtgaacctgatcatcggcctggagcaggacggcatcatcgacggcttcatgacccactacctgagagagggcgagccctacctgaacaccgcctacggccacatgatctgctactgggacggcagcgcccactacctgatgtacctggtgatggtggccgccatcgcctgggaggagacctacagaaccatcggcctgtactgggtgggcagcatcatcatgagcgtggtggtgttcgtgcccggcaacatcgtggacgccggcatctacgtgctgttctgcagcctgctgtgcgactgcaccgtgtggctgagcggcagctggatgttcctggacgcctag

SEQ ID NO: 103130 - DNA, 1020 bp, Artificial Sequence; identical to SEQ ID NO: 103127
  Description of Artificial Sequence: Synthetic coding sequence

SEQ ID NO: 103131 - DNA, 1056 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggagggcgagccctacctgagaaccgcccacggcgtgttcatctgctactgggacggcaccgtgcactacctgctgtacctggccatggccggcgccatctgcagaagaaagagatacagaaacttcggcctgtactggctgggcagcttcgccatgagcatcctggtgttcctgaccggcaacatcctgggcaagtacagcagcgagatcagacccgccttcttcctgaccatcccctacctgctggtgccctgctgggccggcatgaaggtgttcagccagcccagagccctgaccagatgcaccgccaacatggtgcaggaggagcagagaaagggcctgctgcagagacccgccgacctggccctggtgatctacctgatcctggccggcttcttcaccctgttcagaggcctggtggtgctggactgccccaccgacgcctgcttcgtgtacatctaccagtacgagccctacctgagagaccccgtggcctaccccaaggtgcagatgctgatgtacatgttctacgtgctgcccttctgcggcctggccgcctacgccctgaccttccccggctgcagctggctgcccgactgggccctggtgttcgccggcggcatcggccaggcccagttcagccacatgggcgccagcatgcacctgagaacccccttcacctacagatgcctgcagtggcccgccttcttccaccagcccccccccagcgaccccctggccctgcacaagaagcagcactag

SEQ ID NO: 103132 - DNA, 1134 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggagggcgagccctacctgagaaccgcccacggcgtgttcatctgctactgggacggcaccgtgcactacctgctgtacctggccatggccggcgccatctgcagaagaaagagatacagaaacttcggcctgtactggctgggcagcttcgccatgagcatcctggtgttcctgaccggcaacatcctgggcaagtacagcagcgagatcagacccgccttcttcctgaccatcccctacctgctggtgccctgctgggccggcatgaaggtgttcagccagcccagagccctgaccagatgcaccgccaacatggtgcaggaggagcagagaaagggcctgctgcagagacccgccgacctggccctggtgatctacctgatcctggccggcttcttcaccctgttcagaggcctggtggtgctggactgccccaccgacgcctgcttcgtgtacatctaccagtacgagccctacctgagagaccccgtggcctaccccaaggtgcagatgctgatgtacatgttctacgtgctgcccttctgcggcctggccgcctacgccctgaccttccccggctgcagctggctgcccgactgggccctggtgttcgccggcggcatcggccaggcccagttcagccacatgggcgccagcatgcacctgagaacccccttcacctacagagtgcccgaggacacctggggctgcttcttcgtgtgcaacctgctgtacgccctgggcccccacctgctggcctacagatgcctgcagtggcccgccttcttccaccagcccccccccagcgaccccctggccctgcacaagaagcagcactag

SEQ ID NO: 103133 - DNA, 642 bp, Artificial Sequence
  Description of Artificial Sequence: Synthetic coding sequence
atggacatcccccccctggccggcaagatcgccgccctgagcctgagcgccctgcccgtgagctacgccctgaaccacgtgagcgccctgagccaccccctgtgggtggccctgatgagcgccctgatcctgggcctgctgttcgtggccgtgtacagcctgagccacggcgaggtgagctacgaccccctgtacgccgtgttcgccgtgttcgccttcaccagcgtggtggacctgatcatcgccctgcaggaggacagctacgtggtgggcttcatggagttctacaccaaggaggtgctgggcggcagacccggcagccccctgccccactgccccagcgagagccccacctgcccccacagagagagccacacctgcgcccagagaaccgagagcagcagcgccaccggcatggccctgttcaccaccagcagcacctggccctggcccgcccccagcgccgagggcgccggcggcagagagagagtggcccccgaccccggcagagaggtggccagcagcgacggcgtgcccggccagggcggcgccagaagcgtgtgcagaagaaaccaggacgccagcctgggcctgcagcccggcgtggccagaagaagattccagggcaccagccaggtgtag

SEQ ID NO: 103134 - DNA, 1257 bp, Artificial Sequence
  Description of Artificial Sequence: Synthetic coding sequence
atggcccccacccagggccccagagcccccctggagttcggcggccccctgggcgccgccgccctgctgctgctgctgcccgccaccatgttccacctgctgctggccgccagaagcggccccgccagactgctgggcccccccgccagcctgcccggcctggaggtgctgtggagccccagagccctgctgctgtggctggcctggctgggcctgcaggccgccctgtacctgctgcccgccagaaaggtggccgagggccaggagctgaaggacaagagcagactgagataccccatcaacggcttccaggccctggtgctgaccgccctgctggtgggcctgggcatgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacgccaccggctactacatcttcagaggcgccaacagccagaagaacaccttcagaaagaaccccagcgaccccagagtggccggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103135 - DNA, 1176 bp, Artificial Sequence
  Description of Artificial Sequence: Synthetic coding sequence
atggcccccacccagggccccagagcccccctggagttcggcggccccctgggcgccgccgccctgctgctgctgctgcccgccaccatgttccacctgctgctggccgccagaagcggccccgccagactgctgggcccccccgccagcctgcccggcctggaggtgctgtggagccccagagccctgctgctgtggctggcctggctgggcctgcaggccgccctgtacctgctgcccgccagaaaggtggccgagggccaggagctgaaggacaagagcagactgagataccccatcaacggcttccaggccctggtgctgaccgccctgctggtgggcctgggcatgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103136 - DNA, 909 bp, Artificial Sequence
  Description of Artificial Sequence: Synthetic coding sequence
atgagcgccggcctgcccctgggcgccctgcccgagatgctgctgcccctggccttcgtggccaccctgaccgccttcatcttcagcctgttcctgtacatgaaggcccaggtggcccccgtgagcgccctggcccccggcggcaacagcggcaaccccatctacgacttcttcctgggcagagagctgaaccccagaatctgcttcttcgacttcaagtacttctgcgagctgagacccggcctgatcggctgggtgctgatcaacctggccctgctgatgaaggaggccgagctgagaggcagccccagcctggccatgtggctggtgaacggcttccagctgctgtacgtgggcgacgccctgtggcacgaggaggccgtgctgaccaccatggacatcacccacgacggcttcggcttcatgctggccttcggcgacatggcctgggtgcccttcacctacagcctgcaggcccagttcctgctgcaccacccccagcccctgggcctgcccatggccagcgtgatctgcctgatcaacgccaccggctactacatcttcagaggcgccaacagccagaagaacaccttcagaaagaaccccagcgaccccagagtggccggcctggagaccatcagcaccgccaccggcagaaagctgctggtgagcggctggtggggcatggtgagacaccccaactacctgggcgacctgatcatggccctggcctggagcctgccctgcggcgtgagccacctgctgccctacttctacctgctgtacttcaccgccctgctggtgcacagagaggccagagacgagagacagtgcctgcagaagtacggcctggcctggcaggagtactgcagaagagtgccctacagaatcatgccctacatctactag

SEQ ID NO: 103137 - DNA, 1713 bp, Artificial Sequence
  Description of Artificial Sequence: Synthetic coding sequence
atgggcttcctgcagctgctggtggtggccgtgctggccagcgagcacagagtggccggcgccgccgaggtgttcggcaacagcagcgagggcctgatcgagttcagcgtgggcaagttcagatacttcgagctgaacagacccttccccgaggaggccatcctgcacgacatcagcagcaacgtgaccttcctgatcttccagatccacagccagtaccagaacaccaccgtgagcttcagccccaccctgctgagcaacagcagcgagaccggcaccgccagcggcctggtgttcatcctgagacccgagcagagcacctgcacctggtacctgggcaccagcggcatccagcccgtgcagaacatggccatcctgctgagctacagcgagagagaccccgtgcccggcggctgcaacctggagttcgacctggacatcgaccccaacatctacctggagtacaacttcttcgagaccaccatcaagttcgcccccgccaacctgggctacgccagaggcgtggacccccccccctgcgacgccggcaccgaccaggacagcagatggagactgcagtacgacgtgtaccagtacttcctgcccgagaacgacctgaccgaggagatgctgctgaagcacctgcagagaatggtgagcgtgccccaggtgaaggccagcgccctgaaggtggtgaccctgaccgccaacgacaagaccagcgtgagcttcagcagcctgcccggccagggcgtgatctacaacgtgatcgtgtgggaccccttcctgaacaccagcgccgcctacatccccgcccacacctacgcctgcagcttcgaggccggcgagggcagctgcgccagcctgggcagagtgagcagcaaggtgttcttcaccctgttcgccctgctgggcttcttcatctgcttcttcggccacagattctggaagaccgagctgttcttcatcggcttcatcatcatgggcttcttcttctacatcctgatcaccagactgacccccatcaagtacgacgtgaacctgatcctgaccgccgtgaccggcagcgtgggcggcatgttcctggtggccgtgtggtggagattcggcatcctgagcatctgcatgctgtgcgtgggcctggtgctgggcttcctgatcagcagcgtgaccttcttcacccccctgggcaacctgaagatcttccacgacgacggcgtgttctgggtgaccttcagctgcatcgccatcctgatccccgtggtgttcatgggctgcctgagaatcctgaacatcctgacctgcggcgtgatcggcagctacagcgtggtgctggccatcgacagctactggagcaccagcctgagctacatcaccctgaacgtgctgaagagagccctgaacaaggacttccacagagccttcaccaacgtgcccttccagaccaacgacttcatcatcctggccgtgtggggcatgctggccgtgagcggcatcaccctgcagatcagaagagagagaggcagacccttcttccccccccacccctacaagctgtggaagcaggagagagagagaagagtgaccaacatcctggaccccagctaccacatcccccccctgagagagagactgtacggcagactgacccagatcaagggcctgttccagaaggagcagcccgccggcgagagaacccccctgctgctgtag

SEQ ID NO: 103138 - DNA, 351 bp, Artificial Sequence
  Description of Artificial Sequence: Synthetic coding sequence
atgggcttcctgcagctgctggtggtggccgtgctggccagcgagcacagagtggccggcgccgccgaggtgttcggcaacagcagcgaggtgtacctggtggtgggcctgatcgagttcagcgtgggcaagttcagatacttcgagctgaacagacccttccccgaggaggccatcctgcacgacatcagcagcaacgtgaccttcctgatcttccagatccacagccagtaccagaacaccaccgtgagcttcagccccaccctgctgagcaacagcagcgagaccggcaccgccagcggcctggtgttcatcctgagacccgagcagagcacctgcacctggtactag

SEQ ID NO: 103139 - DNA, 1413 bp, Artificial Sequence
  Description of Artificial Sequence: Synthetic coding sequence
atgggcatctggaccagcggcaccgacatcttcctgagcctgtgggagatctacgtgagccccagaagccccggctggatggacttcatccagcacctgggcgtgtgctgcctggtggccctgatcagcgtgggcctgctgagcgtggccgcctgctggttcctgcccagcatcatcgccgccgccgccagctggatcatcacctgcgtgctgctgtgctgcagcaagcacgccagatgcttcatcctgctggtgttcctgagctgcggcctgagagagggcagaaacgccctgatcgccgccggcaccggcatcgtgatcctgggccacgtggagaacatcttccacaacttcaagggcctgctggacggcatgacctgcaacctgagagccaagagcttcagcatccacttccccctgctgaagaagtacatcgaggccatccagtggatctacggcctggccacccccctgagcgtgttcgacgacctggtgagctggaaccagaccctggccgtgagcctgttcagccccagccacgtgctggaggcccagctgaacgacagcaagggcgaggtgctgagcgtgctgtaccagatggccaccaccaccgaggtgctgagcagcctgggccagaagctgctggccttcgccggcctgagcctggtgctgctgggcaccggcctgttcatgaagagattcctgggcccctgcggctggaagtacgagaacatctacatcaccagacagttcgtgcagttcgacgagagagagagacaccagcagagaccctgcgtgctgcccctgaacaaggaggagagaagaaagtacgtgatcatccccaccttctggcccacccccaaggagagaaagaacctgggcctgttcttcctgcccatcctgatccacctgtgcatctgggtgctgttcgccgccgtggactacctgctgtacagactgatcttcagcgtgagcaagcagttccagagcctgcccggcttcgaggtgcacctgaagctgcacggcgagaagcagggcacccaggacatcatccacgacagcagcttcaacatcagcgtgttcgagcccaactgcatccccaagcccaagttcctgctgagcgagacctgggtgcccctgagcgtgatcctgctgatcctggtgatgctgggcctgctgagcagcatcctgatgcagctgaagatcctggtgagcgccagcttctaccccagcgtggagagaaagagaatccagtacctgcacgccaagctgctgaagaagagaagcaagcagcccctgggcgaggtgaagagaagactgagcctgtacctgaccaagatccacttctggctgcccgtgctgaagatgatcagaaagaagcagatggacatggccagcgccgacaagagctag

SEQ ID NO: 103140 - DNA, 567 bp, Artificial Sequence
  Description of Artificial Sequence: Synthetic coding sequence
atgagcaccatgttcgccgacaccctgctgatcgtgttcatcagcgtgtgcaccgccctgctggccgagggcatcacctgggtgctggtgtacagaaccgacaagtacaagagactgaaggccgaggtggagaagcagagcaagaagctggagaagaagaaggagaccatcaccgagagcgccggcagacagcagaagaagaagatcgagagacaggaggagaagctgaagaacaacaacagagacctgagcatggtgagaatgaagagcatgttcgccatcggcttctgcttcaccgccctgatgggcatgttcaacagcatcttcgacggcagagtggtggccaagctgcccttcacccccctgagctacatccagggcctgagccacagaaacctgctgggcgacgacaccaccgactgcagcttcatcttcctgtacatcctgtgcaccatgagcatcagacagaacatccagaagatcctgggcctggcccccagcagagccgccaccaagcaggccggcggcttcctgggcccccccccccccagcggcaagttcagctag

SEQ ID NO: 103141 - DNA, 510 bp, Artificial Sequence
  Description of Artificial Sequence: Synthetic coding sequence
atgagcaccatgttcgccgacaccctgctgatcgtgttcatcagcgtgtgcaccgccctgctggccgagggcatcacctgggtgctggtgtacagaaccgacaagtacaagagactgaaggccgaggtggagaagcagagcaagaagctggagaagaagaaggagaccatcaccgagagcgccggcagacagcagaaggtgagaatgaagagcatgttcgccatcggcttctgcttcaccgccctgatgggcatgttcaacagcatcttcgacggcagagtggtggccaagctgcccttcacccccctgagctacatccagggcctgagccacagaaacctgctgggcgacgacaccaccgactgcagcttcatcttcctgtacatcctgtgcaccatgagcatcagacagaacatccagaagatcctgggcctggcccccagcagagccgccaccaagcaggccggcggcttcctgggcccccccccccccagcggcaagttcagctag

SEQ ID NO: 103142 - DNA, 603 bp, Artificial Sequence
  Description of Artificial Sequence: Synthetic coding sequence
atgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctggtggacatccccgagagcacctag

SEQ ID NO: 103143 - DNA, 1371 bp, Artificial Sequence
  Description of Artificial Sequence: Synthetic coding sequence
atggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagaaggacctgctggagatcgacagattcaccatctgcggcaacagaatcgactag

SEQ ID NO: 103144 - DNA, 1704 bp, Artificial Sequence
  Description of Artificial Sequence: Synthetic coding sequence
atggccggcgtgggcgacgccgccgcccccggcgagggcggcggcggcggcgtggacggcccccagagagacggcagaggcgaggccgagcagcccggcggcagcggcggccagggccccccccccgccccccagctgaccgagaccctgggcttctacgagagcgacagaagaagagagagaagaagaggcagaaccgagctgagcctgctgagattcctgagcgccgagctgaccagaggctacttcctggagcacaacgaggccaagtacaccgagagaagagagagagtgtacacctgcctgagaatccccagagagctggagaagctgatggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagaaggacctgctggagatcgacagattcaccatctgcggcaacagaatcgactag

SEQ ID NO: 103145 - DNA, 1689 bp, Artificial Sequence
  Description of Artificial Sequence: Synthetic coding sequence
atggccggcgtgggcgacgccgccgcccccggcgagggcggcggcggcggcgtggacggcccccagagagacggcagaggcgaggccgagcagcccggcggcagcggcggccagggccccccccccgccccccagctgaccgagaccctgggcttctacgagagcgacagaagaagagagagaagaagaggcagaaccgagctgagcctgctgagattcctgagcgccgagctgaccagaggctacttcctggagcacaacgaggccaagtacaccgagagaagagagagagtgtacacctgcctgagaatccccagagagctggagaagctgatggtgttcggcatcttcctgtgcctggacgccttcctgtacgtgttcaccctgctgcccctgagagtgttcctggccctgttcagactgctgaccctgccctgctacggcctgagagacagaagactgctgcagcccgcccaggtgtgcgacatcctgaagggcgtgatcctggtgatctgctacttcatgatgcactacgtggactacagcatgatgtaccacctgatcagaggccagagcgtgatcaagctgtacatcatctacaacatgctggaggtggccgacagactgttcagcagcttcggccaggacatcctggacgccctgtactggaccgccaccgagcccaaggagagaaagagagcccacatcggcgtgatcccccacttcttcatggccgtgctgtacgtgttcctgcacgccatcctgatcatggtgcaggccaccaccctgaacgtggccttcaacagccacaacaagagcctgctgaccatcatgatgagcaacaacttcgtggagatcaagggcagcgtgttcaagaagttcgagaagaacaacctgttccagatgagcaacagcgacatcaaggagagattcaccaactacgtgctgctgctgatcgtgtgcctgagaaacatggagcagttcagctggaaccccgaccacctgtgggtgctgttccccgacgtgtgcatggtgatcgccagcgagatcgccgtggacatcgtgaagcacgccttcatcaccaagttcaacgacatcaccgccgacgtgtacagcgagtacagagccagcctggccttcgacctggtgagcagcagacagaagaacgcctacaccgactacagcgacagcgtggccagaagaatgggcttcatccccctgcccctggccgtgctgctgatcagagtggtgaccagcagcatcaaggtgcagggcatcctgagctacgcctgcgtgatcctgttctacttcggcctgatcagcctgaaggtgctgaacagcatcgtgctgctgggcaagagctgccagtacgtgaaggaggccaagatggaggagaagctgagcaacccccccgccacctgcacccccggcaagcccagcagcaagagccagaacaagtgcaagcccagccagggcctgagcaccgaggagaacctgagcgccagcatcaccaagcagcccatccaccagaaggagaacatcatccccctgctggtgaccagcaacagcgaccagttcctgaccacccccgacggcgacgagaaggacatcacccaggacaacagcgagctgaagcacagaagcagcaagagcgtgctgctgtgccagagcggcctgcccgagtgctag

SEQ ID NO: 103146 - DNA, 2283 bp, Artificial Sequence
  Description of Artificial Sequence: Synthetic coding sequence
atgagccccaagaaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggaggaggagatcgacgaggaggagctggagagactgaaggccgagctggacgagaagagacagatcatcgccaccgtgaagtgcaagccctggaagatggagaagaagatcgaggtgctgaaggaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgcaggccctggagaacaagatgagaaacaagaagatggccgccgccagagccgccgccgccgccggcagacagtag

SEQ ID NO: 103147 - DNA, 2283 bp, Artificial Sequence; identical to SEQ ID NO: 103146
  Description of Artificial Sequence: Synthetic coding sequence

SEQ ID NO: 103148 - DNA, 2223 bp, Artificial Sequence
  Description of Artificial Sequence: Synthetic coding sequence
gtggagtggagcggcgagtgcctgagaagctgcagaagagaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgctgcagctgctggtggccagcaacaagtaccccgagagccccgagaaggtgcacttcgccctgctgttcaagagcaacgccatctgcgagagacccgagaacaagcactgctag

SEQ ID NO: 103149 - DNA, 2283 bp, Artificial Sequence; identical to SEQ ID NO: 103146
  Description of Artificial Sequence: Synthetic coding sequence

SEQ ID NO: 103150 - DNA, 2184 bp, Artificial Sequence
  Description of Artificial Sequence: Synthetic coding sequence
gtggagtggagcggcgagtgcctgagaagctgcagaagagaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgcaggccctggagaacaagatgagaaacaagaagatggccgccgccagagccgccgccgccgccggcagacagtag

SEQ ID NO: 103151 - DNA, 1665 bp, Artificial Sequence
  Description of Artificial Sequence: Synthetic coding sequence
gtggagtggagcggcgagtgcctgagaagctgcagaagagaggtgcagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctag

SEQ ID NO: 103152 - DNA, 2265 bp, Artificial Sequence
  Description of Artificial Sequence: Synthetic coding sequence
cagatcaaggtggaggagaaggaggacgagaccgaggagagcagcagcgaggaggaggaggaggtggaggacaagctgcccagaagagagagcctgagacccaagagaaagagaaccagagacgtgatcaacgaggacgaccccgagcccgagcccgaggacgaggagaccagaaaggccagagagaaggagagaagaagaagactgaagagaggcgccgaggaggaggagatcgacgaggaggagctggagagactgaaggccgagctggacgagaagagacagatcatcgccaccgtgaagtgcaagccctggaagatggagaagaagatcgaggtgctgaaggaggccaagaagttcgtgagcgagaacgagggcgccctgggcaagggcaagggcaagagatggttcgccttcaagatgatgatggccaagaagtgggccaagttcctgagagacttcgagaacttcaaggccgcctgcgtgccctgggagaacaagatcaaggccatcgagagccagttcggcagcagcgtggccagctacttcctgttcctgagatggatgtacggcgtgaacatggtgctgttcatcctgaccttcagcctgatcatgctgcccgagtacctgtggggcctgccctacggcagcctgcccagaaagaccgtgcccagagccgaggaggccagcgccgccaacttcggcgtgctgtacgacttcaacggcctggcccagtacagcgtgctgttctacggctactacgacaacaagagaaccatcggctggatgaacttcagactgcccctgagctacttcctggtgggcatcatgtgcatcggctacagcttcctggtggtgctgaaggccatgaccaagaacatcggcgacgacggcggcggcgacgacaacaccttcaacttcagctggaaggtgttcaccagctgggactacctgatcggcaaccccgagaccgccgacaacaagttcaacagcatcaccatgaacttcaaggaggccatcaccgaggagaaggccgcccaggtggaggagaacgtgcacctgatcagattcctgagattcctggccaacttcttcgtgttcctgaccctgggcggcagcggctacctgatcttctgggccgtgaagagaagccaggagttcgcccagcaggaccccgacaccctgggctggtgggagaagaacgagatgaacatggtgatgagcctgctgggcatgttctgccccaccctgttcgacctgttcgccgagctggaggactaccaccccctgatcgccctgaagtggctgctgggcagaatcttcgccctgctgctgggcaacctgtacgtgttcatcctggccctgatggacgagatcaacaacaagatcgaggaggagaagctggtgaaggccaacatcaccctgtgggaggccaacatgatcaaggcctacaacgccagcttcagcgagaacagcaccggcccccccttcttcgtgcaccccgccgacgtgcccagaggcccctgctgggagaccatggtgggccaggagttcgtgagactgaccgtgagcgacgtgctgaccacctacgtgaccatcctgatcggcgacttcctgagagcctgcttcgtgagattctgcaactactgctggtgctgggacctggagtacggctaccccagctacaccgagttcgacatcagcggcaacgtgctggccctgatcttcaaccagggcatgatctggatgggcagcttcttcgcccccagcctgcccggcatcaacatcctgagactgcacaccagcatgtacttccagtgctgggccgtgatgtgctgcaacgtgcccgaggccagagtgttcaaggccagcagaagcaacaacttctacctgggcatgctgctgctgatcctgttcctgagcaccatgcccgtgctgtacatgatcgtgagcctgccccccagcttcgactgcggccccttcagcggcaagaacagaatgttcgaggtgatcggcgagaccctggagcacgacttccccagctggatggccaagatcctgagacagctgagcaaccccggcctggtgatcgccgtgatcctggtgatggtgctggccatctactacctgaacgccaccgccaagggccagaaggccgccaacctggacctgaagaagaagatgaagatgcaggccctggagaacaagatgagaaacaagaagatggccgccgccagagccgacggcgccgccggcagagcctag

SEQ ID NO: 103153 - DNA, 2721 bp, Artificial Sequence
  Description of Artificial Sequence: Synthetic coding sequence
atgagccaccaggtgaagggcctgaaggaggaggccagaggcggcgtgaagggcagagtgaagagcggcagcccccacaccggcgacagactgggcagaagaagcagcagcaagagagccctgaaggccgagggcacccccggcagaagaggcgcccagagaagccagaaggagagagccggcggcagccccagccccggcagccccagaagaaagcagaccggcagaagaagacacagagaggagctgggcgagcaggagagaggcgaggccgagagaacctgcgagggcagaagaaagagagacgagagagccagcttccaggagagaaccgccgcccccaagagagagaaggagatccccagaagagaggagaagagcaagagacagaagaagcccagaagcagcagcctggccagcagcgccagcggcggcgagagcctgagcgaggaggagctggcccagatcctggagcaggtggaggagaagaagaagctgatcgccaccatgagaagcaagccctggcccatggccaagaagctgaccgagctgagagaggcccaggagttcgtggagaagtacgagggcgccctgggcaagggcaagggcaagcagctgtacgcctacaagatgctgatggccaagaagtgggtgaagttcaagagagacttcgacaacttcaagacccagtgcatcccctgggagatgaagatcaaggacatcgagagccacttcggcagcagcgtggccagctacttcatcttcctgagatggatgtacggcgtgaacctggtgctgttcggcctgatcttcggcctggtgatcatccccgaggtgctgatgggcatgccctacggcagcatccccagaaagaccgtgcccagagccgaggaggagaaggccatggacttcagcgtgctgtgggacttcgagggctacatcaagtacagcgccctgttctacggctactacaacaaccagagaaccatcggctggctgagatacagactgcccatggcctacttcatggtgggcgtgagcgtgttcggctacagcctgatcatcgtgatcagaagcatggccagcaacacccagggcagcaccggcgagggcgagagcgacaacttcaccttcagcttcaagatgttcaccagctgggactacctgatcggcaacagcgagaccgccgacaacaagtacgccagcatcaccaccagcttcaaggagagcatcgtggacgagcaggagagcaacaaggaggagaacatccacctgaccagattcctgagagtgctggccaacttcctgatcatctgctgcctgtgcggcagcggctacctgatctacttcgtggtgaagagaagccagcagttcagcaagatgcagaacgtgagctggtacgagagaaacgaggtggagatcgtgatgagcctgctgggcatgttctgcccccccctgttcgagaccatcgccgccctggagaactaccaccccagaaccggcctgaagtggcagctgggcagaatcttcgccctgttcctgggcaacctgtacaccttcctgctggccctgatggacgacgtgcacctgaagctggccaacgaggagaccatcaagaacatcacccactggaccctgttcaactactacaacagcagcggctggaacgagagcgtgcccagaccccccctgcaccccgccgacgtgcccagaggcagctgctgggagaccgccgtgggcatcgagttcatgagactgaccgtgagcgacatgctggtgacctacatcaccatcctgctgggcgacttcctgagagcctgcttcgtgagattcatgaactactgctggtgctgggacctggaggccggcttccccagctacgccgagttcgacatcagcggcaacgtgctgggcctgatcttcaaccagggcatgatctggatgggcagcttctacgcccccggcctggtgggcatcaacgtgctgagactgctgaccagcatgtacttccagtgctgggccgtgatgagcagcaacgtgccccacgagagagtgttcaaggccagcagaagcaacaacttctacatgggcctgctgctgctggtgctgttcctgagcctgctgcccgtggcctacaccatcatgagcctgccccccagcttcgactgcggccccttcagcggcaagaacagaatgtacgacgtgctgcaggagaccatcgagaacgacttccccaccttcctgggcaagatcttcgccttcctggccaaccccggcctgatcatccccgccatcctgctgatgttcctggccatctactacctgaacagcgtgagcaagagcctgagcagagccaacgcccagctgagaaagaagatccaggtgctgagagaggtggagaagagccacaagagcgtgaagggcaaggccaccgccagagacagcgaggacacccccaagagcagcagcaagaacgccacccagctgcagctgaccaaggaggagaccaccccccccagcgccagccagagccaggccatggacaagaaggcccagggccccggcaccagcaacagcgccagcagaaccaccctgcccgccagcggccacctgcccatcagcagaccccccggcatcggccccgacagcggccacgcccccagccagacccacccctggagaagcgccagcggcaagagcgcccagagacccccccactag

SEQ ID NO: 103154 - DNA, 1365 bp, Artificial Sequence
  Description of Artificial Sequence: Synthetic coding sequence
atggcccagcccctggccttcatcctggacgtgcccgagacccccggcgaccagggccagggccccagcccctacgacgagagcgaggtgcacgacagcttccagcagctgatccaggagcagagccagtgcaccgcccaggagggcctggagctgcagcagagagagagagaggtgaccggcagcagccagcagaccctgtggagacccgagggcacccagagcaccgccaccctgagaatcctggccagcatgcccagcagaaccatcggcagaagcagaggcgccatcatcagccagtactacaacagaaccgtgcagctgagatgcagaagcagcagacccctgctgggcaacttcgtgagaagcgcctggcccagcctgagactgtacgacctggagctggaccccaccgccctggaggaggaggagaagcagagcctgctggtgaaggagctgcagagcctggccgtggcccagagagaccacatgctgagaggcatgcccctgagcctggccgagaagagaagcctgagagagaagagcagaacccccagaggcaagtggagaggccagcccggcagcggcggcgtgtgcagctgctgcggcagactgagatacgcctgcgtgctggccctgcacagcctgggcctggccctgctgagcgccctgcaggccctgatgccctggagatacgccctgaagagaatcggcggccagttcggcagcagcgtgctgagctacttcctgttcctgaagaccctgctggccttcaacgccctgctgctgctgctgctggtggccttcatcatgggcccccaggtggccttcccccccgccctgcccggccccgcccccgtgtgcaccggcctggagctgctgaccggcgccggctgcttcacccacaccgtgatgtactacggccactacagcaacgccaccctgaaccagccctgcggcagccccctggacggcagccagtgcacccccagagtgggcggcctgccctacaacatgcccctggcctacctgagcaccgtgggcgtgagcttcttcatcacctgcatcaccctggtgtacagcatggcccacagcttcggcgagagctacagagtgggcagcaccagcggcatccacgccatcaccgtgttctgcagctgggactacaaggtgacccagaagagagccagcagactgcagcaggacaacatcagaaccagactgaagggcgaggacaagatcttcctgatcaacaagctgcacagcatctacgagagaaaggagagagaggagagaagcagagtgggcaccaccgaggaggccgccgccccccccgccctgctgaccgacgagcaggacgcctag

SEQ ID NO: 103155 - DNA, 2418 bp, Artificial Sequence
  Description of Artificial Sequence: Synthetic coding sequence
atggcccagcccctggccttcatcctggacgtgcccgagacccccggcgaccagggccagggccccagcccctacgacgagagcgaggtgcacgacagcttccagcagctgatccaggagcagagccagtgcaccgcccaggagggcctggagctgcagcagagagagagagaggtgaccggcagcagccagcagaccctgtggagacccgagggcacccagagcaccgccaccctgagaatcctggccagcatgcccagcagaaccatcggcagaagcagaggcgccatcatcagccagtactacaacagaaccgtgcagctgagatgcagaagcagcagacccctgctgggcaacttcgtgagaagcgcctggcccagcctgagactgtacgacctggagctggaccccaccgccctggaggaggaggagaagcagagcctgctggtgaaggagctgcagagcctggccgtggcccagagagaccacatgctgagaggcatgcccctgagcctggccgagaagagaagcctgagagagaagagcagaacccccagaggcaagtggagaggccagcccggcagcggcggcgtgtgcagctgctgcggcagactgagatacgcctgcgtgctggccctgcacagcctgggcctggccctgctgagcgccctgcaggccctgatgccctggagatacgccctgaagagaatcggcggccagttcggcagcagcgtgctgagctacttcctgttcctgaagaccctgctggccttcaacgccctgctgctgctgctgctggtggccttcatcatgggcccccaggtggccttcccccccgccctgcccggccccgcccccgtgtgcaccggcctggagctgctgaccggcgccggctgcttcacccacaccgtgatgtactacggccactacagcaacgccaccctgaaccagccctgcggcagccccctggacggcagccagtgcacccccagagtgggcggcctgccctacaacatgcccctggcctacctgagcaccgtgggcgtgagcttcttcatcacctgcatcaccctggtgtacagcatggcccacagcttcggcgagagctacagagtgggcagcaccagcggcatccacgccatcaccgtgttctgcagctgggactacaaggtgacccagaagagagccagcagactgcagcaggacaacatcagaaccagactgaaggagctgctggccgagtggcagctgagacacagccccagaagcgtgtgcggcagactgagacaggccgccgtgctgggcctggtgtggctgctgtgcctgggcaccgccctgggctgcgccgtggccgtgcacgtgttcagcgagttcatgatccagagccccgaggccgccggccaggaggccgtgctgctggtgctgcccctggtggtgggcctgctgaacctgggcgccccctacctgtgcagagtgctggccgccctggagccccacgacagccccgtgctggaggtgtacgtggccatctgcagaaacctgatcctgaagctggccatcctgggcaccctgtgctaccactggctgggcagaagagtgggcgtgctgcagggccagtgctgggaggacttcgtgggccaggagctgtacagattcctggtgatggacttcgtgctgatgctgctggacaccctgttcggcgagctggtgtggagaatcatcagcgagaagaagctgaagagaagaagaaagcccgagttcgacatcgccagaaacgtgctggagctgatctacggccagaccctgacctggctgggcgtgctgttcagccccctgctgcccgccgtgcagatcatcaagctgctgctggtgttctacgtgaagaagaccagcctgctggccaactgccaggcccccagaagaccctggctggccagccacatgagcaccgtgttcctgaccctgctgtgcttccccgccttcctgggcgccgccgtgttcctgtgctacgccgtgtggcaggtgaagcccagcagcacctgcggccccttcagaaccctggacaccatgtacgaggccggcagagtgtgggtgagacacctggaggccgccggccccagagtgagctggctgccctgggtgcacagatacctgatggagaacaccttcttcgtgttcctggtgagcgccctgctgctggccgtgatctacctgaacatccaggtggtgagaggccagagaaaggtgatctgcctgctgaaggagcagatcagcaacgagggcgaggacaagatcttcctgatcaacaagctgcacagcatctacgagagaaaggagagagaggagagaagcagagtgggcaccaccgaggaggccgccgccccccccgccctgctgaccgacgagcaggacgcctag

SEQ ID NO: 103156 - DNA, 1155 bp, Artificial Sequence
  Description of Artificial Sequence: Synthetic coding sequence
atggcccacagcttcggcgagagctacagagtgggcagcaccagcggcatccacgccatcaccgtgttctgcagctgggactacaaggtgacccagaagagagccagcagactgcagcaggacaacatcagaaccagactgaaggagctgctggccgagtggcagctgagacacagccccagaagcgtgtgcggcagactgagacaggccgccgtgctgggcctggtgtggctgctgtgcctgggcaccgccctgggctgcgccgtggccgtgcacgtgttcagcgagttcatgatccagagccccgaggccgccggccaggaggccgtgctgctggtgctgcccctggtggtgggcctgctgaacctgggcgccccctacctgtgcagagtgctggccgccctggagccccacgacagccccgtgctggaggtgtacgtggccatctgcagaatcatcagcgagaagaagctgaagagaagaagaaagcccgagttcgacatcgccagaaacgtgctggagctgatctacggccagaccctgacctggctgggcgtgctgttcagccccctgctgcccgccgtgcagatcatcaagctgctgctggtgttctacgtgaagaagaccagcctgctggccaactgccaggcccccagaagaccctggctggccagccacatgagcaccgtgttcctgaccctgctgtgcttccccgccttcctgggcgccgccgtgttcctgtgctacgccgtgtggcaggtgaagcccagcagcacctgcggccccttcagaaccctggacaccatgtacgaggccggcagagtgtgggtgagacacctggaggccgccggccccagagtgagctggctgccctgggtgcacagatacctgatggagaacaccttcttcgtgttcctggtgagcgccctgctgctggccgtgatctacctgaacatccaggtggtgagaggccagagaaaggtgatctgcctgctgaaggagcagatcagcaacgagggcgaggacaagatcttcctgatcaacaagctgcacagcatctacgagagaaaggagagagaggagagaagcagagtgggcaccaccgaggaggccgccgccccccccgccctgctgaccgacgagcaggacgcctag

SEQ ID NO: 103157 - DNA, 417 bp, Artificial Sequence
  Description of Artificial Sequence: Synthetic coding sequence
cagtgctgggaggacttcgtgggccaggagctgtacagattcctggtgatggacttcgtgctgatgctgctggacaccctgttcggcgagctggagaacagattccagagcgacgtgttcagcagcagaatctgggcctggtggagaaagcccgagttcgacatcgccagaaacgtgctggagctgatctacggccagaccctgacctggctgggcgtgctgttcagccccctgctgcccgccgtgcagatcatcaagctgctgctggtgttctacgtgaagaagaccagcctgctggccaactgccaggcccccagaagaccctggctggccagccacatgagcaccgtgttcctgaccctgctgtgcttccccgccttcctgggcgccgccgtgttcctgtgctacgccgtgtag

SEQ ID NO: 103158 - DNA, 2418 bp, Artificial Sequence; identical to SEQ ID NO: 103155
  Description of Artificial Sequence: Synthetic coding sequence

SEQ ID NO: 103159 - DNA, 1098 bp, Artificial Sequence
  Description of Artificial Sequence: Synthetic coding sequence
atgaacatcatggacttcaacgtgaagaagctggccgccgacgccggcaccttcctgagcagagccgtgcagttcaccgaggagaagctgggccaggccgagaagaccgagctggacgcccacctggagaacctgctgagcaaggccgagtgcaccaagatctggaccgagaagatcatgaagcagaccgaggtgctgctgcagcccaaccccaacgccagaatcgaggagttcgtgtacgagaagctggacagaaaggcccccagcagaatcaacaaccccgagctgctgggccagtacatgatcgacgccggcaccgagttcggccccggcaccgcctacggcaacgccctgatcaagtgcggcgagacccagaagagaatcggcaccgccgacagagagctgatccagaccagcgccctgaacttcctgacccccctgagaaacttcatcgagggcgactacaagaccatcgccaaggagagaaagctgctgcagaacaagagactggacctggacgccgccaagaccagactgaagaaggccaaggccgccgagaccagaaacagcagcgagcaggagctgagaatcacccagagcgagttcgacagacaggccgagatcaccagactgctgctggagggcatcagcagcacccacgcccaccacctgagatgcctgaacgacttcgtggaggcccagatgacctactacgcccagtgctaccagtacatgctggacctgcagaagcagctgggcagcttccccagcaactacctgagcaacaacaaccagaccagcgtgacccccgtgcccagcgtgctgcccaacgccatcggcagcagcgccatggccagcaccagcggcctggtgatcaccagccccagcaacctgagcgacctgaaggagtgcagcggcagcagaaaggccagagtgctgtacgactacgacgccgccaacagcaccgagctgagcctgctggccgacgaggtgatcaccgtgttcagcgtggtgggcatggacagcgactggctgatgggcgagagaggcaaccagaagggcaaggtgcccatcacctacctggagctgctgaactag

SEQ ID NO: 103160 - DNA, 636 bp, Artificial Sequence
  Description of Artificial Sequence: Synthetic coding sequence
atggccggcgtgggcgccggccccctgagagccatgggcagacaggccctgctgctgctggccctgtgcgccaccggcgcccagggcctgtacttccacatcggcgagaccgagaagagatgcttcatcgaggagatccccgacgagaccatggtgatcggcaactacagaacccagggcatgcacgtggaggtgaaggaccccgacggcaaggtggtgctgagcagacagtacggcagcgagggcagattcaccttcaccagccacacccccggcgaccaccagatctgcctgcacagcaacagcaccagaatggccctgttcgccggcggcaagctgagagtgcacctggacatccaggtgggcgagcacgccaacaactaccccgagatcgccgccaaggacaagctgaccgagctgcagctgagagccagacagctgctggaccaggtggagcagatccagaaggagcaggactaccagagatacagagaggagagattcagactgaccagcgagagcaccaaccagagagtgctgtggtggagcatcgcccagaccgtgatcctgatcctgaccggcatctggcagatgagacacctgaagagcttcttcgaggccaagaagctggtgtag

SEQ ID NO: 103161 - DNA, 684 bp, Artificial Sequence
  Description of Artificial Sequence: Synthetic coding sequence
atggccggcgtgggcgccggccccctgagagccatgggcagacaggccctgctgctgctggccctgtgcgccaccggcgcccagggcctgtacttccacatcggcgagaccgagaagagatgcttcatcgaggagatccccgacgagaccatggtgatcggcaactacagaacccagatgtgggacaagcagaaggaggtgttcctgcccagcacccccggcctgggcatgcacgtggaggtgaaggaccccgacggcaaggtggtgctgagcagacagtacggcagcgagggcagattcaccttcaccagccacacccccggcgaccaccagatctgcctgcacagcaacagcaccagaatggccctgttcgccggcggcaagctgagagtgcacctggacatccaggtgggcgagcacgccaacaactaccccgagatcgccgccaaggacaagctgaccgagctgcagctgagagccagacagctgctggaccaggtggagcagatccagaaggagcaggactaccagagatacagagaggagagattcagactgaccagcgagagcaccaaccagagagtgctgtggtggagcatcgcccagaccgtgatcctgatcctgaccggcatctggcagatgagacacctgaagagcttcttcgaggccaagaagctggtgtag

SEQ ID NO: 103162 - DNA, 660 bp, Artificial Sequence
  Description of Artificial Sequence: Synthetic coding sequence
atgagcggcctgagcggcccccccgccagaagaggccccttccccctggccctgctgctgctgttcctgctgggccccagactggtgctggccatcagcttccacctgcccatcaacagcagaaagtgcctgagagaggagatccacaaggacctgctggtgaccggcgcctacgagatcagcgaccagagcggcggcgccggcggcctgagaagccacctgaagatcaccgacagcgccggccacatcctgtacagcaaggaggacgccaccaagggcaagttcgccttcaccaccgaggactacgacatgttcgaggtgtgcttcgagagcaagggcaccggcagaatccccgaccagctggtgatcctggacatgaagcacggcgtggaggccaagaactacgaggagatcgccaaggtggagaagctgaagcccctggaggtggagctgagaagactggaggacctgagcgagagcatcgtgaacgacttcgcctacatgaagaagagagaggaggagatgagagacaccaacgagagcaccaacaccagagtgctgtacttcagcatcttcagcatgttctgcctgatcggcctggccacctggcaggtgttctacctgagaagattcttcaaggccaagaagctgatcgagtag

SEQ ID NO: 103163 - DNA, 471 bp, Artificial Sequence
  Description of Artificial Sequence: Synthetic coding sequence
atggccggctggcccggcgccggccccctgtgcgtgctgggcggcgccgccctgggcgtgtgcctggccggcgtggccggccagctggtggagcccagcaccgccccccccaagcccaagcccccccccctgaccaaggagaccgtggtgttctgggacatgagactgtggcacgtggtgggcatcttcagcctgttcgtgctgagcatcatcatcaccctgtgctgcgtgttcaactgcagagtgcccagaaccagaaaggagatcgaggccagatacctgcagagaaaggccgccaagatgtacaccgacaagctggagaccgtgccccccctgaacgagctgaccgaggtgcccggcgaggacaagaagaagaagaagaagaagaagaaggacagcgtggacaccgtggccatcaaggtggaggaggacgagaagaacgaggccaagaagaagaagggcgagaagtag

SEQ ID NO: 103164 - DNA, 1602 bp, Artificial Sequence
  Description of Artificial Sequence: Synthetic coding sequence
atgaacgagagccccgaccccaccgacctggccggcgtgatcatcgagctgggccccaacgacagcccccagaccagcgagttcaagggcgccaccgaggaggcccccgccaaggagagcgtgctggccagactgagcaagttcgaggtggaggacgccgagaacgtggccagctacgacagcaagatcaagaagatcgtgcacagcatcgtgagcagcttcgccttcggcctgttcggcgtgttcctggtgctgctggacgtgaccctgatcctggccgacctgatcttcaccgacagcaagctgtacatccccctggagtacagaagcatcagcctggccatcgccctgttcttcctgatggacgtgctgctgagagtgttcgtggagagaagacagcagtacttcagcgacctgttcaacatcctggacaccgccatcatcgtgatcctgctgctggtggacgtggtgtacatcttcttcgacatcaagctgctgagaaacatccccagatggacccacctgctgagactgctgagactgatcatcctgctgagaatcttccacctgttccaccagaagagacagctggagaagctgatcagaagaagagtgagcgagaacaagagaagatacaccagagacggcttcgacctggacctgacctacgtgaccgagagaatcatcgccatgagcttccccagcagcggcagacagagcttctacagaaaccccatcaaggaggtggtgagattcctggacaagaagcacagaaaccactacagagtgtacaacctgtgcagcgagagagcctacgaccccaagcacttccacaacagagtggtgagaatcatgatcgacgaccacaacgtgcccaccctgcaccagatggtggtgttcaccaaggaggtgaacgagtggatggcccaggacctggagaacatcgtggccatccactgcaagggcggcaccgacagaaccggcaccatggtgtgcgccttcctgatcgccagcgagatctgcagcaccgccaaggagagcctgtactacttcggcgagagaagaaccgacaagacccacagcgagaagttccagggcgtgaagacccccagccagaagagatacgtggcctacttcgcccaggtgaagcacctgtacaactggaacctgccccccagaagaatcctgttcatcaagcacttcatcatctacagcatccccagatacgtgagagacctgaagatccagatcgagatggagaagaaggtggtgttcagcaccatcagcctgggcaagtgcagcgtgctggacaacatcaccaccgacaagatcctgatcgacgtgttcgacggcctgcccctgtacgacgacgtgaaggtgcagttcttctacagcaacctgcccacctactacgacaactgcagcttctacttctggctgcacaccagcttcatcgagaacaacagactgtacctgcccaagaacgagctggacaacctgcacaagcagaaggccagaagaatctaccccagcgacttcgccgtggagatcctgttcggcgagaagatgaccagcagcgacgtggtggccggcagcgactag

SEQ ID NO: 103165 - DNA, 1542 bp, Artificial Sequence
  Description of Artificial Sequence: Synthetic coding sequence
atgaacgagagccccgaccccaccgacctggccggcgtgatcatcgagctgggccccaacgacagcccccagaccagcgagttcaagggcgccaccgaggaggcccccgccaaggagagcagcaagatcaagaagatcgtgcacagcatcgtgagcagcttcgccttcggcctgttcggcgtgttcctggtgctgctggacgtgaccctgatcctggccgacctgatcttcaccgacagcaagctgtacatccccctggagtacagaagcatcagcctggccatcgccctgttcttcctgatggacgtgctgctgagagtgttcgtggagagaagacagcagtacttcagcgacctgttcaacatcctggacaccgccatcatcgtgatcctgctgctggtggacgtggtgtacatcttcttcgacatcaagctgctgagaaacatccccagatggacccacctgctgagactgctgagactgatcatcctgctgagaatcttccacctgttccaccagaagagacagctggagaagctgatcagaagaagagtgagcgagaacaagagaagatacaccagagacggcttcgacctggacctgacctacgtgaccgagagaatcatcgccatgagcttccccagcagcggcagacagagcttctacagaaaccccatcaaggaggtggtgagattcctggacaagaagcacagaaaccactacagagtgtacaacctgtgcagcgagagagcctacgaccccaagcacttccacaacagagtggtgagaatcatgatcgacgaccacaacgtgcccaccctgcaccagatggtggtgttcaccaaggaggtgaacgagtggatggcccaggacctggagaacatcgtggccatccactgcaagggcggcaccgacagaaccggcaccatggtgtgcgccttcctgatcgccagcgagatctgcagcaccgccaaggagagcctgtactacttcggcgagagaagaaccgacaagacccacagcgagaagttccagggcgtgaagacccccagccagaagagatacgtggcctacttcgcccaggtgaagcacctgtacaactggaacctgccccccagaagaatcctgttcatcaagcacttcatcatctacagcatccccagatacgtgagagacctgaagatccagatcgagatggagaagaaggtggtgttcagcaccatcagcctgggcaagtgcagcgtgctggacaacatcaccaccgacaagatcctgatcgacgtgttcgacggcctgcccctgtacgacgacgtgaaggtgcagttcttctacagcaacctgcccacctactacgacaactgcagcttctacttctggctgcacaccagcttcatcgagaacaacagactgtacctgcccaagaacgagctggacaacctgcacaagcagaaggccagaagaatctaccccagcgacttcgccgtggagatcctgttcggcgagaagatgaccagcagcgacgtggtggccggcagcgactag

SEQ ID NO: 103166 - DNA, 1656 bp, Artificial Sequence
  Description of Artificial Sequence: Synthetic coding sequence
atgaacgagagccccgaccccaccgacctggccggcgtgatcatcgagctgggccccaacgacagcccccagaccagcgagttcaagggcgccaccgaggaggcccccgccaaggagagcccccacaccagcgagttcaagggcgccgccagagtgagccccatcagcgagagcgtgctggccagactgagcaagttcgaggtggaggacgccgagaacgtggccagctacgacagcaagatcaagaagatcgtgcacagcatcgtgagcagcttcgccttcggcctgttcggcgtgttcctggtgctgctggacgtgaccctgatcctggccgacctgatcttcaccgacagcaagctgtacatccccctggagtacagaagcatcagcctggccatcgccctgttcttcctgatggacgtgctgctgagagtgttcgtggagagaagacagcagtacttcagcgacctgttcaacatcctggacaccgccatcatcgtgatcctgctgctggtggacgtggtgtacatcttcttcgacatcaagctgctgagaaacatccccagatggacccacctgctgagactgctgagactgatcatcctgctgagaatcttccacctgttccaccagaagagacagctggagaagctgatcagaagaagagtgagcgagaacaagagaagatacaccagagacggcttcgacctggacctgacctacgtgaccgagagaatcatcgccatgagcttccccagcagcggcagacagagcttctacagaaaccccatcaaggaggtggtgagattcctggacaagaagcacagaaaccactacagagtgtacaacctgtgcagcgagagagcctacgaccccaagcacttccacaacagagtggtgagaatcatgatcgacgaccacaacgtgcccaccctgcaccagatggtggtgttcaccaaggaggtgaacgagtggatggcccaggacctggagaacatcgtggccatccactgcaagggcggcaccgacagaaccggcaccatggtgtgcgccttcctgatcgccagcgagatctgcagcaccgccaaggagagcctgtactacttcggcgagagaagaaccgacaagacccacagcgagaagttccagggcgtgaagacccccagccagaagagatacgtggcctacttcgcccaggtgaagcacctgtacaactggaacctgccccccagaagaatcctgttcatcaagcacttcatcatctacagcatccccagatacgtgagagacctgaagatccagatcgagatggagaagaaggtggtgttcagcaccatcagcctgggcaagtgcagcgtgctggacaacatcaccaccgacaagatcctgatcgacgtgttcgacggcctgcccctgtacgacgacgtgaaggtgcagttcttctacagcaacctgcccacctactacgacaactgcagcttctacttctggctgcacaccagcttcatcgagaacaacagactgtacctgcccaagaacgagctggacaacctgcacaagcagaaggccagaagaatctaccccagcgacttcgccgtggagatcctgttcggcgagaagatgaccagcagcgacgtggtggccggcagcgactag

SEQ ID NO: 103167 - DNA, 1692 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccggcaccagcctgcccaagttcacctggagagagggccagaagcagctgcccctgatcggctgcgtgctgctgctgatcgccctggtggtgagcctgatcatcctgttccagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcgcccacatccaccccgcctgcctgcccatgcacggccagaccttcagcctgaacgagacctgctggatcaccggcttcggcaagaccagagagaccgacgacaagaccagccccttcctgagagaggtgcaggtgaacctgatcgacttcaagaagtgcaacgactacctggtgtacgacagctacctgacccccagaatgatgtgcgccggcgacctgagaggcggcagagacagctgccagggcgacagcggcggccccctggtgtgcgagcagaacaacagatggtacctggccggcgtgaccagctggggcaccggctgcggccagagaaacaagcccggcgtgtacaccaaggtgaccgaggtgctgccctggatctacagcaagatggagagcagcgccggctag

SEQ ID NO: 103168 - DNA, 1194 bp, Artificial Sequence
  Description of Artificial Sequence: Synthetic coding sequence
atggaccccgacagcgaccagcccctgaacagcctggtgaaggtgatcctggacaagtactacttcctgtgcggccagcccctgcacttcatccccagaaagcagctgtgcgacggcgagctggactgccccctgggcgaggacgaggagcactgcgtgaagagcttccccgagggccccgccgtggccgtgagactgagcaaggacagaagcaccctgcaggtgctggacagcgccaccggcaactggttcagcgcctgcttcgacaacttcaccgaggccctggccgagaccgcctgcagacagatgggctacagcagcaagcccaccttcagagccgtggagatcggccccgaccaggacctggacgtggtggagatcaccgagaacagccaggagctgagaatgagaaacagcagcggcccctgcctgagcggcagcctggtgagcctgcactgcctggcctgcggcaagagcctgaagacccccagagtggtgggcgtggaggaggccagcgtggacagctggccctggcaggtgagcatccagtacgacaagcagcacgtgtgcggcggcagcatcctggacccccactgggtgctgaccgccgcccactgcttcagaaagcacaccgacgtgttcaactggaaggtgagagccggcagcgacaagctgggcagcttccccagcctggccgtggccaagatcatcatcatcgagttcaaccccatgtaccccaaggacaacgacatcgccctgatgaagctgcagttccccctgaccttcagcggcaccgtgagacccatctgcctgcccttcttcgacgaggagctgacccccgccacccccctgtggatcatcggctggggcttcaccaagcagaacggcggcaagatgagcgacatcctgctgcaggccagcgtgcaggtgatcgacagcaccagatgcaacgccgacgacgcctaccagggcgaggtgaccgagaagatgatgtgcgccggcatccccgagggcggcgtggacacctgccagggcgacagcggcggccccctgatgtaccagagcgaccagtggcacgtggtgggcatcgtgagctggggctacggctgcggcggccccagcacccccggcgtgtacaccaaggtgagcgcctacctgaactggatctacaacgtgtggaaggccgagctgtag

SEQ ID NO: 103169 - DNA, 1266 bp, Artificial Sequence
  Description of Artificial Sequence: Synthetic coding sequence
atgatgtacagaaccgtgggcttcggcaccagaagcagaaacctgaagccctggatgatcgccgtgctgatcgtgctgagcctgaccgtggtggccgtgaccatcggcctgctggtgcacttcctggtgttcgaccagaagaaggagtactaccacggcagcttcaagatcctggacccccagatcaacaacaacttcggccagagcaacacctaccagctgaaggacctgagagagaccaccgagaacctggtgagccaggtggacgagatcttcatcgacagcgcctggaagaagaactacatcaagaaccaggtggtgagactgacccccgaggaggacggcgtgaaggtggacgtgatcatggtgttccagttccccagcaccgagcagagagccgtgagagagaagaagatccagagcatcctgaaccagaagatcagaaacctgagagccctgcccatcaacgccagcagcgtgcaggtgaacgccatgagcagcagcaccggcgagctgaccgtgcaggccagctgcggcaagagagtggtgcccctgaacgtgaacagaatcgccagcggcgtgatcgcccccaaggccgcctggccctggcaggccagcctgcagtacgacaacatccaccagtgcggcgccaccctgatcagcaacacctggctggtgaccgccgcccactgcttccagaagtacaagaacccccaccagtggaccgtgagcttcggcaccaagatcaacccccccctgatgaagagaaacgtgagaagattcatcatccacgagaagtacagaagcgccgccagagagtacgacatcgccgtggtgcaggtgagcagcagagtgaccttcagcgacgacatcagacagatctgcctgcccgaggccagcgccagcttccagcccaacctgaccgtgcacatcaccggcttcggcgccctgtactacggcggcgagagccagaacgacctgagagaggccagagtgaagatcatcagcgacgacgtgtgcaagcagccccaggtgtacggcaacgacatcaagcccggcatgttctgcgccggctacatggagggcatctacgacgcctgcagaggcgacagcggcggccccctggtgaccagagacctgaaggacacctggtacctgatcggcatcgtgagctggggcgacaactgcggccagaaggacaagcccggcgtgtacacccaggtgacctactacagaaactggatcgccagcaagaccggcatctag

SEQ ID NO: 103170 - DNA, 1257 bp, Artificial Sequence
  Description of Artificial Sequence: Synthetic coding sequence
atgatgtacagaaccgtgggcttcggcaccagaagcagaaacctgaagccctggatgatcgccgtgctgatcgtgctgagcctgaccgtggtggccgtgaccatcggcctgctggtgcacttcctggtgttcgaccagaagaaggagtactaccacggcagcttcaagatcctggacccccagatcaacaacaacttcggccagagcaacacctaccagctgaaggacctgagagagaccaccgagaacctggtggacgagatcttcatcgacagcgcctggaagaagaactacatcaagaaccaggtggtgagactgacccccgaggaggacggcgtgaaggtggacgtgatcatggtgttccagttccccagcaccgagcagagagccgtgagagagaagaagatccagagcatcctgaaccagaagatcagaaacctgagagccctgcccatcaacgccagcagcgtgcaggtgaacgccatgagcagcagcaccggcgagctgaccgtgcaggccagctgcggcaagagagtggtgcccctgaacgtgaacagaatcgccagcggcgtgatcgcccccaaggccgcctggccctggcaggccagcctgcagtacgacaacatccaccagtgcggcgccaccctgatcagcaacacctggctggtgaccgccgcccactgcttccagaagtacaagaacccccaccagtggaccgtgagcttcggcaccaagatcaacccccccctgatgaagagaaacgtgagaagattcatcatccacgagaagtacagaagcgccgccagagagtacgacatcgccgtggtgcaggtgagcagcagagtgaccttcagcgacgacatcagacagatctgcctgcccgaggccagcgccagcttccagcccaacctgaccgtgcacatcaccggcttcggcgccctgtactacggcggcgagagccagaacgacctgagagaggccagagtgaagatcatcagcgacgacgtgtgcaagcagccccaggtgtacggcaacgacatcaagcccggcatgttctgcgccggctacatggagggcatctacgacgcctgcagaggcgacagcggcggccccctggtgaccagagacctgaaggacacctggtacctgatcggcatcgtgagctggggcgacaactgcggccagaaggacaagcccggcgtgtacacccaggtgacctactacagaaactggatcgccagcaagaccggcatctag

SEQ ID NO: 103171 - DNA, 1254 bp, Artificial Sequence
  Description of Artificial Sequence: Synthetic coding sequence
atgtacagaaccgtgggcttcggcaccagaagcagaaacctgaagccctggatgatcgccgtgctgatcgtgctgagcctgaccgtggtggccgtgaccatcggcctgctggtgcacttcctggtgttcgaccagaagaaggagtactaccacggcagcttcaagatcctggacccccagatcaacaacaacttcggccagagcaacacctaccagctgaaggacctgagagagaccaccgagaacctggtggacgagatcttcatcgacagcgcctggaagaagaactacatcaagaaccaggtggtgagactgacccccgaggaggacggcgtgaaggtggacgtgatcatggtgttccagttccccagcaccgagcagagagccgtgagagagaagaagatccagagcatcctgaaccagaagatcagaaacctgagagccctgcccatcaacgccagcagcgtgcaggtgaacgccatgagcagcagcaccggcgagctgaccgtgcaggccagctgcggcaagagagtggtgcccctgaacgtgaacagaatcgccagcggcgtgatcgcccccaaggccgcctggccctggcaggccagcctgcagtacgacaacatccaccagtgcggcgccaccctgatcagcaacacctggctggtgaccgccgcccactgcttccagaagtacaagaacccccaccagtggaccgtgagcttcggcaccaagatcaacccccccctgatgaagagaaacgtgagaagattcatcatccacgagaagtacagaagcgccgccagagagtacgacatcgccgtggtgcaggtgagcagcagagtgaccttcagcgacgacatcagacagatctgcctgcccgaggccagcgccagcttccagcccaacctgaccgtgcacatcaccggcttcggcgccctgtactacggcggcgagagccagaacgacctgagagaggccagagtgaagatcatcagcgacgacgtgtgcaagcagccccaggtgtacggcaacgacatcaagcccggcatgttctgcgccggctacatggagggcatctacgacgcctgcagaggcgacagcggcggccccctggtgaccagagacctgaaggacacctggtacctgatcggcatcgtgagctggggcgacaactgcggccagaaggacaagcccggcgtgtacacccaggtgacctactacagaaactggatcgccagcaagaccggcatctag

SEQ ID NO: 103172 - DNA, 1689 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccctgcaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccggcaccagcctgcccaagttcacctggagagagggccagaagcagctgcccctgatcggctgcgtgctgctgctgatcgccctggtggtgagcctgatcatcctgttccagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcgcccacatccaccccgcctgcctgcccatgcacggccagaccttcagcctgaacgagacctgctggatcaccggcttcggcaagaccagagagaccgacgacaagaccagccccttcctgagagaggtgcaggtgaacctgatcgacttcaagaagtgcaacgactacctggtgtacgacagctacctgacccccagaatgatgtgcgccggcgacctgagaggcggcagagacagctgccagggcgacagcggcggccccctggtgtgcgagcagaacaacagatggtacctggccggcgtgaccagctggggcaccggctgcggccagagaaacaagcccggcgtgtacaccaaggtgaccgaggtgctgccctggatctacagcaagatggagagcgaggtgagattcagaaagagctag

SEQ ID NO: 103173 - DNA, 1761 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccggcaccagcctgcccaagttcacctggagagagggccagaagcagctgcccctgatcggctgcgtgctgctgctgatcgccctggtggtgagcctgatcatcctgttccagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcgcccacatccaccccgcctgcctgcccatgcacggccagaccttcagcctgaacgagacctgctggatcaccggcttcggcaagaccagagagaccgacgacaagaccagccccttcctgagagaggtgcaggtgaacctgatcgacttcaagaagtgcaacgactacctggtgtacgacagctacctgacccccagaatgatgtgcgccggcgacctgagaggcggcagagacagctgccagggcgacagcggcggccccctggtgtgcgagcagaacaacagatggtacctggccggcgtgaccagctggggcaccggctgcggccagagaaacaagcccggcgtgtacaccaaggtgaccgaggtgctgccctggatctacagcaagatggaggtgagaagcctgcagcaggacaccgcccccagcagactgggcaccagcagcggcggcgaccccggcggcgcccccagactgtag

SEQ ID NO: 103174 - DNA, 1704 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccggcaccagcctgcccaagttcacctggagagagggccagaagcagctgcccctgatcggctgcgtgctgctgctgatcgccctggtggtgagcctgatcatcctgttccagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcgcccacatccaccccgcctgcctgcccatgcacggccagaccttcagcctgaacgagacctgctggatcaccggcttcggcaagaccagagagaccgacgacaagaccagccccttcctgagagaggtgcaggtgaacctgatcgacttcaagaagtgcaacgactacctggtgtacgacagctacctgacccccagaatgatgtgcgccggcgacctgagaggcggcagagacagctgccagggcgacagcggcggccccctggtgtgcgagcagaacaacagatggtacctggccggcgtgaccagctggggcaccggctgcggccagagaaacaagcccggcgtgtacaccaaggtgaccgaggtgctgccctggatctacagcaagatggagagcgaggtgagattcagaaagagctag

SEQ ID NO: 103175 - DNA, 1476 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccggcaccagcctgcccaagttcacctggagagagggccagaagcagctgcccctgatcggctgcgtgctgctgctgatcgccctggtggtgagcctgatcatcctgttccagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcggcgagggcatctgcacccccagaagccccgccccccagccccagcaccccctgcagcccagccacctgagcgccagcgtgaacagctaccccggccccaaggccagcgccggccagaagagcaagaccctgaaggacccctacatggagcacttctgcttcatcatcagagagaccgaggcccagggcctgtag

SEQ ID NO: 103176 - DNA, 1599 bp, Artificial Sequence
  Description of Artificial Sequence: Synthetic coding sequence
atggagagagacagccacggcaacgccagccccgccagaacccccagcgccggcgccagccccgcccaggccagccccgccggcaccccccccggcagagccagccccgcccaggccagccccgcccaggccagccccgccggcaccccccccggcagagccagccccgcccaggccagccccgccggcaccccccccggcagagccagccccggcagagccagccccgcccaggccagccccgcccaggccagccccgccagagccagccccgccctggccagcctgagcagaagcagcagcggcagaagcagcagcgccagaagcgccagcgtgaccaccagccccaccagagtgtacctggtgagagccacccccgtgggcgccgtgcccatcagaagcagccccgccagaagcgcccccgccaccagagccaccagagagagccccgtgcagttctggcagggccacaccggcatcagatacaaggagcagagagagagctgccccaagcacgccgtgagatgcgacggcgtggtggactgcaagctgaagagcgacgagctgggctgcgtgagattcgactgggacaagagcctgctgaagatctacagcggcagcagccaccagtggctgcccatctgcagcagcaactggaacgacagctacagcgagaagacctgccagcagctgggcttcgagagcgcccacagaaccaccgaggtggcccacagagacttcgccaacagcttcagcatcctgagatacaacagcaccatccaggagagcctgcacagaagcgagtgccccagccagagatacatcagcctgcagtgcagccactgcggcctgagagccatgaccggcagaatcgtgggcggcgccctggccagcgacagcaagtggccctggcaggtgagcctgcacttcggcaccacccacatctgcggcggcaccctgatcgacgcccagtgggtgctgaccgccgcccactgcttcttcgtgaccagagagaaggtgctggagggctggaaggtgtacgccggcaccagcaacctgcaccagctgcccgaggccgccagcatcgccgagatcatcatcaacagcaactacaccgacgaggaggacgactacgacatcgccctgatgagactgagcaagcccctgaccctgagcgcccacatccaccccgcctgcctgcccatgcacggccagaccttcagcctgaacgagacctgctggatcaccggcttcggcaagaccagagagaccgacgacaagaccagccccttcctgagagaggtgcaggtgaacctgatcgacttcaagaagtgcaacgactacctggtgtacgacagctacctgacccccagaatgatgtgcgccggcgacctgagaggcggcagagacagctgccagggcgacagcggcggccccctggtgtgcgagcagaacaacagatggtacctggccggcgtgaccagctggggcaccggctgcggccagagaaacaagcccggcgtgtacaccaaggtgaccgaggtgctgccctggatctacagcaagatggagagcgaggtgagattcagaaagagctag

SEQ ID NO: 103177 - DNA, 1365 bp, Artificial Sequence
  Description of Artificial Sequence: Synthetic coding sequence
atgggcgagaacgacccccccgccgtggaggcccccttcagcttcagaagcctgttcggcctggacgacctgaagatcagccccgtggcccccgacgccgacgccgtggccgcccagatcctgagcctgctgcccctgaagttcttccccatcatcgtgatcggcatcatcgccctgatcctggccctggccatcggcctgggcatccacttcgactgcagcggcaagtacagatgcagaagcagcttcaagtgcatcgagctgatcgccagatgcgacggcgtgagcgactgcaaggacggcgaggacgagtacagatgcgtgagagtgggcggccagaacgccgtgctgcaggtgttcaccgccgccagctggaagaccatgtgcagcgacgactggaagggccactacgccaacgtggcctgcgcccagctgggcttccccagctacgtgagcagcgacaacctgagagtgagcagcctggagggccagttcagagaggagttcgtgagcatcgaccacctgctgcccgacgacaaggtgaccgccctgcaccacagcgtgtacgtgagagagggctgcgccagcggccacgtggtgaccctgcagtgcaccgcctgcggccacagaagaggctacagcagcagaatcgtgggcggcaacatgagcctgctgagccagtggccctggcaggccagcctgcagttccagggctaccacctgtgcggcggcagcgtgatcacccccctgtggatcatcaccgccgcccactgcgtgtacgacctgtacctgcccaagagctggaccatccaggtgggcctggtgagcctgctggacaaccccgcccccagccacctggtggagaagatcgtgtaccacagcaagtacaagcccaagagactgggcaacgacatcgccctgatgaagctggccggccccctgaccttcaacgagatgatccagcccgtgtgcctgcccaacagcgaggagaacttccccgacggcaaggtgtgctggaccagcggctggggcgccaccgaggacggcgccggcgacgccagccccgtgctgaaccacgccgccgtgcccctgatcagcaacaagatctgcaaccacagagacgtgtacggcggcatcatcagccccagcatgctgtgcgccggctacctgaccggcggcgtggacagctgccagggcgacagcggcggccccctggtgtgccaggagagaagactgtggaagctggtgggcgccaccagcttcggcatcggctgcgccgaggtgaacaagcccggcgtgtacaccagagtgaccagcttcctggactggatccacgagcagatggagagagacctgaagacctag

SEQ ID NO: 103178 - DNA, 1617 bp, Artificial Sequence
  Description of Artificial Sequence: Synthetic coding sequence
atgcaggccgtgggccccaagcccctgcccaccctgctgtgcggcggcagaaccggccacagaaccgccagagtgctgagcttcctgatcagaagctgcccctgcgagcccggcaagggctgcgtgtacggcaagcccgtgaccctgtggcccaccatcagcagcgtggtgcccagcaccttcctgggcctgggcaactacgaggtggaggtggaggccgagcccgacgtgagaggccccgagatcgtgaccatgggcgagaacgacccccccgccgtggaggcccccttcagcttcagaagcctgttcggcctggacgacctgaagatcagccccgtggcccccgacgccgacgccgtggccgcccagatcctgagcctgctgcccctgaagttcttccccatcatcgtgatcggcatcatcgccctgatcctggccctggccatcggcctgggcatccacttcgactgcagcggcaagtacagatgcagaagcagcttcaagtgcatcgagctgatcgccagatgcgacggcgtgagcgactgcaaggacggcgaggacgagtacagatgcgtgagagtgggcggccagaacgccgtgctgcaggtgttcaccgccgccagctggaagaccatgtgcagcgacgactggaagggccactacgccaacgtggcctgcgcccagctgggcttccccagctacgtgagcagcgacaacctgagagtgagcagcctggagggccagttcagagaggagttcgtgagcatcgaccacctgctgcccgacgacaaggtgaccgccctgcaccacagcgtgtacgtgagagagggctgcgccagcggccacgtggtgaccctgcagtgcaccgcctgcggccacagaagaggctacagcagcagaatcgtgggcggcaacatgagcctgctgagccagtggccctggcaggccagcctgcagttccagggctaccacctgtgcggcggcagcgtgatcacccccctgtggatcatcaccgccgcccactgcgtgtacgacctgtacctgcccaagagctggaccatccaggtgggcctggtgagcctgctggacaaccccgcccccagccacctggtggagaagatcgtgtaccacagcaagtacaagcccaagagactgggcaacgacatcgccctgatgaagctggccggccccctgaccttcaacgagatgatccagcccgtgtgcctgcccaacagcgaggagaacttccccgacggcaaggtgtgctggaccagcggctggggcgccaccgaggacggcgccggcgacgccagccccgtgctgaaccacgccgccgtgcccctgatcagcaacaagatctgcaaccacagagacgtgtacggcggcatcatcagccccagcatgctgtgcgccggctacctgaccggcggcgtggacagctgccagggcgacagcggcggccccctggtgtgccaggagagaagactgtggaagctggtgggcgccaccagcttcggcatcggctgcgccgaggtgaacaagcccggcgtgtacaccagagtgaccagcttcctggactggatccacgagcagatggagagagacctgaagacctag

SEQ ID NO: 103179 - DNA, 1035 bp, Artificial Sequence
  Description of Artificial Sequence: Synthetic coding sequence
atgggcgagaacgacccccccgccgtggaggcccccttcagcttcagaagcctgttcggcctggacgacctgaagatcagccccgtggcccccgacgccgacgccgtggccgcccagatcctgagcctgctgcccctgaagttcttccccatcatcgtgatcggcatcatcgccctgatcctggccctggccatcggcctgggcatccacttcgactgcagcggcaagtacagatgcagaagcagcttcaagtgcatcgagctgatcgccagatgcgacggcgtgagcgactgcaaggacggcgaggacgagtacagatgcgtgagagtgggcggccagaacgccgtgctgcaggtgttcaccgccgccagctggaagaccatgtgcagcgacgactggaagggccactacgccaacgtggcctgcgcccagctgggcttccccagctacgtgagcagcgacaacctgagagtgagcagcctggagggccagttcagagaggagttcgtgagcatcgaccacctgctgcccgacgacaaggtgaccgccctgcaccacagcgtgtacgtgagagagggctgcgccagcggccacgtggtgaccctgcagtgcaccgcctgcggccacagaagaggctacagcagcagaatcgtgggcggcaacatgagcctgctgagccagtggccctggcaggccagcctgcagttccagggctaccacctgtgcggcggcagcgtgatcacccccctgtggatcatcaccgccgcccactgcgtgtacgacctgtacctgcccaagagctggaccatccaggtgggcctggtgagcctgctggacaaccccgcccccagccacctggtggagaagatcgtgtaccacagcaagtacaagcccaagagactgggcaacgacatcgccctgatgaagctggccggccccctgaccttcaacggcaccagcggcagcctgtgcggcagcgccgccctgcccctgttccaggaggacctgcagctgctgatcgaggccttcctgtag

SEQ ID NO: 103180 - DNA, 1362 bp, Artificial Sequence
  Description of Artificial Sequence: Synthetic coding sequence
atgggcgagaacgacccccccgccgtggaggcccccttcagcttcagaagcctgttcggcctggacgacctgaagatcagccccgtggcccccgacgccgacgccgtggccgcccagatcctgagcctgctgcccctgaagttcttccccatcatcgtgatcggcatcatcgccctgatcctggccctggccatcggcctgggcatccacttcgactgcagcggcaagtacagatgcagaagcagcttcaagtgcatcgagctgatcgccagatgcgacggcgtgagcgactgcaaggacggcgaggacgagtacagatgcgtgagagtgggcggccagaacgccgtgctgcaggtgttcaccgccgccagctggaagaccatgtgcagcgacgactggaagggccactacgccaacgtggcctgcgcccagctgggcttccccagctacgtgagcagcgacaacctgagagtgagcagcctggagggccagttcagagaggagttcgtgagcatcgaccacctgctgcccgacgacaaggtgaccgccctgcaccacagcgtgtacgtgagagagggctgcgccagcggccacgtggtgaccctgcagtgcaccgcctgcggccacagaagaggctacagcagcagaatcgtgggcggcaacatgagcctgctgagccagtggccctggcaggccagcctgcagttccagggctaccacctgtgcggcggcagcgtgatcacccccctgtggatcatcaccgccgcccactgcgtgtacgacctgtacctgcccaagagctggaccatccaggtgggcctggtgagcctgctggacaaccccgcccccagccacctggtggagaagatcgtgtaccacagcaagtacaagcccaagagactgggcaacgacatcgccctgatgaagctggccggccccctgaccttcaacgagatgatccagcccgtgtgcctgcccaacagcgaggagaacttccccgacggcaaggtgtgctggaccagcggctggggcgccaccgaggacggcggcgacgccagccccgtgctgaaccacgccgccgtgcccctgatcagcaacaagatctgcaaccacagagacgtgtacggcggcatcatcagccccagcatgctgtgcgccggctacctgaccggcggcgtggacagctgccagggcgacagcggcggccccctggtgtgccaggagagaagactgtggaagctggtgggcgccaccagcttcggcatcggctgcgccgaggtgaacaagcccggcgtgtacaccagagtgaccagcttcctggactggatccacgagcagatggagagagacctgaagacctag

SEQ ID NO: 103181 - DNA, 1314 bp, Artificial Sequence
  Description of Artificial Sequence: Synthetic coding sequence
atgctgcaggaccccgacagcgaccagcccctgaacagcctggacgtgaagcccctgagaaagcccagaatccccatggagaccttcagaaaggtgggcatccccatcatcatcgccctgctgagcctggccagcatcatcatcgtggtggtgctgatcaaggtgatcctggacaagtactacttcctgtgcggccagcccctgcacttcatccccagaaagcagctgtgcgacggcgagctggactgccccctgggcgaggacgaggagcactgcgtgaagagcttccccgagggccccgccgtggccgtgagactgagcaaggacagaagcaccctgcaggtgctggacagcgccaccggcaactggttcagcgcctgcttcgacaacttcaccgaggccctggccgagaccgcctgcagacagatgggctacagcagcaagcccaccttcagagccgtggagatcggccccgaccaggacctggacgtggtggagatcaccgagaacagccaggagctgagaatgagaaacagcagcggcccctgcctgagcggcagcctggtgagcctgcactgcctggcctgcggcaagagcctgaagacccccagagtggtgggcgtggaggaggccagcgtggacagctggccctggcaggtgagcatccagtacgacaagcagcacgtgtgcggcggcagcatcctggacccccactgggtgctgaccgccgcccactgcttcagaaagcacaccgacgtgttcaactggaaggtgagagccggcagcgacaagctgggcagcttccccagcctggccgtggccaagatcatcatcatcgagttcaaccccatgtaccccaaggacaacgacatcgccctgatgaagctgcagttccccctgaccttcagcggcaccgtgagacccatctgcctgcccttcttcgacgaggagctgacccccgccacccccctgtggatcatcggctggggcttcaccaagcagaacggcggcaagatgagcgacatcctgctgcaggccagcgtgcaggtgatcgacagcaccagatgcaacgccgacgacgcctaccagggcgaggtgaccgagaagatgatgtgcgccggcatccccgagggcggcgtggacacctgccagggcgacagcggcggccccctgatgtaccagagcgaccagtggcacgtggtgggcatcgtgagctggggctacggctgcggcggccccagcacccccggcgtgtacaccaaggtgagcgcctacctgaactggatctacaacgtgtggaaggccgagctgtag

SEQ ID NO: 103182 - DNA, 1299 bp, Artificial Sequence
  Description of Artificial Sequence: Synthetic coding sequence
atgctgcaggaccccgacagcgaccagcccctgaacagcctggacgtgaagcccctgagaaagcccagaatccccatggagaccttcagaaaggtgggcatccccatcatcatcgccctgctgagcctggccagcatcatcatcgtggtggtgctgatcaaggtgatcctggacaagtactacttcctgtgcggccagcccctgcacttcatccccagaaagcagctgtgcgacggcgagctggactgccccctgggcgaggacgaggagcactgcgtgaagagcttccccgagggccccgccgtggccgtgagactgagcaaggacagaagcaccctgcaggtgctggacagcgccaccggcaactggttcagcgcctgcttcgacaacttcaccgaggccctggccgagaccgcctgcagacagatgggctacagcagagccgtggagatcggccccgaccaggacctggacgtggtggagatcaccgagaacagccaggagctgagaatgagaaacagcagcggcccctgcctgagcggcagcctggtgagcctgcactgcctggcctgcggcaagagcctgaagacccccagagtggtgggcgtggaggaggccagcgtggacagctggccctggcaggtgagcatccagtacgacaagcagcacgtgtgcggcggcagcatcctggacccccactgggtgctgaccgccgcccactgcttcagaaagcacaccgacgtgttcaactggaaggtgagagccggcagcgacaagctgggcagcttccccagcctggccgtggccaagatcatcatcatcgagttcaaccccatgtaccccaaggacaacgacatcgccctgatgaagctgcagttccccctgaccttcagcggcaccgtgagacccatctgcctgcccttcttcgacgaggagctgacccccgccacccccctgtggatcatcggctggggcttcaccaagcagaacggcggcaagatgagcgacatcctgctgcaggccagcgtgcaggtgatcgacagcaccagatgcaacgccgacgacgcctaccagggcgaggtgaccgagaagatgatgtgcgccggcatccccgagggcggcgtggacacctgccagggcgacagcggcggccccctgatgtaccagagcgaccagtggcacgtggtgggcatcgtgagctggggctacggctgcggcggccccagcacccccggcgtgtacaccaaggtgagcgcctacctgaactggatctacaacgtgtggaaggccgagctgtag

SEQ ID NO: 103183 - DNA, 1308 bp, Artificial Sequence
  Description of Artificial Sequence: Synthetic coding sequence
atggaccccgacagcgaccagcccctgaacagcctggacgtgaagcccctgagaaagcccagaatccccatggagaccttcagaaaggtgggcatccccatcatcatcgccctgctgagcctggccagcatcatcatcgtggtggtgctgatcaaggtgatcctggacaagtactacttcctgtgcggccagcccctgcacttcatccccagaaagcagctgtgcgacggcgagctggactgccccctgggcgaggacgaggagcactgcgtgaagagcttccccgagggccccgccgtggccgtgagactgagcaaggacagaagcaccctgcaggtgctggacagcgccaccggcaactggttcagcgcctgcttcgacaacttcaccgaggccctggccgagaccgcctgcagacagatgggctacagcagcaagcccaccttcagagccgtggagatcggccccgaccaggacctggacgtggtggagatcaccgagaacagccaggagctgagaatgagaaacagcagcggcccctgcctgagcggcagcctggtgagcctgcactgcctggcctgcggcaagagcctgaagacccccagagtggtgggcgtggaggaggccagcgtggacagctggccctggcaggtgagcatccagtacgacaagcagcacgtgtgcggcggcagcatcctggacccccactgggtgctgaccgccgcccactgcttcagaaagcacaccgacgtgttcaactggaaggtgagagccggcagcgacaagctgggcagcttccccagcctggccgtggccaagatcatcatcatcgagttcaaccccatgtaccccaaggacaacgacatcgccctgatgaagctgcagttccccctgaccttcagcggcaccgtgagacccatctgcctgcccttcttcgacgaggagctgacccccgccacccccctgtggatcatcggctggggcttcaccaagcagaacggcggcaagatgagcgacatcctgctgcaggccagcgtgcaggtgatcgacagcaccagatgcaacgccgacgacgcctaccagggcgaggtgaccgagaagatgatgtgcgccggcatccccgagggcggcgtggacacctgccagggcgacagcggcggccccctgatgtaccagagcgaccagtggcacgtggtgggcatcgtgagctggggctacggctgcggcggccccagcacccccggcgtgtacaccaaggtgagcgcctacctgaactggatctacaacgtgtggaaggccgagctgtag

SEQ ID NO: 103184 - DNA, 1374 bp, Artificial Sequence
  Description of Artificial Sequence: Synthetic coding sequence
atgagcctgatgctggacgaccagccccccatggaggcccagtacgccgaggagggccccggccccggcatcttcagagccgagcccggcgaccagcagcaccccatcagccaggccgtgtgctggagaagcatgagaagaggctgcgccgtgctgggcgccctgggcctgctggccggcgccggcgtgggcagctggctgctggtgctgtacctgtgccccgccgccagccagcccatcagcggcaccctgcaggacgaggagatcaccctgagctgcagcgaggccagcgccgaggaggccctgctgcccgccctgcccaagaccgtgagcttcagaatcaacagcgaggacttcctgctggaggcccaggtgagagaccagcccagatggctgctggtgtgccacgagggctggagccccgccctgggcctgcagatctgctggagcctgggccacctgagactgacccaccacaagggcgtgaacctgaccgacatcaagctgaacagcagccaggagttcgcccagctgagccccagactgggcggcttcctggaggaggcctggcagcccagaaacaactgcaccagcggccaggtggtgagcctgagatgcagcgagtgcggcgccagacccctggccagcagaatcgtgggcggccagagcgtggcccccggcagatggccctggcaggccagcgtggccctgggcttcagacacacctgcggcggcagcgtgctggcccccagatgggtggtgaccgccgcccactgcatgcacagcttcagactggccagactgagcagctggagagtgcacgccggcctggtgagccacagcgccgtgagaccccaccagggcgccctggtggagagaatcatcccccaccccctgtacagcgcccagaaccacgactacgacgtggccctgctgagactgcagaccgccctgaacttcagcgacaccgtgggcgccgtgtgcctgcccgccaaggagcagcacttccccaagggcagcagatgctgggtgagcggctggggccacacccaccccagccacacctacagcagcgacatgctgcaggacaccgtggtgcccctgttcagcacccagctgtgcaacagcagctgcgtgtacagcggcgccctgacccccagaatgctgtgcgccggctacctggacggcagagccgacgcctgccagggcgacagcggcggccccctggtgtgccccgacggcgacacctggagactggtgggcgtggtgagctggggcagaggctgcgccgagcccaaccaccccggcgtgtacgccaaggtggccgagttcctggactggatccacgacaccgcccaggacagcctgctgtag

SEQ ID NO: 103185 - DNA, 2436 bp, Artificial Sequence
  Description of Artificial Sequence: Synthetic coding sequence
atgctgctgctgttccacagcaagagaatgcccgtggccgaggccccccaggtggccggcggccagggcgacggcggcgacggcgaggaggccgagcccgagggcatgttcaaggcctgcgaggacagcaagagaaaggccagaggctacctgagactggtgcccctgttcgtgctgctggccctgctggtgctggccagcgccggcgtgctgctgtggtacttcctgggctacaaggccgaggtgatggtgagccaggtgtacagcggcagcctgagagtgctgaacagacacttcagccaggacctgaccagaagagagagcagcgccttcagaagcgagaccgccaaggcccagaagatgctgaaggagctgatcaccagcaccagactgggcacctactacaacagcagcagcgtgtacagcttcggcgagggccccctgacctgcttcttctggttcatcctgcagatccccgagcacagaagactgatgctgagccccgaggtggtgcaggccctgctggtggaggagctgctgagcaccgtgaacagcagcgccgccgtgccctacagagccgagtacgaggtggaccccgagggcctggtgatcctggaggccagcgtgaaggacatcgccgccctgaacagcaccctgggctgctacagatacagctacgtgggccagggccaggtgctgagactgaagggccccgaccacctggccagcagctgcctgtggcacctgcagggccccaaggacctgatgctgaagctgagactggagtggaccctggccgagtgcagagacagactggccatgtacgacgtggccggccccctggagaagagactgatcaccagcgtgtacggctgcagcagacaggagcccgtggtggaggtgctggccagcggcgccatcatggccgtggtgtggaagaagggcctgcacagctactacgaccccttcgtgctgagcgtgcagcccgtggtgttccaggcctgcgaggtgaacctgaccctggacaacagactggacagccagggcgtgctgagcaccccctacttccccagctactacagcccccagacccactgcagctggcacctgaccgtgcccagcctggactacggcctggccctgtggttcgacgcctacgccctgagaagacagaagtacgacctgccctgcacccagggccagtggaccatccagaacagaagactgtgcggcctgagaatcctgcagccctacgccgagagaatccccgtggtggccaccgccggcatcaccatcaacttcaccagccagatcagcctgaccggccccggcgtgagagtgcactacggcctgtacaaccagagcgacccctgccccggcgagttcctgtgcagcgtgaacggcctgtgcgtgcccgcctgcgacggcgtgaaggactgccccaacggcctggacgagagaaactgcgtgtgcagagccaccttccagtgcaaggaggacagcacctgcatcagcctgcccaaggtgtgcgacggccagcccgactgcctgaacggcagcgacgaggagcagtgccaggagggcgtgccctgcggcaccttcaccttccagtgcgaggacagaagctgcgtgaagaagcccaacccccagtgcgacggcagacccgactgcagagacggcagcgacgaggagcactgcgactgcggcctgcagggccccagcagcagaatcgtgggcggcgccgtgagcagcgagggcgagtggccctggcaggccagcctgcaggtgagaggcagacacatctgcggcggcgccctgatcgccgacagatgggtgatcaccgccgcccactgcttccaggaggacagcatggccagcaccgtgctgtggaccgtgttcctgggcaaggtgtggcagaacagcagatggcccggcgaggtgagcttcaaggtgagcagactgctgctgcacccctaccacgaggaggacagccacgactacgacgtggccctgctgcagctggaccaccccgtggtgagaagcgccgccgtgagacccgtgtgcctgcccgccagaagccacttcttcgagcccggcctgcactgctggatcaccggctggggcgccctgagagagggcggccccatcagcaacgccctgcagaaggtggacgtgcagctgatcccccaggacctgtgcagcgaggtgtacagataccaggtgacccccagaatgctgtgcgccggctacagaaagggcaagaaggacgcctgccagggcgacagcggcggccccctggtgtgcaaggccctgagcggcagatggttcctggccggcctggtgagctggggcctgggctgcggcagacccaactacttcggcgtgtacaccagaatcaccggcgtgatcagctggatccagcaggtggtgacctag

SEQ ID NO: 103186 - DNA, 2475 bp, Artificial Sequence
  Description of Artificial Sequence: Synthetic coding sequence
atgcccgtggccgaggccccccaggtggccggcggccagggcgacggcggcgacggcgaggaggccgagcccgagggcatgttcaaggcctgcgaggacagcaagagaaaggccagaggctacctgagactggtgcccctgttcgtgctgctggccctgctggtgctggccagcgccggcgtgctgctgtggtacttcctgggctacaaggccgaggtgatggtgagccaggtgtacagcggcagcctgagagtgctgaacagacacttcagccaggacctgaccagaagagagagcagcgccttcagaagcgagaccgccaaggcccagaagatgctgaaggagctgatcaccagcaccagactgggcacctactacaacagcagcagcgtgtacagcttcggcgagggccccctgacctgcttcttctggttcatcctgcagatccccgagcacagaagactgatgctgagccccgaggtggtgcaggccctgctggtggaggagctgctgagcaccgtgaacagcagcgccgccgtgccctacagagccgagtacgaggtggaccccgagggcctggtgatcctggaggccagcgtgaaggacatcgccgccctgaacagcaccctgggctgctacagatacagctacgtgggccagggccaggtgctgagactgaagggccccgaccacctggccagcagctgcctgtggcacctgcagggccccaaggacctgatgctgaagctgagactggagtggaccctggccgagtgcagagacagactggccatgtacgacgtggccggccccctggagaagagactgatcaccagcgtgtacggctgcagcagacaggagcccgtggtggaggtgctggccagcggcgccatcatggccgtggtgtggaagaagggcctgcacagctactacgaccccttcgtgctgagcgtgcagcccgtggtgttccaggcctgcgaggtgaacctgaccctggacaacagactggacagccagggcgtgctgagcaccccctacttccccagctactacagcccccagacccactgcagctggcacctgaccgtgcccagcctggactacggcctggccctgtggttcgacgcctacgccctgagaagacagaagtacgacctgccctgcacccagggccagtggaccatccagaacagaagactgtgcggcctgagaatcctgcagccctacgccgagagaatccccgtggtggccaccgccggcatcaccatcaacttcaccagccagatcagcctgaccggccccggcgtgagagtgcactacggcctgtacaaccagagcgacccctgccccggcgagttcctgtgcagcgtgaacggcctgtgcgtgcccgcctgcgacggcgtgaaggactgccccaacggcctggacgagagaaactgcgtgtgcagagccaccttccagtgcaaggaggacagcacctgcatcagcctgcccaaggtgtgcgacggccagcccgactgcctgaacggcagcgacgaggagcagtgccaggagggcgtgccctgcggcaccttcaccttccagtgcgaggacagaagctgcgtgaagaagcccaacccccagtgcgacggcagacccgactgcagagacggcagcgacgaggagcactgcgactgcggcctgcagggccccagcagcagaatcgtgggcggcgccgtgagcagcgagggcgagtggccctggcaggccagcctgcaggtgagaggcagacacatctgcggcggcgccctgatcgccgacagatgggtgatcaccgccgcccactgcttccaggaggacagcatggccagcaccgtgctgtggaccgtgttcctgggcaaggtgtggcagaacagcagatggcccggcgaggtgagcttcaaggtgagcagactgctgctgcacccctaccacgaggaggacagccacgactacgacgtggccctgctgcagctggaccaccccgtggtgagaagcgccgccgtgagacccgtgtgcctgcccgccagaagccacttcttcgagcccggcctgcactgctggatcaccggctggggcgccctgagagagggcgccctgagagccgacgccgtggccctgttctacggctggagaaaccagggcagcgagacctgctgctgccccatcagcaacgccctgcagaaggtggacgtgcagctgatcccccaggacctgtgcagcgaggtgtacagataccaggtgacccccagaatgctgtgcgccggctacagaaagggcaagaaggacgcctgccagggcgacagcggcggccccctggtgtgcaaggccctgagcggcagatggttcctggccggcctggtgagctggggcctgggctgcggcagacccaactacttcggcgtgtacaccagaatcaccggcgtgatcagctggatccagcaggtggtgacctag

SEQ ID NO: 103187 - DNA, 2409 bp, Artificial Sequence
  Description of Artificial Sequence: Synthetic coding sequence
atgcccgtggccgaggccccccaggtggccggcggccagggcgacggcggcgacggcgaggaggccgagcccgagggcatgttcaaggcctgcgaggacagcaagagaaaggccagaggctacctgagactggtgcccctgttcgtgctgctggccctgctggtgctggccagcgccggcgtgctgctgtggtacttcctgggctacaaggccgaggtgatggtgagccaggtgtacagcggcagcctgagagtgctgaacagacacttcagccaggacctgaccagaagagagagcagcgccttcagaagcgagaccgccaaggcccagaagatgctgaaggagctgatcaccagcaccagactgggcacctactacaacagcagcagcgtgtacagcttcggcgagggccccctgacctgcttcttctggttcatcctgcagatccccgagcacagaagactgatgctgagccccgaggtggtgcaggccctgctggtggaggagctgctgagcaccgtgaacagcagcgccgccgtgccctacagagccgagtacgaggtggaccccgagggcctggtgatcctggaggccagcgtgaaggacatcgccgccctgaacagcaccctgggctgctacagatacagctacgtgggccagggccaggtgctgagactgaagggccccgaccacctggccagcagctgcctgtggcacctgcagggccccaaggacctgatgctgaagctgagactggagtggaccctggccgagtgcagagacagactggccatgtacgacgtggccggccccctggagaagagactgatcaccagcgtgtacggctgcagcagacaggagcccgtggtggaggtgctggccagcggcgccatcatggccgtggtgtggaagaagggcctgcacagctactacgaccccttcgtgctgagcgtgcagcccgtggtgttccaggcctgcgaggtgaacctgaccctggacaacagactggacagccagggcgtgctgagcaccccctacttccccagctactacagcccccagacccactgcagctggcacctgaccgtgcccagcctggactacggcctggccctgtggttcgacgcctacgccctgagaagacagaagtacgacctgccctgcacccagggccagtggaccatccagaacagaagactgtgcggcctgagaatcctgcagccctacgccgagagaatccccgtggtggccaccgccggcatcaccatcaacttcaccagccagatcagcctgaccggccccggcgtgagagtgcactacggcctgtacaaccagagcgacccctgccccggcgagttcctgtgcagcgtgaacggcctgtgcgtgcccgcctgcgacggcgtgaaggactgccccaacggcctggacgagagaaactgcgtgtgcagagccaccttccagtgcaaggaggacagcacctgcatcagcctgcccaaggtgtgcgacggccagcccgactgcctgaacggcagcgacgaggagcagtgccaggagggcgtgccctgcggcaccttcaccttccagtgcgaggacagaagctgcgtgaagaagcccaacccccagtgcgacggcagacccgactgcagagacggcagcgacgaggagcactgcgactgcggcctgcagggccccagcagcagaatcgtgggcggcgccgtgagcagcgagggcgagtggccctggcaggccagcctgcaggtgagaggcagacacatctgcggcggcgccctgatcgccgacagatgggtgatcaccgccgcccactgcttccaggaggacagcatggccagcaccgtgctgtggaccgtgttcctgggcaaggtgtggcagaacagcagatggcccggcgaggtgagcttcaaggtgagcagactgctgctgcacccctaccacgaggaggacagccacgactacgacgtggccctgctgcagctggaccaccccgtggtgagaagcgccgccgtgagacccgtgtgcctgcccgccagaagccacttcttcgagcccggcctgcactgctggatcaccggctggggcgccctgagagagggcggccccatcagcaacgccctgcagaaggtggacgtgcagctgatcccccaggacctgtgcagcgaggtgtacagataccaggtgacccccagaatgctgtgcgccggctacagaaagggcaagaaggacgcctgccagggcgacagcggcggccccctggtgtgcaaggccctgagcggcagatggttcctggccggcctggtgagctggggcctgggctgcggcagacccaactacttcggcgtgtacaccagaatcaccggcgtgatcagctggatccagcaggtggtgacctag

SEQ ID NO: 103188 - DNA, 2475 bp, Artificial Sequence; identical to SEQ ID NO: 103186
  Description of Artificial Sequence: Synthetic coding sequence

SEQ ID NO: 103189 - DNA, 426 bp, Artificial Sequence
  Description of Artificial Sequence: Synthetic coding sequence
atgcccgtggccgaggccccccaggtggccggcggccagggcgacggcggcgacggcgaggaggccgagcccgagggcatgttcaaggcctgcgaggacagcaagagaaaggccagaggctacctgagactggtgcccctgttcgtgctgctggccctgctggtgctggccagcgccggcgtgctgctgtggtacttcctgggctacaaggccgaggtgatggtgagccaggtgtacagcggcagcctgagagtgctgaacagacacttcagccaggacctgaccagaagagagagcagcgccttcagaagcgagaccgccaaggcccagaagatgctgaaggagctgatcaccagcaccagactgggcacctactacaacagcagcagcgtgtacagcttcggcgagggccccctgacctgctag

SEQ ID NO: 103190 - DNA, 1386 bp, Artificial Sequence
  Description of Artificial Sequence: Synthetic coding sequence
atgctgctgctgttccacagcaagagaatgcccgtggccgaggccccccaggtggccggcggccagggcgacggcggcgacggcgaggaggccgagcccgagggcatgttcaaggcctgcgaggacagcaagagaaaggccagaggctacctgagactggtgcccctgttcgtgctgctggccctgctggtgctggccagcgccggcgtgctgctgtggtacttcctgggctacaaggccgaggtgatggtgagccaggtgtacagcggcagcctgagagtgctgaacagacacttcagccaggacctgaccagaagagagagcagcgccttcagaagcgagaccgccaaggcccagaagatgctgaaggagctgatcaccagcaccagactgggcacctactacaacagcagcagcgtgtacagcttcggcgagggccccctgacctgcttcttctggttcatcctgcagatccccgagcacagaagactgatgctgagccccgaggtggtgcaggccctgctggtggaggagctgctgagcaccgtgaacagcagcgccgccgtgccctacagagccgagtacgaggtggaccccgagggcctggtgatcctggaggccagcgtgaaggacatcgccgccctgaacagcaccctgggctgctacagatacagctacgtgggccagggccaggtgctgagactgaagggccccgaccacctggccagcagctgcctgtggcacctgcagggccccaaggacctgatgctgaagctgagactggagtggaccctggccgagtgcagagacagactggccatgtacgacgtggccggccccctggagaagagactgatcaccagcgtgtacggctgcagcagacaggagcccgtggtggaggtgctggccagcggcgccatcatggccgtggtgtggaagaagggcctgcacagctactacgaccccttcgtgctgagcgtgcagcccgtggtgttccaggcctgcgaggtgaacctgaccctggacaacagactggacagccagggcgtgctgagcaccccctacttccccagctactacagcccccagacccactgcagctggcacctgaccgtgcccagcctggactacggcctggccctgtggttcgacgcctacgccctgagaagacagaagtacgacctgccctgcacccagggccagtggaccatccagaacagaagataccacttcctgagcagcctgtggctgcccttcctgccccccccccccagcctgcccagcagcatcgtgacccccagcctggaggcccaggtgcccaacctgagaggcgccgccagaggcgccagcagaggctggggctggtgccaggcctgctgcccctag

SEQ ID NO: 103191 - DNA, 1527 bp, Artificial Sequence
  Description of Artificial Sequence: Synthetic coding sequence
atggccagcgccgtgtggggcagcgccccctggtggggcccccccccccccgcccccgccagacccctgaccgacatcgacttctgcagcggcgcccagctgcaggagctgacccagctgatccaggagctgggcgtgcaggagagctggagcgacggccccaagcccggcgccgacctgctgagagccaaggacttcgtgttcagcctgctgggcctggtgcacagaagagaccccagattccccccccaggccgagctgctgctgctgagaggcggcatcagagagggcagcctggacctgggccacgcccccctgggcccctacgccagaggcccccactacgacgccggcttcaccctgctggtgcccatgttcagcctggacggcaccgagctgcagctggacctggagagctgctacgcccaggtgtgcctgcccgagatggtgtgcggcacccccatcagagagatgtggcaggactgcctgggcccccccgtgcccggcgccagagacagcatccacagaaccgagagcgaggagagcagcaaggactggcagagcagcgtggaccagccccacagctacgtgaccgagcacgaggcccccgtgagcctggagaagagccccagcgacgtgagcgccagcgagagcccccagcacgacgtggtggacctgggcagcaccgcccccctgaagaccatgagcagcgacgtgaccaaggccgccgtggagagccccgtgcccaagcccagcgaggccagagaggcctggcccaccctgtgcagcgcccaggtggccgcctggttcttcgccaccctggccgccgtggccgagagcctgatccccgtgcccggcgcccccagactggtgcacgccgccagacacgccggcttcaccaccgtgctgctggccacccccgagccccccagaagactgctgctgttcgacctgatccccgtggtgagcgtggccggctggcccgagggcgccagaagccacagctgggccggccccctggccagcgagagcgccagcttctacctggtgcccggcggcggcaccgagagaccctgcgccagcgcctggcagctgtgcttcgccagacaggagctggccctgaaggccagaatccccgcccccctgctgcaggcccacgccgccgcccaggccctgctgagacccctggtggccggcaccagagccgccgccccctacctgctgagaaccctgctgtactgggcctgcgagagactgcccgccctgtacctggccagacccgagaacgccggcgcctgctgcctgggcctgctggacgagctgggcagagtgctggaggccggcaccctgccccactacttcctgaacggcagacagctgagaaccggcgacgacagcgccgccctgctgggcgagctggccagactgagaggcgaccccgccagagccctgagagccgccgtggaggaggccaaggtggccagaaagggcggcggcctggccggcgtgggcggcggcgcccactag

SEQ ID NO: 103192 - DNA, 1527 bp, Artificial Sequence; identical to SEQ ID NO: 103191
  Description of Artificial Sequence: Synthetic coding sequence

SEQ ID NO: 103193 - DNA, 825 bp, Artificial Sequence
  Description of Artificial Sequence: Synthetic coding sequence
atgggcaagagcctgagccacctgcccctgcacagcagcaaggaggacgcctacgacggcgtgaccagcgagaacatgagaaacggcctggtgaacagcgaggtgcacaacgaggacggcagaaacggcgacgtgagccagttcccctacgtggagttcaccggcagagacagcgtgacctgccccacctgccagggcaccggcagaatccccagaggccaggagaaccagctggtggccctgatcccctacagcgaccagagactgagacccagaagaaccaagctgtacgtgatggccagcgtgttcgtgtgcctgctgctgagcggcctggccgtgttcttcctgttccccagaagcatcgacgtgaagtacatcggcgtgaagagcgcctacgtgagctacgacgtgcagaagagaaccatctacctgaacatcaccaacaccctgaacatcaccaacaacaactactacagcgtggaggtggagaacatcaccgcccaggtgcagttcagcaagaccgtgatcggcaaggccagactgaacaacatcaccatcatcggccccctggacatgaagcagatcgactacaccgtgcccaccgtgatcgccgaggagatgagctacatgtacgacttctgcaccctgatcagcatcaaggtgcacaacatcgtgctgatgatgcaggtgaccgtgaccaccacctacttcggccacagcgagcagatcagccaggagagataccagtacgtggactgcggcagaaacaccacctaccagctgggccagagcgagtacctgaacgtgctgcagccccagcagtag

SEQ ID NO: 103194 - DNA, 825 bp, Artificial Sequence; identical to SEQ ID NO: 103193
  Description of Artificial Sequence: Synthetic coding sequence

SEQ ID NO: 103195 - DNA, 78 bp, Artificial Sequence
  Description of Artificial Sequence: Synthetic coding sequence
atgggcaagagcctgagccacctgcccctgcacagcagcaaggaggacgcctacgacggcgtgaccagcgagaactag

SEQ ID NO: 103196 - DNA, 333 bp, Artificial Sequence
  Description of Artificial Sequence: Synthetic coding sequence
atgggcaagagcctgagccacctgcccctgcacagcagcaaggaggacgcctacgacggcgtgaccagcgagaacatgagaaacggcctggtgaacagcgaggtgcacaacgaggacggcagaaacggcgacgtgagccagttcccctacgtggagttcaccggcagagacagcgtgacctgccccacctgccagggcaccggcagaatccccagaggccaggagaaccagctggtggccctgatcccctacagcgaccagagactgagacccagaagaaccaagctgtacgtgatggccagcgtgttcgtgtgcctgctgctgagcggctag

SEQ ID NO: 103197 - DNA, 369 bp, Artificial Sequence
  Description of Artificial Sequence: Synthetic coding sequence
atgcacggcaccttcgtgatcctgctgcccctgagcctgatcctgatggtgttcggcggcatgaccggcttcctgagcttcctgctgcaggcctacctgctgctgctgctgaccggcatcctgttcctgttcggcgccatggtgaccctggccggcatcagcgtgtacatcgcctacagcgccgccgccttcagagaggccctgtgcctgctggaggagaaggccctgctggaccaggtggacatcagcttcggctggagcctggccctgggctggatcagcttcatcgccgagctgctgaccggcgccgccttcctggccgccgccagagagctgagcctgagaagaagacaggaccaggccatctag

SEQ ID NO: 103198 - DNA, 570 bp, Artificial Sequence
  Description of Artificial Sequence: Synthetic coding sequence
atgggcctgggcgccagaggcgcctgggccgccctgctgctgggcaccctgcaggtgctggccctgctgggcgccgcccacgagagcgccgccatggccgagaccctgcagcacgtgcccagcgaccacaccaacgagaccagcaacagcaccgtgaagccccccaccagcgtggccagcgacagcagcaacaccaccgtgaccaccatgaagcccaccgccgccagcaacaccaccacccccggcatggtgagcaccaacatgaccagcaccaccctgaagagcacccccaagaccaccagcgtgagccagaacaccagccagatcagcaccagcaccatgaccgtgacccacaacagcagcgtgaccagcgccgccagcagcgtgaccatcaccaccaccatgcacagcgaggccaagaagggcagcaagttcgacaccggcagcttcgtgggcggcatcgtgctgaccctgggcgtgctgagcatcctgtacatcggctgcaagatgtactacagcagaagaggcatcagatacagaaccatcgacgagcacgacgccatcatctag

SEQ ID NO: 103199 - DNA, 627 bp, Artificial Sequence
  Description of Artificial Sequence: Synthetic coding sequence
atgggcctgggcgccagaggcgcctgggccgccctgctgctgggcaccctgcaggtgctggccctgctgggcgccgcccacgagagcgccgccatggccgccagcgccaacatcgagaacagcggcctgccccacaacagcagcgccaacagcaccgagaccctgcagcacgtgcccagcgaccacaccaacgagaccagcaacagcaccgtgaagccccccaccagcgtggccagcgacagcagcaacaccaccgtgaccaccatgaagcccaccgccgccagcaacaccaccacccccggcatggtgagcaccaacatgaccagcaccaccctgaagagcacccccaagaccaccagcgtgagccagaacaccagccagatcagcaccagcaccatgaccgtgacccacaacagcagcgtgaccagcgccgccagcagcgtgaccatcaccaccaccatgcacagcgaggccaagaagggcagcaagttcgacaccggcagcttcgtgggcggcatcgtgctgaccctgggcgtgctgagcatcctgtacatcggctgcaagatgtactacagcagaagaggcatcagatacagaaccatcgacgagcacgacgccatcatctag

SEQ ID NO: 103200 - DNA, 588 bp, Artificial Sequence
  Description of Artificial Sequence: Synthetic coding sequence
atggagaaccacaagagcaacaacaaggagaacatcaccatcgtggacatcagcagaaagatcaaccagctgcccgaggccgagagaaacctgctggagaacggcagcgtgtacgtgggcctgaacgccgccctgtgcggcctgatcgccaacagcctgttcagaagaatcctgaacgtgaccaaggccagaatcgccgccggcctgcccatggccggcatccccttcctgaccaccgacctgacctacagatgcttcgtgagcttccccctgaacaccggcgacctggactgcgagacctgcaccatcaccagaagcggcctgaccggcctggtgatcggcggcctgtaccccgtgttcctggccatccccgtgaacggcggcctggccgccagataccagagcgccctgctgccccacaagggcaacatcctgagctactggatcagaaccagcaagcccgtgttcagaaagatgctgttccccatcctgctgcagaccatgttcagcgcctacctgggcagcgagcagtacaagctgctgatcaaggccctgcagctgagcgagcccggcaaggagatccactag

SEQ ID NO: 103201 - DNA, 378 bp, Artificial Sequence
  Description of Artificial Sequence: Synthetic coding sequence
atggccggcatccccttcctgaccaccgacctgacctacagatgcttcgtgagcttccccctgaacaccggcgacctggactgcgagacctgcaccatcaccagaagcggcctgaccggcctggtgatcggcggcctgtaccccgtgttcctggccatccccgtgaacggcggcctggccgccagataccagagcgccctgctgccccacaagggcaacatcctgagctactggatcagaaccagcaagcccgtgttcagaaagatgctgttccccatcctgctgcagaccatgttcagcgcctacctgggcagcgagcagtacaagctgctgatcaaggccctgcagctgagcgagcccggcaaggagatccactag

SEQ ID NO: 103202 - DNA, 489 bp, Artificial Sequence
  Description of Artificial Sequence: Synthetic coding sequence
atgctgcagaccagcaactacagcctggtgctgagcctgcagttcctgctgctgagctacgacctgttcgtgaacagcttcagcgagctgctgcagaagacccccgtgatccagctggtgctgttcatcatccaggacatcgccgtgctgttcaacatcatcatcatcttcctgatgttcttcaacaccttcgtgttccaggccggcctggtgaacctgctgttccacaagttcaagggcaccatcatcctgaccgccgtgtacttcgccctgagcatcagcctgcacgtgtgggtgatgaacctgagatggaagaacagcaacagcttcatctggaccgacggcctgcagatgctgttcgtgttccagagactggccgccgtgctgtactgctacttctacaagagaaccgccgtgagactgggcgacccccacttctaccaggacagcctgtggctgagaaaggagttcatgcaggtgagaagatag

SEQ ID NO: 103203 - DNA, 318 bp, Artificial Sequence
  Description of Artificial Sequence: Synthetic coding sequence
atgctgcagaccagcaactacagcctggtgctgagcctgcagttcctgctgctgagctacgacctgttcgtgaacagcttcagcgagctgctgcagaagacccccgtgatccagctggtgctgttcatcatccaggacatcgccgtgctgttcaacatcatcatcatcttcctgatgttcttcaacaccttcgtgttccaggccggcctggtgaacctgctgttccacaagttcaagggcaccatcatcctgaccgccgtgtacttcgccctgagcatcagcctgcacgtgtgggtgatggtgagagtggccgtgtag

SEQ ID NO: 103204 - DNA, 1140 bp, Artificial Sequence
  Description of Artificial Sequence: Synthetic coding sequence
atgccccacagcagcctgcaccccagcatcccctgccccagaggccacggcgcccagaaggccgccctggtgctgctgagcgcctgcctggtgaccctgtggggcctgggcgagccccccgagcacaccctgagatacctggtgctgcacctggccagcctgcagctgggcctgctgctgaacggcgtgtgcagcctggccgaggagctgagacacatccacagcagatacagaggcagctactggagaaccgtgagagcctgcctgggctgccccctgagaagaggcgccctgctgctgctgagcatctacttctactacagcctgcccaacgccgtgggcccccccttcacctggatgctggccctgctgggcctgagccaggccctgaacatcctgctgggcctgaagggcctggcccccgccgagatcagcgccgtgtgcgagaagggcaacttcaacgtggcccacggcctggcctggagctactacatcggctacctgagactgatcctgcccgagctgcaggccagaatcagaacctacaaccagcactacaacaacctgctgagaggcgccgtgagccagagactgtacatcctgctgcccctggactgcggcgtgcccgacaacctgagcatggccgaccccaacatcagattcctggacaagctgccccagcagaccggcgaccacgccggcatcaaggacagagtgtacagcaacagcatctacgagctgctggagaacggccagagagccggcacctgcgtgctggagtacgccacccccctgcagaccctgttcgccatgagccagtacagccaggccggcttcagcagagaggacagactggagcaggccaagctgttctgcagaaccctggaggacatcctggccgacgcccccgagagccagaacaactgcagactgatcgcctaccaggagcccgccgacgacagcagcttcagcctgagccaggaggtgctgagacacctgagacaggaggagaaggaggaggtgaccgtgggcagcctgaagaccagcgccgtgcccagcaccagcaccatgagccaggagcccgagctgctgatcagcggcatggagaagcccctgcccctgagaaccgacttcagctag

SEQ ID NO: 103205 - DNA, 762 bp, Artificial Sequence
  Description of Artificial Sequence: Synthetic coding sequence
atgccccacagcagcctgcaccccagcatcccctgccccagaggccacggcgcccagaaggccgccctggtgctgctgagcgcctgcctggtgaccctgtggggcctgggcgagccccccgagcacaccctgagatacctggtgctgcacctggccagcctgcagctgggcctgctgctgaacggcgtgtgcagcctggccgaggagctgagacacatccacagcagatacagaggcagctactggagaaccgtgagagcctgcctgggctgccccctgagaagaggcgccctgctgctgctgagcatctacttctactacagcctgcccaacgccgtgggcccccccttcacctggatgctggccctgctgggcctgagccaggccctgaacatcctgctgggcctgaagggcctggcccccgccgagatcagcgccgtgtgcgagaagggcaacttcaacgtggcccacggcctggcctggagctactacatcggctacctgagactgatcctgcccgagctgcaggccagaatcagaacctacaaccagcactacaacaacctgctgagaggcgccgtgagccagagactgtacatcctgctgcccctggactgcggcgtgcccgacaacctgagcatggccgaccccaacatcagattcctggacaagctgccccagcagaccggcgaccacgccggcatcaaggacagagtgtacagcaacagcatctacgagctgctggagaacggccagagatag

SEQ ID NO: 103206 - DNA, 423 bp, Artificial Sequence
  Description of Artificial Sequence: Synthetic coding sequence
atgcccagcgccttcagcgtgagcagcttccccgtgagcatccccgccgtgctgacccagaccgactggaccgagccctggctgatgggcctggccaccttccacgccctgtgcgtgctgctgacctgcctgagcagcagaagctacagactgcagatcggccacttcctgtgcctggtgatcctggtgtactgcgccgagtacatcaacgaggccgccgccatgaactggagactgttcagcaagtaccagtacttcgacagcagaggcatgttcatcagcatcgtgttcagcgcccccctgctggtgaacgccatgatcatcgtggtgatgtgggtgtggaagaccctgaacgtgatgaccgacctgaagaacgcccaggagagaagaaaggagaagaagagaagaagaaaggaggactag

SEQ ID NO: 103207 - DNA, 384 bp, Artificial Sequence
  Description of Artificial Sequence: Synthetic coding sequence
atgctgagcggctacctgcagaccgactggaccgagccctggctgatgggcctggccaccttccacgccctgtgcgtgctgctgacctgcctgagcagcagaagctacagactgcagatcggccacttcctgtgcctggtgatcctggtgtactgcgccgagtacatcaacgaggccgccgccatgaactggagactgttcagcaagtaccagtacttcgacagcagaggcatgttcatcagcatcgtgttcagcgcccccctgctggtgaacgccatgatcatcgtggtgatgtgggtgtggaagaccctgaacgtgatgaccgacctgaagaacgcccaggagagaagaaaggagaagaagagaagaagaaaggaggactag

SEQ ID NO: 103208 - DNA, 1560 bp, Artificial Sequence
  Description of Artificial Sequence: Synthetic coding sequence
ggccccgcccagagagccagcagccccatccccagcgccggcagaagagagggcgcccaggccgccacccagagagtggagagaagagacagagaccccggcggctgcgccgcctggacccccagcaccctgcccctgagccccagaagcgccgccagcagcagcacctgcgccggcggctgcggcaagagaaccgccagcagcagaagaaccagcagacccagcagaatgaccgccaccaccggccccaaggtgatccagaccagcgccgccaacttcagcctgaacaacagcaagaagctgaagcccatccagatcctgagcaaccccctgagcacctacaaccagcagctgtggctgacctgcgtggtggagctggaccagagcaaggagaccagcatcaagaccagcttccccatgaccgtgaaggtggacggcgtggcccaggacggcaccaccatgtacatccacaacaaggtgcacaacagaaccagaaccctgacctgcgccggcaagtgcgccgagatcatcgtggcccacctgggctacctgaactacacccagtacaccgtgatcgtgggcttcgagcacctgaagctgcccatcaagggcatgaacttcacctggaagacctacaaccccgccttcagcagactggagatctggttcagattcttcttcgtggtgctgaccttcatcgtgacctgcctgttcgcccacagcctgagaaagttcagcatgagagactggggcatcgagcagaagtggatgagcgtgctgctgcccctgctgctgctgtacaacgaccccttcttccccctgagcttcctggtgaacagctggctgcccggcatgctggacgacctgttccagagcatgttcctgtgcgccctgctgctgttctggctgtgcgtgtaccacggcatcagagtgcagggcgagagaaagtgcctgaccttctacctgcccaagttcttcatcgtgggcctgctgtggctggccagcgtgaccctgggcatctggcagaccgtgaacgagctgcacgaccccatgtaccagtacagagtggacaccggcaacttccagggcatgaaggtgttcttcatggtggtggccgccgtgtacatcctgtacctgctgttcctgatcgtgagagcctgcagcgagctgagacacatgccctacgtggacctgagactgaagttcctgaccgccctgaccttcgtggtgctggtgatcagcatcgccatcctgtacctgagattcggcgcccaggtgctgcaggacaacttcgtggccgagctgagcacccactaccagaagcccgccgagttcctgagcttctacggcctgctgaacttctacctgtacaccctggccttcgtgtacagccccagcaagaacgccctgtacgagagccagctgaaggacaaccccgccttcagcatgctgaacgacagcgacgacgacgtgatctacggcagcgactacgaggagatgcccctgcagaacggccaggccatcagagccaagtacaaggaggagagcgacagcgactag

SEQ ID NO: 103209 - DNA, 1839 bp, Artificial Sequence
  Description of Artificial Sequence: Synthetic coding sequence
atgggcgccgcccccagccccacccaggccagcagcagaggcggcggccccggcccccccgcccccaccagagccgtgagcagcagcagcagagccagaggcggcgccctgagcgccctgggccccagccccgccagacccctgaccaccagccccgcccccgcccccccccccagaagcagacccgccagacagcagcccgacccccagtgctgggagaagagaggcggcgccggcggcgacaccaagggcggcgccgccggccccggccccggcagactgagaggcatggacgccgagtaccccgccttcgagccccccctgtgcagcgagctgaagcacctgtgcagaagactgagagaggcctacagagagctgaaggaggacctgacccccttcaaggacgacagatactacagactggcccccatgagactgtacaccctgagcaagagacacttcgtgctggtgttcgtggtgttcttcatctgcttcggcctgaccatcttcgtgggcatcagaggccccaaggtgatccagaccagcgccgccaacttcagcctgaacaacagcaagaagctgaagcccatccagatcctgagcaaccccctgagcacctacaaccagcagctgtggctgacctgcgtggtggagctggaccagagcaaggagaccagcatcaagaccagcttccccatgaccgtgaaggtggacggcgtggcccaggacggcaccaccatgtacatccacaacaaggtgcacaacagaaccagaaccctgacctgcgccggcaagtgcgccgagatcatcgtggcccacctgggctacctgaactacacccagtacaccgtgatcgtgggcttcgagcacctgaagctgcccatcaagggcatgaacttcacctggaagacctacaaccccgccttcagcagactggagatctggttcagattcttcttcgtggtgctgaccttcatcgtgacctgcctgttcgcccacagcctgagaaagttcagcatgagagactggggcatcgagcagaagtggatgagcgtgctgctgcccctgctgctgctgtacaacgaccccttcttccccctgagcttcctggtgaacagctggctgcccggcatgctggacgacctgttccagagcatgttcctgtgcgccctgctgctgttctggctgtgcgtgtaccacggcatcagagtgcagggcgagagaaagtgcctgaccttctacctgcccaagttcttcatcgtgggcctgctgtggctggccagcgtgaccctgggcatctggcagaccgtgaacgagctgcacgaccccatgtaccagtacagagtggacaccggcaacttccagggcatgaaggtgttcttcatggtggtggccgccgtgtacatcctgtacctgctgttcctgatcgtgagagcctgcagcgagctgagacacatgccctacgtggacctgagactgaagttcctgaccgccctgaccttcgtggtgctggtgatcagcatcgccatcctgtacctgagattcggcgcccaggtgctgcaggacaacttcgtggccgagctgagcacccactaccagaacagcgccgagttcctgagcttctacggcctgctgaacttctacctgtacaccctggccttcgtgtacagccccagcaagaacgccctgtacgagagccagctgaaggacaaccccgccttcagcatgctgaacgacagcgacgacgacgtgatctacggcagcgactacgaggagatgcccctgcagaacggccaggccatcagagccaagtacaaggaggagagcgacagcgactag

SEQ ID NO: 103210 - DNA, 1317 bp, Artificial Sequence
  Description of Artificial Sequence: Synthetic coding sequence
atgccctgcacctgcacctggagaaactggagacagtggatcagacccctggtggccgtgatctacctggtgagcatcgtggtggccgtgcccctgtgcgtgtgggagctgcagaagctggaggtgggcatccacaccaaggcctggttcatcgccggcatcttcctgctgctgaccatccccatcagcctgtgggtgatcctgcagcacctggtgcactacacccagcccgagctgcagaagcccatcatcagaatcctgtggatggtgcccatctacagcctggacagctggatcgccctgaagtaccccggcatcgccatctacgtggacacctgcagagagtgctacgaggcctacgtgatctacaacttcatgggcttcctgaccaactacctgaccaacagataccccaacctggtgctgatcctggaggccaaggaccagcagaagcacttcccccccctgtgctgctgccccccctgggccatgggcgaggtgctgctgttcagatgcaagctgggcgtgctgcagtacaccgtggtgagacccttcaccaccatcgtggccctgatctgcgagctgctgggcatctacgacgagggcaacttcagcttcagcaacgcctggacctacctggtgatcatcaacaacatgagccagctgttcgccatgtactgcctgctgctgttctacaaggtgctgaaggaggagctgagccccatccagcccgtgggcaagttcctgtgcgtgaagctggtggtgttcgtgagcttctggcaggccgtggtgatcgccctgctggtgaaggtgggcgtgatcagcgagaagcacacctgggagtggcagaccgtggaggccgtggccaccggcctgcaggacttcatcatctgcatcgagatgttcctggccgccatcgcccaccactacaccttcagctacaagccctacgtgcaggaggccgaggagggcagctgcttcgacagcttcctggccatgtgggacgtgagcgacatcagagacgacatcagcgagcaggtgagacacgtgggcagaaccgtgagaggccaccccagaaagaagctgttccccgaggaccaggaccagaacgagcacaccagcctgctgagcagcagcagccaggacgccatcagcatcgccagcagcatgccccccagccccatgggccactaccagggcttcggccacaccgtgaccccccagaccacccccaccaccgccaagatcagcgacgagatcctgagcgacaccatcggcgagaagaaggagcccagcgacaagagcgtggacagctag

SEQ ID NO: 103211 - DNA, 4152 bp, Artificial Sequence
  Description of Artificial Sequence: Synthetic coding sequence
atgtacgccaccgacagcagaggccacagccccgccttcctgcagccccagaacggcaacagcagacaccccagcggctacgtgcccggcaaggtggtgcccctgagacccccccccccccccaagagccaggccagcgccaagttcaccagcatcagaagagaggacagagccaccttcgccttcagccccgaggagcagcaggcccagagagagagccagaagcagaagagacacaagaacaccttcatctgcttcgccatcaccagcttcagcttcttcatcgccctggccatcatcctgggcatcagcagcaagtacgcccccgacgagaactgccccgaccagaaccccagactgagaaactgggaccccggccaggacagcgccaagcaggtggtgatcaaggagggcgacatgctgagactgaccagcgacgccaccgtgcacagcatcgtgatccaggacggcggcctgctggtgttcggcgacaacaaggacggcagcagaaacatcaccctgagaacccactacatcctgatccaggacggcggcgccctgcacatcggcgccgagaagtgcagatacaagagcaaggccaccatcaccctgtacggcaagagcgacgagggcgagagcatgcccaccttcggcaagaagttcatcggcgtggaggccggcggcaccctggagctgcacggcgccagaaaggccagctggaccctgctggccagaaccctgaacagcagcggcctgcccttcggcagctacaccttcgagaaggacttcagcagaggcctgaacgtgagagtgatcgaccaggacaccgccaagatcctggagagcgagagattcgacacccacgagtacagaaacgagagcagaagactgcaggagttcctgagattccaggaccccggcagaatcgtggccatcgccgtgggcgacagcgccgccaagagcctgctgcagggcaccatccagatgatccaggagagactgggcagcgagctgatccagggcctgggctacagacaggcctgggccctggtgggcgtgatcgacggcggcagcaccagctgcaacgagagcgtgagaaactacgagaaccacagcagcggcggcaaggccctggcccagagagagttctacaccgtggacggccagaagttcagcgtgaccgcctacagcgagtggatcgagggcgtgagcctgagcggcttcagagtggaggtggtggacggcgtgaagctgaacctgctggacgacgtgagcagctggaagcccggcgaccagatcgtggtggccagcaccgactacagcatgtaccaggccgaggagttcaccctgctgccctgcagcgagtgcagccacttccaggtgaaggtgaaggagaccccccagttcctgcacatgggcgagatcatcgacggcgtggacatgagagccgaggtgggcatcctgaccagaaacatcgtgatccagggcgaggtggaggacagctgctacgccgagaaccagtgccagttcttcgactacgacaccttcggcggccacatcatgatcatgaagaacttcaccagcgtgcacctgagctacgtggagctgaagcacatgggccagcagcagatgggcagataccccgtgcacttccacctgtgcggcgacgtggactacaagggcggctacagacacgccaccttcgtggacggcctgagcatccaccacagcttcagcagatgcatcaccgtgcacggcaccaacggcctgctgatcaaggacaccatcggcttcgacaccctgggccactgcttcttcctggaggacggcatcgagcagagaaacaccctgttccacaacctgggcctgctgaccaagcccggcaccctgctgcccaccgacagaaacaacagcatgtgcaccaccatgagagacaaggtgttcggcaactacatccccgtgcccgccaccgactgcatggccgtgagcaccttctggatcgcccaccccaacaacaacctgatcaacaacgccgccgccggcagccaggacgccggcatctggtacctgttccacaaggagcccaccggcgagagcagcggcctgcagctgctggccaagcccgagctgacccccctgggcatcttctacaacaacagagtgcacagcaacttcaaggccggcctgttcatcgacaagggcgtgaagaccaccaacagcagcgccgccgaccccagagagtacctgtgcctggacaacagcgccagattcagaccccaccaggacgccaaccccgagaagcccagagtggccgccctgatcgacagactgatcgccttcaagaacaacgacaacggcgcctgggtgagaggcggcgacatcatcgtgcagaacagcgccttcgccgacaacggcatcggcctgaccttcgccagcgacggcagcttccccagcgacgagggcagcagccaggaggtgagcgagagcctgttcgtgggcgagagcagaaactacggcttccagggcggccagaacaagtacgtgggcaccggcggcatcgaccagaagcccagaaccctgcccagaaacagaaccttccccatcagaggcttccagatctacgacggccccatccacctgaccagaagcaccttcaagaagtacgtgcccacccccgacagatacagcagcgccatcggcttcctgatgaagaacagctggcagatcacccccagaaacaacatcagcctggtgaagttcggcccccacgtgagcctgaacgtgttcttcggcaagcccggcccctggttcgaggactgcgagatggacggcgacaagaacagcatcttccacgacatcgacggcagcgtgaccggctacaaggacgcctacgtgggcagaatggacaactacctgatcagacaccccagctgcgtgaacgtgagcaagtggaacgccgtgatctgcagcggcacctacgcccaggtgtacgtgcagacctggagcacccagaacctgagcatgaccatcaccagagacgagtaccccagcaaccccatggtgctgagaggcatcaaccagaaggccgccttcccccagtaccagcccgtggtgatgctggagaagggctacaccatccactggaacggccccgcccccagaaccaccttcctgtacctggtgaacttcaacaagaacgactggatcagagtgggcctgtgctaccccagcaacaccagcttccaggtgaccttcggctacctgcagagacagaacggcagcctgagcaagatcgaggagtacgagcccgtgcacagcctggaggagctgcagagaaagcagagcgagagaaagttctacttcgacagcagcaccggcctgctgttcctgtacctgaaggccaagagccacagacacggccacagctactgcagcagccagggctgcgagagagtgaagatccaggccgccaccgacagcaaggacatcagcaactgcatggccaaggcctacccccagtactacagaaagcccagcgtggtgaagagaatgcccgccatgctgaccggcctgtgccagggctgcggcaccagacaggtggtgttcaccagcgacccccacaagagctacctgcccgtgcagttccagagccccgacaaggccgagacccagagaggcgaccccagcgtgatcagcgtgaacggcaccgacttcaccttcagaagcgccggcgtgctgctgctggtggtggacccctgcagcgtgcccttcagactgaccgagaagaccgtgttccccctggccgacgtgagcagaatcgaggagtacctgaagaccggcatcccccccagaagcatcgtgctgctgagcaccagaggcgagatcaagcagctgaacatcagccacctgctggtgcccctgggcctggccaagcccgcccacctgtacgacaagggcagcaccatcttcctgggcttcagcggcaacttcaagcccagctggaccaagctgttcaccagccccgccggccagggcctgggcgtgctggagcagttcatccccctgcagctggacgagtacggctgccccagagccaccaccgtgagaagaagagacctggagctgctgaagcaggccagcaaggcccactag

SEQ ID NO: 103212 - DNA, 3963 bp, Artificial Sequence
  Description of Artificial Sequence: Synthetic coding sequence
atgtacgccaccgacagcagaggccacagccccgccttcctgcagccccagaacggcaacagcagacaccccagcggctacgtgcccggcaaggtggtgcccctgagacccccccccccccccaagagccaggccagcgccaagttcaccagcatcagaagagaggacagagccaccttcgccttcagccccgaggagcagcaggcccagagagagagccagaagcagaagagacacaagaacaccttcatctgcttcgccatcaccagcttcagcttcttcatcgccctggccatcatcctgggcatcagcagcaagtacgcccccgacgagaactgccccgaccagaaccccagactgagaaactgggaccccggccaggacagcgccaagcaggtggtgatcaaggagggcgacatgctgagactgaccagcgacgccaccgtgcacagcatcgtgatccaggacggcggcctgctggtgttcggcgacaacaaggacggcagcagaaacatcaccctgagaacccactacatcctgatccaggacggcggcgccctgcacatcggcgccgagaagtgcagatacaagagcaaggccaccatcaccctgtacggcaagagcgacgagggcgagagcatgcccaccttcggcaagaagttcatcggcgtggaggccggcggcaccctggagctgcacggcgccagaaaggccagctggaccctgctggccagaaccctgaacagcagcggcctgcccttcggcagctacaccttcgagaaggacttcagcagaggcctgaacgtgagagtgatcgaccaggacaccgccaagatcctggagagcgagagattcgacacccacgagtacagaaacgagagcagaagactgcaggagttcctgagattccaggaccccggcagaatcgtggccatcgccgtgggcgacagcgccgccaagagcctgctgcagggcaccatccagatgatccaggagagactgggcagcgagctgatccagggcctgggctacagacaggcctgggccctggtgggcgtgatcgacggcggcagcaccagctgcaacgagagcgtgagaaactacgagaaccacagcagcggcggcaaggccctggcccagagagagttctacaccgtggacggccagaagttcagcgtgaccgcctacagcgagtggatcgaggagaccccccagttcctgcacatgggcgagatcatcgacggcgtggacatgagagccgaggtgggcatcctgaccagaaacatcgtgatccagggcgaggtggaggacagctgctacgccgagaaccagtgccagttcttcgactacgacaccttcggcggccacatcatgatcatgaagaacttcaccagcgtgcacctgagctacgtggagctgaagcacatgggccagcagcagatgggcagataccccgtgcacttccacctgtgcggcgacgtggactacaagggcggctacagacacgccaccttcgtggacggcctgagcatccaccacagcttcagcagatgcatcaccgtgcacggcaccaacggcctgctgatcaaggacaccatcggcttcgacaccctgggccactgcttcttcctggaggacggcatcgagcagagaaacaccctgttccacaacctgggcctgctgaccaagcccggcaccctgctgcccaccgacagaaacaacagcatgtgcaccaccatgagagacaaggtgttcggcaactacatccccgtgcccgccaccgactgcatggccgtgagcaccttctggatcgcccaccccaacaacaacctgatcaacaacgccgccgccggcagccaggacgccggcatctggtacctgttccacaaggagcccaccggcgagagcagcggcctgcagctgctggccaagcccgagctgacccccctgggcatcttctacaacaacagagtgcacagcaacttcaaggccggcctgttcatcgacaagggcgtgaagaccaccaacagcagcgccgccgaccccagagagtacctgtgcctggacaacagcgccagattcagaccccaccaggacgccaaccccgagaagcccagagtggccgccctgatcgacagactgatcgccttcaagaacaacgacaacggcgcctgggtgagaggcggcgacatcatcgtgcagaacagcgccttcgccgacaacggcatcggcctgaccttcgccagcgacggcagcttccccagcgacgagggcagcagccaggaggtgagcgagagcctgttcgtgggcgagagcagaaactacggcttccagggcggccagaacaagtacgtgggcaccggcggcatcgaccagaagcccagaaccctgcccagaaacagaaccttccccatcagaggcttccagatctacgacggccccatccacctgaccagaagcaccttcaagaagtacgtgcccacccccgacagatacagcagcgccatcggcttcctgatgaagaacagctggcagatcacccccagaaacaacatcagcctggtgaagttcggcccccacgtgagcctgaacgtgttcttcggcaagcccggcccctggttcgaggactgcgagatggacggcgacaagaacagcatcttccacgacatcgacggcagcgtgaccggctacaaggacgcctacgtgggcagaatggacaactacctgatcagacaccccagctgcgtgaacgtgagcaagtggaacgccgtgatctgcagcggcacctacgcccaggtgtacgtgcagacctggagcacccagaacctgagcatgaccatcaccagagacgagtaccccagcaaccccatggtgctgagaggcatcaaccagaaggccgccttcccccagtaccagcccgtggtgatgctggagaagggctacaccatccactggaacggccccgcccccagaaccaccttcctgtacctggtgaacttcaacaagaacgactggatcagagtgggcctgtgctaccccagcaacaccagcttccaggtgaccttcggctacctgcagagacagaacggcagcctgagcaagatcgaggagtacgagcccgtgcacagcctggaggagctgcagagaaagcagagcgagagaaagttctacttcgacagcagcaccggcctgctgttcctgtacctgaaggccaagagccacagacacggccacagctactgcagcagccagggctgcgagagagtgaagatccaggccgccaccgacagcaaggacatcagcaactgcatggccaaggcctacccccagtactacagaaagcccagcgtggtgaagagaatgcccgccatgctgaccggcctgtgccagggctgcggcaccagacaggtggtgttcaccagcgacccccacaagagctacctgcccgtgcagttccagagccccgacaaggccgagacccagagaggcgaccccagcgtgatcagcgtgaacggcaccgacttcaccttcagaagcgccggcgtgctgctgctggtggtggacccctgcagcgtgcccttcagactgaccgagaagaccgtgttccccctggccgacgtgagcagaatcgaggagtacctgaagaccggcatcccccccagaagcatcgtgctgctgagcaccagaggcgagatcaagcagctgaacatcagccacctgctggtgcccctgggcctggccaagcccgcccacctgtacgacaagggcagcaccatcttcctgggcttcagcggcaacttcaagcccagctggaccaagctgttcaccagccccgccggccagggcctgggcgtgctggagcagttcatccccctgcagctggacgagtacggctgccccagagccaccaccgtgagaagaagagacctggagctgctgaagcaggccagcaaggcccactag

SEQ ID NO: 103213 - DNA, 1131 bp, Artificial Sequence
  Description of Artificial Sequence: Synthetic coding sequence
atgaccatcaccagagacgagtaccccagcaaccccatggtgctgagaggcatcaaccagaaggccgccttcccccagtaccagcccgtggtgatgctggagaagggctacaccatccactggaacggccccgcccccagaaccaccttcctgtacctggtgaacttcaacaagaacgactggatcagagtgggcctgtgctaccccagcaacaccagcttccaggtgaccttcggctacctgcagagacagaacggcagcctgagcaagatcgaggagtacgagcccgtgcacagcctggaggagctgcagagaaagcagagcgagagaaagttctacttcgacagcagcaccggcctgctgttcctgtacctgaaggccaagagccacagacacggccacagctactgcagcagccagggctgcgagagagtgaagatccaggccgccaccgacagcaaggacatcagcaactgcatggccaaggcctacccccagtactacagaaagcccagcgtggtgaagagaatgcccgccatgctgaccggcctgtgccagggctgcggcaccagacaggtggtgttcaccagcgacccccacaagagctacctgcccgtgcagttccagagccccgacaaggccgagacccagagaggcgaccccagcgtgatcagcgtgaacggcaccgacttcaccttcagaagcgccggcgtgctgctgctggtggtggacccctgcagcgtgcccttcagactgaccgagaagaccgtgttccccctggccgacgtgagcagaatcgaggagtacctgaagaccggcatcccccccagaagcatcgtgctgctgagcaccagaggcgagatcaagcagctgaacatcagccacctgctggtgcccctgggcctggccaagcccgcccacctgtacgacaagggcagcaccatcttcctgggcttcagcggcaacttcaagcccagctggaccaagctgttcaccagccccgccggccagggcctgggcgtgctggagcagttcatccccctgcagctggacgagtacggctgccccagagccaccaccgtgagaagaagagacctggagctgctgaagcaggccagcaaggcccactag

SEQ ID NO: 103214 - DNA, 57 bp, Artificial Sequence
  Description of Artificial Sequence: Synthetic coding sequence
atgtacgccaccgacagcagaggccacagccccgccttcctgcagccccagaactag

SEQ ID NO: 103215 - DNA, 570 bp, Artificial Sequence
  Description of Artificial Sequence: Synthetic coding sequence
atggaggagggcggcaacctgggcggcctgatcaagatggtgcacctgctggtgctgagcggcgcctggggcatgcagatgtgggtgaccttcgtgagcggcttcctgctgttcagaagcctgcccagacacaccttcggcctggtgcagagcaagctgttccccttctacttccacatcagcatgggctgcgccttcatcaacctgtgcatcctggccagccagcacgcctgggcccagctgaccttctgggaggccagccagctgtacctgctgttcctgagcctgaccctggccaccgtgaacgccagatggctggagcccagaaccaccgccgccatgtgggccctgcagaccgtggagaaggagagaggcctgggcggcgaggtgcccggcagccaccagggccccgacccctacagacagctgagagagaaggaccccaagtacagcgccctgagacagaacttcttcagataccacggcctgagcagcctgtgcaacctgggctgcgtgctgagcaacggcctgtgcctggccggcctggccctggagatcagaagcctgtag

SEQ ID NO: 103216 - DNA, 570 bp, Artificial Sequence; identical to SEQ ID NO: 103215
  Description of Artificial Sequence: Synthetic coding sequence

SEQ ID NO: 103217 - DNA, 570 bp, Artificial Sequence; identical to SEQ ID NO: 103215
  Description of Artificial Sequence: Synthetic coding sequence

SEQ ID NO: 103218 - DNA, 447 bp, Artificial Sequence
  Description of Artificial Sequence: Synthetic coding sequence
atgctgcccagaggcctgaagatggcccccagaggcaagagactgagcagcacccccctggagatcctgttcttcctgaacggctggtacaacgccacctacttcctgctggagctgttcatcttcctgtacaagggcgtgctgctgccctaccccaccgccaacctggtgctggacgtggtgatgctgctgctgtacctgggcatcgaggtgatcagactgttcttcggcaccaagggcaacctgtgccagagaaagatgcccctgagcatcagcgtggccctgaccttccccagcgccatgatggccagctactacctgctgctgcagacctacgtgctgagactggaggccatcatgaacggcatcctgctgttcttctgcggcagcgagctgctgctggaggtgctgaccctggccgccttcagcagcatggacagaatctag

SEQ ID NO: 103219 - DNA, 438 bp, Artificial Sequence
  Description of Artificial Sequence: Synthetic coding sequence
atgctgcccagaggcctgaagatggcccccagaggcaagagactgagcagcacccccctggagatcctgttcttcctgaacggctggtacaacgccacctacttcctgctggagctgttcatcttcctgtacaagggcgtgctgctgccctaccccaccgccaacctggtgctggacgtggtgatgctgctgctgtacctgggcatcgaggtgatcagactgttcttcggcaccaagggcaacctgtgccagagaaagatgcccctgagcatcagcgtggccctgaccttccccagcgccatgatggccagctactacctgctgctgcagacctacgtgctgagactggaggccatcatgaacggcatcctgctgttcttctgcggcagcgagctgctgctggaggtgctgaccctggccgccttcagcagaatctag

SEQ ID NO: 103220 - DNA, 942 bp, Artificial Sequence
  Description of Artificial Sequence: Synthetic coding sequence
atgagaaccgacagcggcgccagactggaggagggccacctgagaccccccagagccctgccccccgtgcccagcatcgacgacatccccctgagcagacccaagaagaagaagacccagcccgccgagctgcagtacgccaacgagctgggcgtggaggacgaggacatcatcaccgacgagcagaccaccgtggagcagcagagcgtgttcaccgcccccaccggcatcagccagcccgtgggcaaggtgttcgtggagaagagcagaagattccaggccgccgacagaagcgagctgatcaagaccaccgagaacatcgacgtgagcatggacgtgaagcccagctggaccaccagagacgtggccctgaccgtgcacagagccttcagaatgatcggcctgttcagccacggcttcctggccggctgcgccgtgtggaacatcgtggtgatctacgtgctggccggcgaccagctgagcaacctgagcaacctgctgcagcagtacaagaccctggcctaccccttccagagcctgctgtacctgctgctggccctgagcaccatcagcgccttcgacagaatcgacttcgccaagatcagcgtggccatcagaaacttcctggccctggaccccaccgccctggccagcttcctgtacttcaccgccctgatcctgagcctgagccagcagatgaccagcgacagaatccacctgtacacccccagcagcgtgaacggcagcctgtgggaggccggcatcgaggagcagatcctgcagccctggatcgtggtgaacctggtggtggccctgctggtgggcctgagctggctgttcctgagctacagacccggcatggacctgagcgaggagctgatgttcagcagcgaggtggaggagtaccccgacaaggagaaggagatcaaggccagcagctag

SEQ ID NO: 103221 - DNA, 1203 bp, Artificial Sequence
  Description of Artificial Sequence: Synthetic coding sequence
atgggcaagaaccccgtgagaccccccagagccctgccccccgtgcccagccaggacgacatccccctgagcagacccaagaagaagaagcccagaaccaagaacacccccgccagcgccagcctggagggcctggcccagaccgccggcagaagacccagcgagggcaacgagcccagcaccaaggagctgaaggagcaccccgaggcccccgtgcagagaagacagaagaagaccagactgcccctggagctggagaccagcagcacccagaagaagagcagcagcagcagcctgctgagaaacgagaacggcatcgacgccgagcccgccgaggaggccgtgatccagaagcccagaagaaagaccaagaagacccagcccgccgagctgcagtacgccaacgagctgggcgtggaggacgaggacatcatcaccgacgagcagaccaccgtggagcagcagagcgtgttcaccgcccccaccggcatcagccagcccgtgggcaaggtgttcgtggagaagagcagaagattccaggccgccgacagaagcgagctgatcaagaccaccgagaacatcgacgtgagcatggacgtgaagcccagctggaccaccagagacgtggccctgaccgtgcacagagccttcagaatgatcggcctgttcagccacggcttcctggccggctgcgccgtgtggaacatcgtggtgatctacgtgctggccggcgaccagctgagcaacctgagcaacctgctgcagcagtacaagaccctggcctaccccttccagagcctgctgtacctgctgctggccctgagcaccatcagcgccttcgacagaatcgacttcgccaagatcagcgtggccatcagaaacttcctggccctggaccccaccgccctggccagcttcctgtacttcaccgccctgatcctgagcctgagccagcagatgaccagcgacagaatccacctgtacacccccagcagcgtgaacggcagcctgtgggaggccggcatcgaggagcagatcctgcagccctggatcgtggtgaacctggtggtggccctgctggtgggcctgagctggctgttcctgagctacagacccggcatggacctgagcgaggagctgatgttcagcagcgaggtggaggagtaccccgacaaggagaaggagatcaaggccagcagctag

SEQ ID NO: 103222 - DNA, 1227 bp, Artificial Sequence
  Description of Artificial Sequence: Synthetic coding sequence
atgagaaccgacagcggcgccagactggaggagggccacctgagaccccccagagccctgccccccgtgcccagccaggacgacatccccctgagcagacccaagaagaagaagcccagaaccaagaacacccccgccagcgccagcctggagggcctggcccagaccgccggcagaagacccagcgagggcaacgagcccagcaccaaggagctgaaggagcaccccgaggcccccgtgcagagaagacagaagaagaccagactgcccctggagctggagaccagcagcacccagaagaagagcagcagcagcagcctgctgagaaacgagaacggcatcgacgccgagcccgccgaggaggccgtgatccagaagcccagaagaaagaccaagaagacccagcccgccgagctgcagtacgccaacgagctgggcgtggaggacgaggacatcatcaccgacgagcagaccaccgtggagcagcagagcgtgttcaccgcccccaccggcatcagccagcccgtgggcaaggtgttcgtggagaagagcagaagattccaggccgccgacagaagcgagctgatcaagaccaccgagaacatcgacgtgagcatggacgtgaagcccagctggaccaccagagacgtggccctgaccgtgcacagagccttcagaatgatcggcctgttcagccacggcttcctggccggctgcgccgtgtggaacatcgtggtgatctacgtgctggccggcgaccagctgagcaacctgagcaacctgctgcagcagtacaagaccctggcctaccccttccagagcctgctgtacctgctgctggccctgagcaccatcagcgccttcgacagaatcgacttcgccaagatcagcgtggccatcagaaacttcctggccctggaccccaccgccctggccagcttcctgtacttcaccgccctgatcctgagcctgagccagcagatgaccagcgacagaatccacctgtacacccccagcagcgtgaacggcagcctgtgggaggccggcatcgaggagcagatcctgcagccctggatcgtggtgaacctggtggtggccctgctggtgggcctgagctggctgttcctgagctacagacccggcatggacctgagcgaggagctgatgttcagcagcgaggtggaggagtaccccgacaaggagaaggagatcaaggccagcagctag

SEQ ID NO: 103223 - DNA, 1293 bp, Artificial Sequence
  Description of Artificial Sequence: Synthetic coding sequence
atgacccactgcgcctgcgccagagacagaagagagggctggggcgccagatgcctgggcagaagaccccccagacccgccaagagaagaatgggcaagaaccccgtgagaccccccagagccctgccccccgtgcccagcatcgacgacatccccctgagcagacccaagaagaagaagcccagaaccaagaacacccccgccagcgccagcctggagggcctggcccagaccgccggcagaagacccagcgagggcaacgagcccagcaccaaggagctgaaggagcaccccgaggcccccgtgcagagaagacagaagaagaccagactgcccctggagctggagaccagcagcacccagaagaagagcagcagcagcagcctgctgagaaacgagaacggcatcgacgccgagcccgccgaggaggccgtgatccagaagcccagaagaaagaccaagaagacccagcccgccgagctgcagtacgccaacgagctgggcgtggaggacgaggacatcatcaccgacgagcagaccaccgtggagcagcagagcgtgttcaccgcccccaccggcatcagccagcccgtgggcaaggtgttcgtggagaagagcagaagattccaggccgccgacagaagcgagctgatcaagaccaccgagaacatcgacgtgagcatggacgtgaagcccagctggaccaccagagacgtggccctgaccgtgcacagagccttcagaatgatcggcctgttcagccacggcttcctggccggctgcgccgtgtggaacatcgtggtgatctacgtgctggccggcgaccagctgagcaacctgagcaacctgctgcagcagtacaagaccctggcctaccccttccagagcctgctgtacctgctgctggccctgagcaccatcagcgccttcgacagaatcgacttcgccaagatcagcgtggccatcagaaacttcctggccctggaccccaccgccctggccagcttcctgtacttcaccgccctgatcctgagcctgagccagcagatgaccagcgacagaatccacctgtacacccccagcagcgtgaacggcagcctgtgggaggccggcatcgaggagcagatcctgcagccctggatcgtggtgaacctggtggtggccctgctggtgggcctgagctggctgttcctgagctacagacccggcatggacctgagcgaggagctgatgttcagcagcgaggtggaggagtaccccgacaaggagaaggagatcaaggccagcagctag

SEQ ID NO: 103224 - DNA, 1227 bp, Artificial Sequence
  Description of Artificial Sequence: Synthetic coding sequence
atgagaaccgacagcggcgccagactggaggagggccacctgagaccccccagagccctgccccccgtgcccagcatcgacgacatccccctgagcagacccaagaagaagaagcccagaaccaagaacacccccgccagcgccagcctggagggcctggcccagaccgccggcagaagacccagcgagggcaacgagcccagcaccaaggagctgaaggagcaccccgaggcccccgtgcagagaagacagaagaagaccagactgcccctggagctggagaccagcagcacccagaagaagagcagcagcagcagcctgctgagaaacgagaacggcatcgacgccgagcccgccgaggaggccgtgatccagaagcccagaagaaagaccaagaagacccagcccgccgagctgcagtacgccaacgagctgggcgtggaggacgaggacatcatcaccgacgagcagaccaccgtggagcagcagagcgtgttcaccgcccccaccggcatcagccagcccgtgggcaaggtgttcgtggagaagagcagaagattccaggccgccgacagaagcgagctgatcaagaccaccgagaacatcgacgtgagcatggacgtgaagcccagctggaccaccagagacgtggccctgaccgtgcacagagccttcagaatgatcggcctgttcagccacggcttcctggccggctgcgccgtgtggaacatcgtggtgatctacgtgctggccggcgaccagctgagcaacctgagcaacctgctgcagcagtacaagaccctggcctaccccttccagagcctgctgtacctgctgctggccctgagcaccatcagcgccttcgacagaatcgacttcgccaagatcagcgtggccatcagaaacttcctggccctggaccccaccgccctggccagcttcctgtacttcaccgccctgatcctgagcctgagccagcagatgaccagcgacagaatccacctgtacacccccagcagcgtgaacggcagcctgtgggaggccggcatcgaggagcagatcctgcagccctggatcgtggtgaacctggtggtggccctgctggtgggcctgagctggctgttcctgagctacagacccggcatggacctgagcgaggagctgatgttcagcagcgaggtggaggagtaccccgacaaggagaaggagatcaaggccagcagctag

SEQ ID NO: 103225 - DNA, 1101 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggcctgctggccaccagagtggaggtgcccctgctgggcatcgtggtggccgccggcctggccctgggcaccctggtgggcttcagcaccctggtggcctgcctggtgtgcagaaaggagaagaagaccaagggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcttcatcagactgcccgtgctgggctacatctacagagtgagcagcgtgagcagcgacgagatctggctgtag

SEQ ID NO: 103226 - DNA, 657 bp, Artificial Sequence
  Description of Artificial Sequence: Synthetic coding sequence
atggccctgccccccggccccgccgccctgagacacaccctgctgctgctgcccgccctgctgagcagcgtgaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcttcatcagactgcccgtgctgggctacatctacagagtgagcagcgtgagcagcgacgagatctggctgtag

SEQ ID NO: 103227 - DNA, 1056 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggcctgctggccaccagagtggaggtgcccctgctgggcatcgtggtggccgccggcctggccctgggcaccctggtgggcttcagcaccctggtggcctgcctggtgtgcagaaaggagaagaagaccaagggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcagaagaaaccaggacaaggacgcctag

SEQ ID NO: 103228 - DNA, 969 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcttcatcagactgcccgtgctgggctacatctacagagtgagcagcgtgagcagcgacgagatctggctgtag

SEQ ID NO: 103229 - DNA, 969 bp, Artificial Sequence; identical to SEQ ID NO: 103228
  Description of Artificial Sequence: Synthetic coding sequence

SEQ ID NO: 103230 - DNA, 921 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggccccagcagacaccccagcctgatcagcagcgacagcaacaacctgaagctgaacaacgtgagactgcccagagagaacatgagcctgcccagcaacctgcagctgaacgacctgacccccgacagcagagtgaagcccgccgacagacagatggcccagaacaacagcagacccgagctgctggaccccgagcccggcggcctgctgaccagccagggcagaagaaaccaggacaaggacgcctag

SEQ ID NO: 103231 - DNA, 1146 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagttcaagcccgagatcgcccaggtgggcgccaagtaccaggaggcccagggccccggcctgctggtggtgctgttcgccctggtgagagccaacccccccgccaacgtgacctggatcgaccaggacggccccgtgaccgtgaacaccagcgacttcctggtgctggacgcccagaactacccctggctgaccaaccacaccgtgcagctgcagctgagaagcctggcccacaacctgagcgtggtggccaccaacgacgtgggcgtgaccagcgccagcctgcccgcccccggcctgctggccaccagagtggaggtgcccctgctgggcatcgtggtggccgccggcctggccctgggcaccctggtgggcttcagcaccctggtggcctgcctggtgtgcagaaaggagaagaagaccaagggccccagcagacaccccagcctgatcagcagcgacagcaacaacctgaagctgaacaacgtgagactgcccagagagaacatgagcctgcccagcaacctgcagctgaacgacctgacccccgacagcagagtgaagcccgccgacagacagatggcccagaacaacagcagacccgagctgctggaccccgagcccggcggcctgctgaccagccaggcctgcctgctgcaccacggcacccccgccctgaccaacccctggctgccccaccagcaggagggcgccctgcccggcggctggagcccccaggcccacaacagcaccgtgtggaagctgtag

SEQ ID NO: 103232 - DNA, 810 bp, Artificial Sequence
  Description of Artificial Sequence: Synthetic coding sequence
atggccctgccccccggccccgccgccctgagacacaccctgctgctgctgcccgccctgctgagcagcggctggggcgagctggagccccagatcgacggccagacctgggccgagagagccctgagagagaacgagagacacgccttcacctgcagagtggccggcggccccggcacccccagactggcctggtacctggacggccagctgcaggaggccagcaccagcagactgctgagcgtgggcggcgaggccttcagcggcggcaccagcaccttcaccgtgaccgcccacagagcccagcacgagctgaactgcagcctgcaggaccccagaagcggcagaagcgccaacgccagcgtgatcctgaacgtgcagtggctgctggccaccagagtggaggtgcccctgctgggcatcgtggtggccgccggcctggccctgggcaccctggtgggcttcagcaccctggtggcctgcctggtgtgcagaaaggagaagaagaccaagggccccagcagacaccccagcctgatcagcagcgacagcaacaacctgaagctgaacaacgtgagactgcccagagagaacatgagcctgcccagcaacctgcagctgaacgacctgacccccgacagcagagccgtgaagcccgccgacagacagatggcccagaacaacagcagacccgagctgctggaccccgagcccggcggcctgctgaccagccagggcttcatcagactgcccgtgctgggctacatctacagagtgagcagcgtgagcagcgacgagatctggctgtag

SEQ ID NO: 103233 - DNA, 669 bp, Artificial Sequence
  Description of Artificial Sequence: Synthetic coding sequence
atgctgtggctgctgttcttcctggtgaccgccatccacgccgagctgtgccagcccggcgccgagaacgccttcaaggtgagactgagcatcagaaccgccctgggcgacaaggcctacgcctgggacaccaacgaggagtacctgttcaaggccatggtggccttcagcatgagaaaggtgcccaacagagaggccaccgagatcagccacgtgctgctgtgcaacgtgacccagagagtgagcttctggttcgtggtgaccgaccccagcaagaaccacaccctgcccgccgtggaggtgcagagcgccatcagaatgaacaagaacagaatcaacaacgccttcttcctgaacgaccagaccctggagttcctgaagatccccagcaccctggccccccccatggaccccagcgtgcccatctggatcatcatcttcggcgtgatcttctgcatcatcatcgtggccatcgccctgctgatcctgagcggcatctggcagagaagaagaaagaacaaggagcccagcgaggtggacgacgccgaggacaagtgcgagaacatgatcaccatcgagaacggcatccccagcgaccccctggacatgaagggcggccacatcaacgacgccttcatgaccgaggacgagagactgacccccctgtag

SEQ ID NO: 103234 - DNA, 252 bp, Artificial Sequence
  Description of Artificial Sequence: Synthetic coding sequence
atgctgagaaacctgctggccctgagacagatcggccagagaaccatcagcaccgccagcagaagacacttcaagaacaaggtgcccgagaagcagaagctgttccaggaggacgacgagatccccctgtacctgaagggcggcgtggccgacgccctgctgtacagagccaccatgatcctgaccgtgggcggcaccgcctacgccatctacgagctggccgtggccagcttccccaagaagcaggagtag

SEQ ID NO: 103235 - DNA, 729 bp, Artificial Sequence
  Description of Artificial Sequence: Synthetic coding sequence
atgtactacggcctgagcaacttctaccagaaccacagaagatacgtgaagagcagagacgacagccagctgaacggcgacagcagcgccctgctgaaccccagcaaggagtgcgagccctacagaagaaacgaggacaagcccatcgccccctgcggcgccatcgccaacagcatgttcaacgacaccctggagctgttcctgatcggcaacgacagctaccccatccccatcgccctgaagaagaagggcatcgcctggtggaccgacaagaacgtgaagttcagaaacccccccggcggcgacaacctggaggagagattcaagggcaccaccaagcccgtgaactggctgaagcccgtgtacatgctggacagcgaccccgacaacaacggcttcatcaacgaggacttcatcgtgtggatgagaaccgccgccctgcccaccttcagaaagctgtacagactgatcgagagaaagagcgacctgcaccccaccctgcccgccggcagatacagcctgaacgtgacctacaactaccccgtgcactacttcgacggcagaaagagaatgatcctgagcaccatcagctggatgggcggcaagaaccccttcctgggcatcgcctacatcgccgtgggcagcatcagcttcctgctgggcgtggtgctgctggtgatcaaccacaagtacagaaacagcagcaacaccgccgacatcaccatctag

SEQ ID NO: 103236 - DNA, 978 bp, Artificial Sequence
  Description of Artificial Sequence: Synthetic coding sequence
atggccatgaactacaacgccaaggacgaggtggacggcggccccccctgcgcccccggcggcaccgccaagaccagaagacccgacaacaccgccttcaagcagcagagactgcccgcctggcagcccatcctgaccgccggcaccgtgctgcccatcttcttcatcatcggcctgatcttcatccccatcggcatcggcatcttcgtgaccagcaacaacatcagagagatcgagggcaacgtgttcatgtactacggcctgagcaacttctaccagaaccacagaagatacgtgaagagcagagacgacagccagctgaacggcgacagcagcgccctgctgaaccccagcaaggagtgcgagccctacagaagaaacgaggacaagcccatcgccccctgcggcgccatcgccaacagcatgttcaacgacaccctggagctgttcctgatcggcaacgacagctaccccatccccatcgccctgaagaagaagggcatcgcctggtggaccgacaagaacgtgaagttcagaaacccccccggcggcgacaacctggaggagagattcaagggcaccaccaagcccgtgaactggctgaagcccgtgtacatgctggacagcgaccccgacaacaacggcttcatcaacgaggacttcatcgtgtggatgagaaccgccgccctgcccaccttcagaaagctgtacagactgatcgagagaaagagcgacctgcaccccaccctgcccgccggcagatacagcctgaacgtgacctacaactaccccgtgcactacttcgacggcagaaagagaatgatcctgagcaccatcagctggatgggcggcaagaaccccttcctgggcatcgcctacatcgccgtgggcagcatcagcttcctgctgggcgtggtgctgctggtgatcaaccacaagtacagaaacagcagcaacaccgccgacatcaccatctag

SEQ ID NO: 103237 - DNA, 234 bp, Artificial Sequence
  Description of Artificial Sequence: Synthetic coding sequence
atgtactacggcctgagcaacttctaccagaaccacagaagatacgtgaagagcagagacgacagccagctgaacggcgacagcagcgccctgctgaaccccagcaaggagtgcgagccctacagaagaaacgaggacaagcccatcgccccctgcggcgccatcgccaacagcatgttcaacgacaccctggagctgttcctgatcggcaacgacagctaccccatcccctag

SEQ ID NO: 103238 - DNA, 1038 bp, Artificial Sequence
  Description of Artificial Sequence: Synthetic coding sequence
atggccatgaactacaccgccaagaccagaagacccgacaacaccgccttcaagcagcagagactgcccgcctggcagcccatcctgaccgccggcaccgtgctgcccatcttcttcatcatcggcctgatcttcatccccatcggcatcggcatcttcgtgaccagcaacaacatcagagagatcgagatcgactacaccggcaccgagcccagcagcccctgcaacaagtgcctgagccccgacgtgaccccctgcttctgcaccatcaacttcaccctggagaagagcttcgagggcaacgtgttcatgtactacggcctgagcaacttctaccagaaccacagaagatacgtgaagagcagagacgacagccagctgaacggcgacagcagcgccctgctgaaccccagcaaggagtgcgagccctacagaagaaacgaggacaagcccatcgccccctgcggcgccatcgccaacagcatgttcaacgacaccctggagctgttcctgatcggcaacgacagctaccccatccccatcgccctgaagaagaagggcatcgcctggtggaccgacaagaacgtgaagttcagaaacccccccggcggcgacaacctggaggagagattcaagggcaccaccaagcccgtgaactggctgaagcccgtgtacatgctggacagcgaccccgacaacaacggcttcatcaacgaggacttcatcgtgtggatgagaaccgccgccctgcccaccttcagaaagctgtacagactgatcgagagaaagagcgacctgcaccccaccctgcccgccggcagatacagcctgaacgtgacctacaactaccccgtgcactacttcgacggcagaaagagaatgatcctgagcaccatcagctggatgggcggcaagaaccccttcctgggcatcgcctacatcgccgtgggcagcatcagcttcctgctgggcgtggtgctgctggtgatcaaccacaagtacagaaacagcagcaacaccgccgacatcaccatctag

SEQ ID NO: 103239 - DNA, 1056 bp, Artificial Sequence
  Description of Artificial Sequence: Synthetic coding sequence
atgacctggagcgccaccgccagaggcgcccaccagcccgacaacaccgccttcacccagcagagactgcccgcctggcagcccctgctgagcgccagcatcgccctgcccctgttcttctgcgccggcctggccttcatcggcctgggcctgggcctgtactacagcagcaacggcatcaaggagctggagtacgactacaccggcgaccccggcaccggcaactgcagcgtgtgcgccgccgccggccagggcagagccctgccccccccctgcagctgcgcctggtacttcagcctgcccgagctgttccagggccccgtgtacctgtactacgagctgaccaacttctaccagaacaacagaagatacggcgtgagcagagacgacgcccagctgagcggcctgcccagcgccctgagacaccccgtgaacgagtgcgccccctaccagagaagcgccgccggcctgcccatcgccccctgcggcgccatcgccaacagcctgttcaacgacagcttcagcctgtggcaccagagacagcccggcggcccctacgtggaggtgcccctggacagaagcggcatcgcctggtggaccgactaccacgtgaagttcagaaacccccccctggtgaacggcagcctggccctggccttccagggcaccgcccccccccccaactggagaagacccgtgtacgagctgagccccgaccccaacaacaccggcttcatcaaccaggacttcgtggtgtggatgagaaccgccgccctgcccaccttcagaaagctgtacgccagaatcagacagggcaactacagcgccggcctgcccagaggcgcctacagagtgaacatcacctacaactaccccgtgagagccttcggcggccacaagctgctgatcttcagcagcatcagctggatgggcggcaagaaccccttcctgggcatcgcctacctggtggtgggcagcctgtgcatcctgaccggcttcgtgatgctggtggtgtacatcagataccaggaccaggacgacgacgacgaggagtag

SEQ ID NO: 103240 - DNA, 1056 bp, Artificial Sequence; identical to SEQ ID NO: 103239
  Description of Artificial Sequence: Synthetic coding sequence

SEQ ID NO: 103241 - DNA, 342 bp, Artificial Sequence
  Description of Artificial Sequence: Synthetic coding sequence
atggaggagagagcccagcactgcctgagcagactgctggacaacagcgccctgaagcagcaggagctgcccatccacagactgtacttcaccgccagaagagtgctgttcgtgttcttcgccaccggcatcttctgcctgtgcatgggcatcatcctgatcctgagcgccagaagcacccaggagatcgagatcaactacaccagaatctgcgccaactgcgccaagctgagagagaacgccagcaacttcgacaaggagtgcacctgcagcatccccttctacctgagcggcaagatgatggtgggcgagatccaggagaccagactgaccctgcactag

SEQ ID NO: 103242 - DNA, 207 bp, Artificial Sequence
  Description of Artificial Sequence: Synthetic coding sequence
tgactgtgcatgggcatcatcctgatcctgagcgccagaagcacccaggagatcgagatcaactacaccagaatctgcgccaactgcgccaagctgagagagaacgccagcaacttcgacaaggagtgcacctgcagcatccccttctacctgagcggcaagatgatggtgggcgagatccaggagaccagactgaccctgcactag

SEQ ID NO: 103243 - DNA, 1203 bp, Artificial Sequence
  Description of Artificial Sequence: Synthetic coding sequence
atggccgccaactacagcagcaccagcaccagaagagagcacgtgaaggtgaagaccagcagccagcccggcttcctggagagactgagcgagaccagcggcggcatgttcgtgggcctgatggccttcctgctgagcttctacctgatcttcaccaacgagggcagagccctgaagaccgccaccagcctggccgagggcctgagcctggtggtgagccccgacagcatccacagcgtggcccccgagaacgagggcagactggtgcacatcatcggcgccctgagaaccagcaagctgctgagcgaccccaactacggcgtgcacctgcccgccgtgaagctgagaagacacgtggagatgtaccagtgggtggagaccgaggagagcagagagtacaccgaggacggccaggtgaagaaggagaccagatacagctacaacaccgagtggagaagcgagatcatcaacagcaagaacttcgacagagagatcggccacaagaaccccagcgccatggccgtggagagcttcatggccaccgcccccttcgtgcagatcggcagattcttcctgagcagcggcctgatcgacaaggtggacaacttcaagagcctgagcctgagcaagctggaggacccccacgtggacatcatcagaagaggcgacttcttctaccacagcgagaaccccaagtaccccgaggtgggcgacctgagagtgagcttcagctacgccggcctgagcggcgacgaccccgacctgggccccgcccacgtggtgaccgtgatcgccagacagagaggcgaccagctggtgcccttcagcaccaagagcggcgacaccctgctgctgctgcaccacggcgacttcagcgccgaggaggtgttccacagagagctgagaagcaacagcatgaagacctggggcctgagagccgccggctggatggccatgttcatgggcctgaacctgatgaccagaatcctgtacaccctggtggactggttccccgtgttcagagacctggtgaacatcggcctgaaggccttcgccttctgcgtggccaccagcctgaccctgctgaccgtggccgccggctggctgttctacagacccctgtgggccctgctgatcgccggcctggccctggtgcccatcctggtggccagaaccagagtgcccgccaagaagctggagtag

SEQ ID NO: 103244 - DNA, 546 bp, Artificial Sequence
  Description of Artificial Sequence: Synthetic coding sequence
atggccagcgccggcagcggcatggaggaggtgagagtgagcgtgctgacccccctgaagctggtgggcctggtgtgcatcttcctggccctgtgcctggacctgggcgccgtgctgagccccgcctgggtgaccgccgaccaccagtactacctgagcctgtgggagagctgcagaaagcccgccagcctggacatctggcactgcgagagcaccctgagcagcgactggcagatcgccaccctggccctgctgctgggcggcgccgccatcatcctgatcgccttcctggtgggcctgatcagcatctgcgtgggcagcagaagaagattctacagacccgtggccgtgatgctgttcgccgccgtggtgctgcaggtgtgcagcctggtgctgtaccccatcaagttcatcgagaccgtgagcctgaagatctaccacgagttcaactggggctacggcctggcctggggcgccaccatcttcagcttcggcggcgccatcctgtactgcctgaaccccaagaactacgaggactactactag

SEQ ID NO: 103245 - DNA, 2745 bp, Artificial Sequence; identical to SEQ ID NO: 76570
  Description of Artificial Sequence: Synthetic coding sequence

SEQ ID NO: 103246 - DNA, 1674 bp, Artificial Sequence
  Description of Artificial Sequence: Synthetic coding sequence
atggccaccgccgtgagcagaccctgcgccggcagaagcagagacatcctgtggagagtgctgggctggagaatcgtggccagcatcgtgtggagcgtgctgttcctgcccatctgcaccaccgtgttcatcatcttcagcagaatcgacctgttccaccccatccagtggctgagcgacagcttcagcgacctgtacagcagctacgtgatcttctacttcctgctgctgagcgtggtgatcatcatcatcagcatcttcaacgtggagttctacgccgtggtgcccagcatcccctgcagcagactggccctgatcggcaagatcatccacccccagcagctgatgcacagcttcatccacgccgccatgggcatggtgatggcctggtgcgccgccgtgatcacccagggccagtacagcttcctggtggtgccctgcaccggcaccaacagcttcggcagccccgccgcccagacctgcctgaacgagtaccacctgttcttcctgctgaccggcgccttcatgggctacagctacagcctgctgtacttcgtgaacaacatgaactacctgcccttccccatcatccagcagtacaagttcctgagattcagaagaagcctgctgctgctggtgaagcacagctgcgtggagagcctgttcctggtgagaaacttctgcatcctgtactacttcctgggctacatccccaaggcctggatcagcaccgccatgaacctgcacatcgacgagcaggtgcacagacccctggacaccgtgagcggcctgctgaacctgagcctgctgtaccacgtgtggctgtgcggcgtgttcctgctgaccacctggtacgtgagctggatcctgttcaagatctacgccaccgaggcccacgtgttccccgtgcagccccccttcgccgagggcagcgacgagtgcctgcccaaggtgctgaacagcaaccccccccccatcatcaagtacctggccctgcaggacctgatgctgctgagccagtacagccccagcagaagacaggaggtgttcagcctgagccagcccggcggccacccccacaactggaccgccatcagcagagagtgcctgaacctgctgaacgagatgaccgagttcagcaaccccagccccagcaccagcatcagcgccgagggcaagaccatgagacagcccagcgtgatctacagctggatccagaacaagagagagcagatcaagaacttcctgagcaagagagtgctgatcatgtacttcttcagcaagcaccccgaggccagcatccaggccgtgttcagcgacgcccagatgcacatctgggccctggagggcctgagccacctggtggccgccagcttcaccgaggacagattcggcgtggtgcagaccaccctgcccgccatcctgaacaccctgctgaccctgcaggaggccgtggacaagtacttcaagctgccccacgccagcagcaagccccccagaatcagcggcagcctggtggacaccagctacaagaccctgagattcgccttcagagccagcctgaagaccgccatctacagaatcaccaccaccttcggcgagcacctgaacgccgtgcaggccagcgccgagcaccagaagagactgcagcagttcctggagttcaaggagtag

SEQ ID NO: 103247 - DNA, 2025 bp, Artificial Sequence
  Description of Artificial Sequence: Synthetic coding sequence
atggccaccgccgtgagcagaccctgcgccggcagaagcagagacatcctgtggagagtgctgggctggagaatcgtggccagcatcgtgtggagcgtgctgttcctgcccatctgcaccaccgtgttcatcatcttcagcagaatcgacctgttccaccccatccagtggctgagcgacagcttcagcgacctgtacagcagctacgtgatcttctacttcctgctgctgagcgtggtgatcatcatcatcagcatcttcaacgtggagttctacgccgtggtgcccagcatcccctgcagcagactggccctgatcggcaagatcatccacccccagcagctgatgcacagcttcatccacgccgccatgggcatggtgatggcctggtgcgccgccgtgatcacccagggccagtacagcttcctggtggtgccctgcaccggcaccaacagcttcggcagccccgccgcccagacctgcctgaacgagtaccacctgttcttcctgctgaccggcgccttcatgggctacagctacagcctgctgtacttcgtgaacaacatgaactacctgcccttccccatcatccagcagtacaagttcctgagattcagaagaagcctgctgctgctggtgaagcacagctgcgtggagagcctgttcctggtgagaaacttctgcatcctgtactacttcctgggctacatccccaaggcctggatcagcaccgccatgaacctgcacatcgacgagcaggtgcacagacccctggacaccgtgagcggcctgctgaacctgagcctgctgtaccacgtgtggctgtgcggcgtgttcctgctgaccacctggtacgtgagctggatcctgttcaagatctacgccaccgaggcccacgtgttccccgtgcagccccccttcgccgagggcagcgacgagtgcctgcccaaggtgctgaacagcaaccccccccccatcatcaagtacctggccctgcaggacctgatgctgctgagccagtacagccccagcagaagacaggaggtgttcagcctgagccagcccggcggccacccccacaactggaccgccatcagcagagagtgcctgaacctgctgaacggcatgacccagaagctgatcctgtaccaggaggccgccgccaccaacggcagagtgagcagcagctaccccgtggagcccaagaagctgaacagccccgaggagaccgccttccagacccccaagagcagccagatgcccagacccagcgtgccccccctggtgaagaccagcctgttcagcagcaagctgagcacccccgacgtggtgagccccttcggcacccccttcggcagcagcgtgatgaacagaatggccggcatcttcgacgtgaacacctgctacggcagcccccagagcccccagctgatcagaagaggccccagactgtggaccagcgccagcgaccagcagatgaccgagttcagcaaccccagccccagcaccagcatcagcgccgagggcaagaccatgagacagcccagcgtgatctacagctggatccagaacaagagagagcagatcaagaacttcctgagcaagagagtgctgatcatgtacttcttcagcaagcaccccgaggccagcatccaggccgtgttcagcgacgcccagatgcacatctgggccctggagggcctgagccacctggtggccgccagcttcaccgaggacagattcggcgtggtgcagaccaccctgcccgccatcctgaacaccctgctgaccctgcaggaggccgtggacaagtacttcaagctgccccacgccagcagcaagccccccagaatcagcggcagcctggtggacaccagctacaagaccctgagattcgccttcagagccagcctgaagaccgccatctacagaatcaccaccaccttcggcgagcacctgaacgccgtgcaggccagcgccgagcaccagaagagactgcagcagttcctggagttcaaggagtag

SEQ ID NO: 103248 - DNA, 1020 bp, Artificial Sequence
  Description of Artificial Sequence: Synthetic coding sequence
atgctgctgagccagtacagccccagcagaagacaggaggtgttcagcctgagccagcccggcggccacccccacaactggaccgccatcagcagagagtgcctgaacctgctgaacggcatgacccagaagctgatcctgtaccaggaggccgccgccaccaacggcagagtgagcagcagctaccccgtggagcccaagaagctgaacagccccgaggagaccgccttccagacccccaagagcagccagatgcccagacccagcgtgccccccctggtgaagaccagcctgttcagcagcaagctgagcacccccgacgtggtgagccccttcggcacccccttcggcagcagcgtgatgaacagaatggccggcatcttcgacgtgaacacctgctacggcagcccccagagcccccagctgatcagaagaggccccagactgtggaccagcgccagcgaccagcagatgaccgagttcagcaaccccagccccagcaccagcatcagcgccgagggcaagaccatgagacagcccagcgtgatctacagctggatccagaacaagagagagcagatcaagaacttcctgagcaagagagtgctgatcatgtacttcttcagcaagcaccccgaggccagcatccaggccgtgttcagcgacgcccagatgcacatctgggccctggagggcctgagccacctggtggccgccagcttcaccgaggacagattcggcgtggtgcagaccaccctgcccgccatcctgaacaccctgctgaccctgcaggaggccgtggacaagtacttcaagctgccccacgccagcagcaagccccccagaatcagcggcagcctggtggacaccagctacaagaccctgagattcgccttcagagccagcctgaagaccgccatctacagaatcaccaccaccttcggcgagcacctgaacgccgtgcaggccagcgccgagcaccagaagagactgcagcagttcctggagttcaaggagtag

SEQ ID NO: 103249 - DNA, 1629 bp, Artificial Sequence
  Description of Artificial Sequence: Synthetic coding sequence
atggccaccgccgtgagcagaccctgcgccggcagaagcagagacatcctgtggagagtgctgggctggagaatcgtggccagcatcgtgtggagcgtgctgttcctgcccatctgcaccaccgtgttcatcatcttcagcagaatcgacctgttccaccccatccagtggctgagcgacagcttcagcgacctgtacagcagctacgtgatcttctacttcctgctgctgagcgtggtgatcatcatcatcagcatcttcaacgtggagttctacgccgtggtgcccagcatcccctgcagcagactggccctgatcggcaagatcatccacccccagcagctgatgcacagcttcatccacgccgccatgggcatggtgatggcctggtgcgccgccgtgatcacccagggccagtacagcttcctggtggtgccctgcaccggcaccaacagcttcggcagccccgccgcccagacctgcctgaacgagtaccacctgttcttcctgctgaccggcgccttcatgggctacagctacagcctgctgtacttcgtgaacaacatgaactacctgcccttccccatcatccagcagtacaagttcctgagattcagaagaagcctgctgctgctggtgaagcacagctgcgtggagagcctgttcctggtgagaaacttctgcatcctgtactacttcctgggctacatccccaaggcctggatcagcaccgccatgaacctgcacatcgacgagcaggtgcacagacccctggacaccgtgagcggcctgctgaacctgagcctgctgtaccacgtgtggctgtgcggcgtgttcctgctgaccacctggtacgtgagctggatcctgttcaagatctacgccaccgaggcccacgtgttccccgtgcagccccccttcgccgagggcagcgacgagtgcctgcccaaggtgctgaacagcaaccccccccccatcatcaagtacctggccctgcaggacctgatgctgctgagccagtacagccccagcagaagacaggaggtgttcagcctgagccagcccggcggccacccccacaactggaccgccatcagcagagagtgcctgaacctgctgaacggcatgacccagaagctgatcctgtaccaggaggccgccgccaccaacggcagagtgagcagcagctaccccgtggagcccaagaagctgaacagccccgaggagaccgccttccagacccccaagagcagccagatgcccagacccagcgtgccccccctggtgaagaccagcctgttcagcagcaagctgagcacccccgacgtggtgagccccttcggcacccccttcggcagcagcgtgatgaacagaatggccggcatcttcgacgtgaacacctgctacggcagcccccagagcccccagctgatcagaagaggccccagactgtggaccagcgccagcgaccagcagatgaccgagttcagcaaccccagccccagcaccagcatcagcgccgaggcccccagaggcctgcacagcggctgcttcttcagatgccccaacgcctacctgggcatcagaagaagcgtggccctgagcagcagcatcatctacagaggctag

SEQ ID NO: 103250 - DNA, 1332 bp, Artificial Sequence
  Description of Artificial Sequence: Synthetic coding sequence
atgagactgaccagaaagagactgtgcagcttcctgatcgccctgtactgcctgttcagcctgtacgccgcctaccacgtgttcttcggcagaagaagacaggcccccgccggcagccccagaggcctgagaaagggcgccgcccccgccagagagagaagaggcagagagcagagcaccctggagagcgaggagtggaacccctgggagggcgacgagaagaacgagcagcagcacagattcaagaccagcctgcagatcctggacaagagcaccaagggcaagaccgacctgagcgtgcagatctggggcaaggccgccatcggcctgtacctgtgggagcacatcttcgagggcctgctggaccccagcgacgtgaccgcccagtggagagagggcaagagcatcgtgggcagaacccagtacagcttcatcaccggccccgccgtgatccccggctacttcagcgtggacgtgaacaacgtggtgctgatcctgaacggcagagagaaggccaagatcttctacgccacccagtggctgctgtacgcccagaacctggtgcagatccagaagctgcagcacctggccgtggtgctgctgggcaacgagcactgcgacaacgagtggatcaaccccttcctgaagagaaacggcggcttcgtggagctgctgttcatcatctacgacagcccctggatcaacgacgtggacgtgttccagtggcccctgggcgtggccacctacagaaacttccccgtggtggaggccagctggagcatgctgcacgacgagagaccctacctgtgcaacttcctgggcaccatctacgagaacagcagcagacaggccctgatgaacatcctgaagaaggacggcaacgacaagctgtgctgggtgagcgccagagagcactggcagccccaggagaccaacgagagcctgaagaactaccaggacgccctgctgcagagcgacctgaccctgtgccccgtgggcgtgaacaccgagtgctacagaatctacgaggcctgcagctacggcagcatccccgtggtggaggacgtgatgaccgccggcaactgcggcaacaccagcgtgcaccacggcgcccccctgcagctgctgaagagcatgggcgcccccttcatcttcatcaagaactggaaggagctgcccgccgtgctggagaaggagaagaccatcatcctgcaggagaagatcgagagaagaaagatgctgctgcagtggtaccagcacttcaagaccgagctgaagatgaagttcaccaacatcctggagagcagcttcctgatgaacaacaagagctag

SEQ ID NO: 103251 - DNA, 774 bp, Artificial Sequence
  Description of Artificial Sequence: Synthetic coding sequence
atggccgccgacggcgtggacgagagaagccccctgctgagcgccagccacagcggcaacgtgacccccaccgcccccccctacctgcaggagagcagccccagagccgagctgccccccccctacaccgccatcgccagccccgacgccagcggcatccccgtgatcaactgcagagtgtgccagagcctgatcaacctggacggcaagctgcaccagcacgtggtgaagtgcaccgtgtgcaacgaggccacccccatcaagaacccccccaccggcaagaagtacgtgagatgcccctgcaactgcctgctgatctgcaaggacaccagcagaagaatcggctgccccagacccaactgcagaagaatcatcaacctgggccccgtgatgctgatcagcgaggagcagcccgcccagcccgccctgcccatccagcccgagggcaccagagtggtgtgcggccactgcggcaacaccttcctgtggatggagctgagattcaacaccctggccaagtgcccccactgcaagaagatcagcagcgtgggcagcgccctgcccagaagaagatgctgcgcctacatcaccatcggcatgatctgcatcttcatcggcgtgggcctgaccgtgggcacccccgacttcgccagaagattcagagccacctacgtgagctgggccatcgcctacctgctgggcctgatctgcctgatcagagcctgctactggggcgccatcagagtgagctaccccgagcacagcttcgcctag

SEQ ID NO: 103252 - DNA, 2745 bp, Artificial Sequence
  Description of Artificial Sequence: Synthetic coding sequence
atgagcctgagccactggccctacttcagactggtgctgaacttcagaccccaggtgatctgcctgccccagccccccaaggtgctgggctacagactggagcccccccacctgaccctggcctgcaccctggagggcatgtacaacatcatcgaggagatcctggagagagacatcaacggcaccctgctgagccaggccacctgcgagctgtgcgacggcaacgagaacagcttcatggtggtgaacgccctgggcgacagatgcgtgagatgcgagcccaccttcgtgaacaccagcagaagctgcgcctgcagcgagcccaacatcctgaccggcggcctgtgcttcagcagcaccggcaacttccccctgagaagaatcagcgccgccagatacggcgaggtgggcatgagcctgaccagcgagtggttcgccaagtacctgcagagcagcgccgccgcctgctgggtgtacgccaacctgaccagctgccaggccctgggcaacatgtgcgtgatgaacatgaacagctacgacttcgccaccttcgacgcctgcggcctgttccagttcatcttcgagaacaccgccggcctgagcaccgtgcacagcatcagcttctggagacagaacctgccctggctgttctacggcgaccagctgggcctggccccccaggtgctgagcagcaccagcctgcccaccaacttcagcttcaagggcgagaaccagaacaccaagctgaagttcgtggccgccagctacgacatcagaggcaacttcctgaagtggcagaccctggagggcggcgtgctgcagctgtgccccgacaccgagaccagactgaacgccgcctacagcttcggcaccacctaccagcagaactgcgagatccccatcagcaagatcctgatcgacttccccacccccatcttctacgacgtgtacctggagtacaccgacgagaaccagcaccagtacatcctggccgtgcccgtgctgaacctgaacctgcagcacaacaagatcttcgtgaaccaggacagcaacagcggcaagtggctgctgaccagaagaatcttcctggtggacgccgtgagcggcagagagaacgacctgggcacccagcccagagtgatcagagtggccacccagatcagcctgagcgtgcacctggtgcccaacaccatcaacggcaacatctacccccccctgatcaccatcgcctacagcgacatcgacatcaaggacgccaacagccagagcgtgaaggtgagcttcagcgtgacctacgagatggaccacggcgaggcccacgtgcagaccgacatcgccctgggcgtgctgggcggcctggccgtgctggccagcctgctgaagaccgccggctggaagagaagaatcggcagccccatgatcgacctgcagaccgtggtgaagttcctggtgtactacgccggcgacctggccaacgtgttcttcatcatcaccgtgggcaccggcctgtactggctgatcttcttcaaggcccagaagagcgtgagcgtgctgctgcccatgcccatccaggaggagagattcgtgacctacgtgggctgcgccttcgccctgaaggccctgcagttcctgcacaagctgatcagccagatcaccatcgacgtgttcttcatcgactgggagagacccaagggcaaggtgctgaaggccgtggagggcgagggcggcgtgagaagcgccaccgtgcccgtgagcatctggagaacctacttcgtggccaacgagtggaacgagatccagaccgtgagaaagatcaacagcctgttccaggtgctgaccgtgctgttcttcctggaggtggtgggcttcaagaacctggccctgatggacagcagcagcagcctgagcagaaacccccccagctacatcgccccctacagctgcatcctgagatacgccgtgagcgccgccctgtggctggccatcggcatcatccaggtggtgttcttcgccgtgttctacgagagattcatcgaggacaagatcagacagttcgtggacctgtgcagcatgagcaacatcagcgtgttcctgctgagccacaagtgcttcggctactacatccacggcagaagcgtgcacggccacgccgacaccaacatggaggagatgaacatgaacctgaagagagaggccgagaacctgtgcagccagagaggcctggtgcccaacaccgacggccagaccttcgagatcgccatcagcaaccagatgagacagcactacgacagaatccacgagaccctgatcagaaagaacggccccgccagactgctgagcagcagcgccagcaccttcgagcagagcatcaaggcctaccacatgatgaacaagttcctgggcagcttcatcgaccacgtgcacaaggagatggactacttcatcaaggacaagctgctgctggagagaatcctgggcatggagttcatggagcccatggagaagagcatcttctacaacgacgagggctacagcttcagcagcgtgctgtactacggcaacgaggccaccctgctgatcttcgacctgctgttcttctgcgtggtggacctggcctgccagaacttcatcctggccagcttcctgacctacctgcagcaggagatcttcagatacatcagaaacaccgtgggccagaagaacctggccagcaagaccctggtggaccagagattcctgatctag

SEQ ID NO: 103253 - DNA, 2988 bp, Artificial Sequence
  Description of Artificial Sequence: Synthetic coding sequence
atggccaccagaggcggcgccggcgtggccatggccgtgtggagcctgctgagcgccagagccgtgaccgccttcctgctgctgttcctgcccagattcctgcaggcccagaccttcagcttccccttccagcagcccgagaagtgcgacaacaaccagtacttcgacatcagcgccctgagctgcgtgccctgcggcgccaaccagagacaggacgccagaggcaccagctgcgtgtgcctgcccggcttccagatgatcagcaacaacggcggccccgccatcatctgcaagaagtgccccgagaacatgaagggcgtgaccgaggacggctggaactgcatcagctgccccagcgacctgaccgccgagggcaagtgccactgccccatcggccacatcctggtggagagagacatcaacggcaccctgctgagccaggccacctgcgagctgtgcgacggcaacgagaacagcttcatggtggtgaacgccctgggcgacagatgcgtgagatgcgagcccaccttcgtgaacaccagcagaagctgcgcctgcagcgagcccaacatcctgaccggcggcctgtgcttcagcagcaccggcaacttccccctgagaagaatcagcgccgccagatacggcgaggtgggcatgagcctgaccagcgagtggttcgccaagtacctgcagagcagcgccgccgcctgctgggtgtacgccaacctgaccagctgccaggccctgggcaacatgtgcgtgatgaacatgaacagctacgacttcgccaccttcgacgcctgcggcctgttccagttcatcttcgagaacaccgccggcctgagcaccgtgcacagcatcagcttctggagacagaacctgccctggctgttctacggcgaccagctgggcctggccccccaggtgctgagcagcaccagcctgcccaccaacttcagcttcaagggcgagaaccagaacaccaagctgaagttcgtggccgccagctacgacatcagaggcaacttcctgaagtggcagaccctggagggcggcgtgctgcagctgtgccccgacaccgagaccagactgaacgccgcctacagcttcggcaccacctaccagcagaactgcgagatccccatcagcaagatcctgatcgacttccccacccccatcttctacgacgtgtacctggagtacaccgacgagaaccagcaccagtacatcctggccgtgcccgtgctgaacctgaacctgcagcacaacaagatcttcgtgaaccaggacagcaacagcggcaagtggctgctgaccagaagaatcttcctggtggacgccgtgagcggcagagagaacgacctgggcacccagcccagagtgatcagagtggccacccagatcagcctgagcgtgcacctggtgcccaacaccatcaacggcaacatctacccccccctgatcaccatcgcctacagcgacatcgacatcaaggacgccaacagccagagcgtgaaggtgagcttcagcgtgacctacgagatggaccacggcgaggcccacgtgcagaccgacatcgccctgggcgtgctgggcggcctggccgtgctggccagcctgctgaagaccgccggctggaagagaagaatcggcagccccatgatcgacctgcagaccgtggtgaagttcctggtgtactacgccggcgacctggccaacgtgttcttcatcatcaccgtgggcaccggcctgtactggctgatcttcttcaaggcccagaagagcgtgagcgtgctgctgcccatgcccatccaggaggagagattcgtgacctacgtgggctgcgccttcgccctgaaggccctgcagttcctgcacaagctgatcagccagatcaccatcgacgtgttcttcatcgactgggagagacccaagggcaaggtgctgaaggccgtggagggcgagggcggcgtgagaagcgccaccgtgcccgtgagcatctggagaacctacttcgtggccaacgagtggaacgagatccagaccgtgagaaagatcaacagcctgttccaggtgctgaccgtgctgttcttcctggaggtggtgggcttcaagaacctggccctgatggacagcagcagcagcctgagcagaaacccccccagctacatcgccccctacagctgcatcctgagatacgccgtgagcgccgccctgtggctggccatcggcatcatccaggtggtgttcttcgccgtgttctacgagagattcatcgaggacaagatcagacagttcgtggacctgtgcagcatgagcaacatcagcgtgttcctgctgagccacaagtgcttcggctactacatccacggcagaagcgtgcacggccacgccgacaccaacatggaggagatgaacatgaacctgaagagagaggccgagaacctgtgcagccagagaggcctggtgcccaacaccgacggccagaccttcgagatcgccatcagcaaccagatgagacagcactacgacagaatccacgagaccctgatcagaaagaacggccccgccagactgctgagcagcagcgccagcaccttcgagcagagcatcaaggcctaccacatgatgaacaagttcctgggcagcttcatcgaccacgtgcacaaggagatggactacttcatcaaggacaagctgctgctggagagaatcctgggcatggagttcatggagcccatggagaagagcatcttctacaacgacgagggctacagcttcagcagcgtgctgtactacggcaacgaggccaccctgctgatcttcgacctgctgttcttctgcgtggtggacctggcctgccagaacttcatcctggccagcttcctgacctacctgcagcaggagatcttcagatacatcagaaacaccgtgggccagaagaacctggccagcaagaccctggtggaccagagattcctgatctag

SEQ ID NO: 103254 - DNA, 783 bp, Artificial Sequence
  Description of Artificial Sequence: Synthetic coding sequence
atgctgttcctggccctgggcagcccctgggccgtggagctgcccctgtgcggcagaagaaccgccctgtgcgccgccgccgccctgagaggccccagagccagcgtgagcagagccagcagcagcagcggccccagcggccccgtggccggctggagcaccggccccagcggcgccgccagactgctgagaagacccggcagagcccagatccccgtgtactgggagggctacgtgagattcctgaacacccccagcgacaagagcgaggacggcagactgatctacaccggcaacatggccagagccgtgttcggcgtgaagtgcttcagctacagcaccagcctgatcggcctgaccttcctgccctacatcttcacccagaacaacgccatcagcgagagcgtgcccctgcccatccagatcatcttctacggcatcatgggcagcttcaccgtgatcacccccgtgctgctgcacttcatcaccaagggctacgtgatcagactgtaccacgaggccaccaccgacacctacaaggccatcacctacaacgccatgctggccgagaccagcaccgtgttccaccagaacgacgtgaagatccccgacgccaagcacgtgttcaccaccttctacgccaagaccaagagcctgctggtgaaccccgtgctgttccccaacagagaggactacatccacctgatgggctacgacaaggaggagttcatcctgtacatggaggagaccagcgaggagaagagacacaaggacgacaagtag

SEQ ID NO: 103255 - DNA, 324 bp, Artificial Sequence
  Description of Artificial Sequence: Synthetic coding sequence
atgctgttcctggccctgggcagcccctgggccgtggagctgcccctgtgcggcagaagaaccgccctgtgcgccgccgccgccctgagaggccccagagccagcgtgagcagagccagcagcagcagcggccccagcggccccgtggccggctggagcaccggccccagcggcgccgccagactgctgagaagacccggcagagcccagatccccgtgtactgggagggctacgtgagattcctgaacacccccagcgacaagagcgaggacggcagactgatctacaccggcaacatggccagagccgtgttcggcaagtag

SEQ ID NO: 103256 - DNA, 918 bp, Artificial Sequence
  Description of Artificial Sequence: Synthetic coding sequence
atggagctgcactacctggccaagaagagcaaccaggccgacctgtgcgacgccagagactggagcagcagaggcctgcccggcgaccaggccgacaccgccgccaccagagccgccctgtgctgccagaagcagtgcgccagcacccccagagccaccgagatggagggcagcaagctgagcagcagccccgccagccccagcagcagcctgcagaacagcaccctgcagcccgacgccttcccccccggcctgctgcacagcggcaacaaccagatcaccgccgagagaaaggtgtgcaactgctgcagccaggagctggagaccagcttcacctacgtggacaagaacatcaacctggagcagagaaacagaagcagccccagcgccaagggccacaaccaccccggcgagctgggctgggagaaccccaacgagtggagccaggaggccgccatcagcctgatcagcgaggaggaggacgacaccagcagcgaggccaccagcagcggcaagagcatcgactacggcttcatcagcgccatcctgttcctggtgaccggcatcctgctggtgatcatcagctacatcgtgcccagagaggtgaccgtggaccccaacaccgtggccgccagagagatggagagactggagaaggagagcgccagactgggcgcccacctggacagatgcgtgatcgccggcctgtgcctgctgaccctgggcggcgtgatcctgagctgcctgctgatgatgagcatgtggaagggcgagctgtacagaagaaacagattcgccagcagcaaggagagcgccaagctgtacggcagcttcaacttcagaatgaagaccagcaccaacgagaacaccctggagctgagcctggtggaggaggacgccctggccgtgcagagctag

SEQ ID NO: 103257 - DNA, 951 bp, Artificial Sequence
  Description of Artificial Sequence: Synthetic coding sequence
atgagcggcgacacctgcctgtgccccgccagcggcgccaagcccaagctgagcggcttcaagggcggcggcctgggcaacaagtacgtgcagctgaacgtgggcggcagcctgtactacaccaccgtgagagccctgaccagacacgacaccatgctgaaggccatgttcagcggcagaatggaggtgctgaccgacaaggagggctggatcctgatcgacagatgcggcaagcacttcggcaccatcctgaactacctgagagacgacaccatcaccctgccccagaacagacaggagatcaaggagctgatggccgaggccaagtactacctgatccagggcctggtgaacatgtgccagagcgccctgcaggacaagaaggacagctaccagcccgtgtgcaacatccccatcatcaccagcctgaaggaggaggagagactgatcgagagcagcaccaagcccgtggtgaagctgctgtacaacagaagcaacaacaagtacagctacaccagcaacagcgacgaccacctgctgaagaacatcgagctgttcgacaagctgagcctgagattcaacggcagagtgctgttcatcaaggacgtgatcggcgacgagatctgctgctggagcttctacggccagggcagaaagctggccgaggtgtgctgcaccagcatcgtgtacgccaccgagaagaagcagaccaaggtggagttccccgaggccagaatctacgaggagaccctgaacgtgctgctgtacgagacccccagagtgcccgacaacagcctgctggaggccaccagcagaagcagaagccaggccagccccagcgaggacgaggagaccttcgagctgagagacagagtgagaagaatccacgtgaagagatacagcacctacgacgacagacagctgggccaccagagcacccacagagactag

SEQ ID NO: 103258 - DNA, 210 bp, Artificial Sequence
  Description of Artificial Sequence: Synthetic coding sequence
atgaccaccctgatccccatcctgagcaccttcctgttcgaggacttcagcaaggccagcggcttcaagggccagagacccgagaccctgcacgagagactgaccctggtgagcgtgtacgccccctacctgctgatccccttcatcctgctgatcttcatgctgagaagcccctactacaagtacgaggagaagagaaagaagaagtag

SEQ ID NO: 103259 - DNA, 1125 bp, Artificial Sequence
  Description of Artificial Sequence: Synthetic coding sequence
atggtgctgtgggagagccccagacagtgcagcagctggaccctgtgcgagggcttctgctggctgctgctgctgcccgtgatgctgctgatcgtggccagacccgtgaagctggccgccttccccaccagcctgagcgactgccagacccccaccggctggaactgcagcggctacgacgacagagagaacgacctgttcctgtgcgacaccaacacctgcaagttcgacggcgagtgcctgagaatcggcgacaccgtgacctgcgtgtgccagttcaagtgcaacaacgactacgtgcccgtgtgcggcagcaacggcgagagctaccagaacgagtgctacctgagacaggccgcctgcaagcagcagagcgagatcctggtggtgagcgagggcagctgcgccaccgacgccggcagcggcagcggcgacggcgtgcacgagggcagcggcgagaccagccagaaggagaccagcacctgcgacatctgccagttcggcgccgagtgcgacgaggacgccgaggacgtgtggtgcgtgtgcaacatcgactgcagccagaccaacttcaaccccctgtgcgccagcgacggcaagagctacgacaacgcctgccagatcaaggaggccagctgccagaagcaggagaagatcgaggtgatgagcctgggcagatgccaggacaacaccaccaccaccaccaagagcgaggacggccactacgccagaaccgactacgccgagaacgccaacaagctggaggagagcgccagagagcaccacatcccctgccccgagcactacaacggcttctgcatgcacggcaagtgcgagcacagcatcaacatgcaggagcccagctgcagatgcgacgccggctacaccggccagcactgcgagaagaaggactacagcgtgctgtacgtggtgcccggccccgtgagattccagtacgtgctgatcgccgccgtgatcggcaccatccagatcgccgtgatctgcgtggtggtgctgtgcatcaccagaaagtgccccagaagcaacagaatccacagacagaagcagaacaccggccactacagcagcgacaacaccaccagagccagcaccagactgatctag

SEQ ID NO: 103260 - DNA, 528 bp, Artificial Sequence
  Description of Artificial Sequence: Synthetic coding sequence
atggtgctgtgggagagccccagacagtgcagcagctggaccctgtgcgagggcttctgctggctgctgctgctgcccgtgatgctgctgatcgtggccagacccgtgaagctggccgccttccccaccagcctgagcgactgccagacccccaccggctggaactgcagcggctacgacgacagagagaacgacctgttcctgtgcgacaccaacacctgcaagttcgacggcgagtgcctgagaatcggcgacaccgtgacctgcgtgtgccagttcaagtgcaacaacgactacgtgcccgtgtgcggcagcaacggcgagagctaccagaacgagtgctacctgagacaggccgcctgcaagcagcagagcgagatcctggtggtgagcgagggcagctgcgccaccgacgccggcagcggcagcggcgacggcggcagaagctgcctgttcacctacctgaagatctactggtggatcctgctgtgcatcttcacctacgtgtgcagcatcagcgacatctag

SEQ ID NO: 103261 - DNA, 2427 bp, Artificial Sequence
  Description of Artificial Sequence: Synthetic coding sequence
atggccgagctgctggccagcgccggcagcgcctgcagctgggacttccccagagccccccccagcttccccccccccgccgccagcagaggcggcctgggcggcaccagaagcttcagaccccacagaggcgccgagagccccagacccggcagagacagagacggcgtgagagtgcccatggccagcagcagatgccccgcccccagaggctgcagatgcctgcccggcgccagcctggcctggctgggcaccgtgctgctgctgctggccgactgggtgctgctgagaaccgccctgcccagaatcttcagcctgctggtgcccaccgccctgcccctgctgagagtgtgggccgtgggcctgagcagatgggccgtgctgtggctgggcgcctgcggcgtgctgagagccaccgtgggcagcaagagcgagaacgccggcgcccagggctggctggccgccctgaagcccctggccgccgccctgggcctggccctgcccggcctggccctgttcagagagctgatcagctggggcgcccccggcagcgccgacagcaccagactgctgcactggggcagccaccccaccgccttcgtggtgagctacgccgccgccctgcccgccgccgccctgtggcacaagctgggcagcctgtgggtgcccggcggccagggcggcagcggcaaccccgtgagaagactgctgggctgcctgggcagcgagaccagaagactgagcctgttcctggtgctggtggtgctgagcagcctgggcgagatggccatccccttcttcaccggcagactgaccgactggatcctgcaggacggcagcgccgacaccttcaccagaaacctgaccctgatgagcatcctgaccatcgccagcgccgtgctggagttcgtgggcgacggcatctacaacaacaccatgggccacgtgcacagccacctgcagggcgaggtgttcggcgccgtgctgagacaggagaccgagttcttccagcagaaccagaccggcaacatcatgagcagagtgaccgaggacaccagcaccctgagcgacagcctgagcgagaacctgagcctgttcctgtggtacctggtgagaggcctgtgcctgctgggcatcatgctgtggggcagcgtgagcctgaccatggtgaccctgatcaccctgcccctgctgttcctgctgcccaagaaggtgggcaagtggtaccagctgctggaggtgcaggtgagagagagcctggccaagagcagccaggtggccatcgaggccctgagcgccatgcccaccgtgagaagcttcgccaacgaggagggcgaggcccagaagttcagagagaagctgcaggagatcaagaccctgaaccagaaggaggccgtggcctacgccgtgaacagctggaccaccagcatcagcggcatgctgctgaaggtgggcatcctgtacatcggcggccagctggtgaccagcggcgccgtgagcagcggcaacctggtgaccttcgtgctgtaccagatgcagttcacccaggccgtggaggtgctgctgagcatctaccccagagtgcagaaggccgtgggcagcagcgagaagatcttcgagtacctggacagaacccccagatgcccccccagcggcctgctgacccccctgcacctggagggcctggtgcagttccaggacgtgagcttcgcctaccccaacagacccgacgtgctggtgctgcagggcctgaccttcaccctgagacccggcgaggtgaccgccctggtgggccccaacggcagcggcaagagcaccgtggccgccctgctgcagaacctgtaccagcccaccggcggccagctgctgctggacggcaagcccctgccccagtacgagcacagatacctgcacagacaggtggccgccgtgggccaggagccccaggtgttcggcagaagcctgcaggagaacatcgcctacggcctgacccagaagcccaccatggaggagatcaccgccgccgccgtgaagagcggcgcccacagcttcatcagcggcctgccccagggctacgacaccgaggtggacgaggccggcagccagctgagcggcggccagagacaggccgtggccctggccagagccctgatcagaaagccctgcgtgctgatcctggacgacgccaccagcgccctggacgccaacagccagctgcaggtggagcagctgctgtacgagagccccgagagatacagcagaagcgtgctgctgatcacccagcacctgagcctggtggagcaggccgaccacatcctgttcctggagggcggcgccatcagagagggcggcacccaccagcagctgatggagaagaagggctgctactgggccatggtgcaggcccccgccgacgcccccgagtag

SEQ ID NO: 103262 - DNA, 2427 bp, Artificial Sequence; identical to SEQ ID NO: 103261
  Description of Artificial Sequence: Synthetic coding sequence

SEQ ID NO: 103263 - DNA, 2427 bp, Artificial Sequence; identical to SEQ ID NO: 103261
  Description of Artificial Sequence: Synthetic coding sequence

SEQ ID NO: 103264 - DNA, 2427 bp, Artificial Sequence; identical to SEQ ID NO: 103261
  Description of Artificial Sequence: Synthetic coding sequence

SEQ ID NO: 103265 - DNA, 2427 bp, Artificial Sequence; identical to SEQ ID NO: 103261
  Description of Artificial Sequence: Synthetic coding sequence

SEQ ID NO: 103266 - DNA, 1644 bp, Artificial Sequence
  Description of Artificial Sequence: Synthetic coding sequence
atggccatccccttcttcaccggcagactgaccgactggatcctgcaggacggcagcgccgacaccttcaccagaaacctgaccctgatgagcatcctgaccatcgccagcgccgtgctggagttcgtgggcgacggcatctacaacaacaccatgggccacgtgcacagccacctgcagggcgaggtgttcggcgccgtgctgagacaggagaccgagttcttccagcagaaccagaccggcaacatcatgagcagagtgaccgaggacaccagcaccctgagcgacagcctgagcgagaacctgagcctgttcctgtggtacctggtgagaggcctgtgcctgctgggcatcatgctgtggggcagcgtgagcctgaccatggtgaccctgatcaccctgcccctgctgttcctgctgcccaagaaggtgggcaagtggtaccagctgctggaggtgcaggtgagagagagcctggccaagagcagccaggtggccatcgaggccctgagcgccatgcccaccgtgagaagcttcgccaacgaggagggcgaggcccagaagttcagagagaagctgcaggagatcaagaccctgaaccagaaggaggccgtggcctacgccgtgaacagctggaccaccagcatcagcggcatgctgctgaaggtgggcatcctgtacatcggcggccagctggtgaccagcggcgccgtgagcagcggcaacctggtgaccttcgtgctgtaccagatgcagttcacccaggccgtggaggtgctgctgagcatctaccccagagtgcagaaggccgtgggcagcagcgagaagatcttcgagtacctggacagaacccccagatgcccccccagcggcctgctgacccccctgcacctggagggcctggtgcagttccaggacgtgagcttcgcctaccccaacagacccgacgtgctggtgctgcagggcctgaccttcaccctgagacccggcgaggtgaccgccctggtgggccccaacggcagcggcaagagcaccgtggccgccctgctgcagaacctgtaccagcccaccggcggccagctgctgctggacggcaagcccctgccccagtacgagcacagatacctgcacagacaggtggccgccgtgggccaggagccccaggtgttcggcagaagcctgcaggagaacatcgcctacggcctgacccagaagcccaccatggaggagatcaccgccgccgccgtgaagagcggcgcccacagcttcatcagcggcctgccccagggctacgacaccgaggtggacgaggccggcagccagctgagcggcggccagagacaggccgtggccctggccagagccctgatcagaaagccctgcgtgctgatcctggacgacgccaccagcgccctggacgccaacagccagctgcaggtggagcagctgctgtacgagagccccgagagatacagcagaagcgtgctgctgatcacccagcacctgagcctggtggagcaggccgaccacatcctgttcctggagggcggcgccatcagagagggcggcacccaccagcagctgatggagaagaagggctgctactgggccatggtgcaggcccccgccgacgcccccgagtag

SEQ ID NO: 103267 - DNA, 2427 bp, Artificial Sequence
  Description of Artificial Sequence: Synthetic coding sequence
atggccgagctgctggccagcgccggcagcgcctgcagctgggacttccccagagccccccccagcttccccccccccgccgccagcagaggcggcctgggcggcaccagaagcttcagaccccacagaggcgccgagagccccagacccggcagagacagagacggcgtgagagtgcccatggccagcagcagatgccccgcccccagaggctgcagatgcctgcccggcgccagcctggcctggctgggcaccgtgctgctgctgctggccgactgggtgctgctgagaaccgccctgcccagaatcttcagcctgctggtgcccaccgccctgcccctgctgagagtgtgggccgtgggcctgagcagatgggccgtgctgtggctgggcgcctgcggcgtgctgagagccaccggcggcagcaagagcgagaacgccggcgcccagggctggctggccgccctgaagcccctggccgccgccctgggcctggccctgcccggcctggccctgttcagagagctgatcagctggggcgcccccggcagcgccgacagcaccagactgctgcactggggcagccaccccaccgccttcgtggtgagctacgccgccgccctgcccgccgccgccctgtggcacaagctgggcagcctgtgggtgcccggcggccagggcggcagcggcaaccccgtgagaagactgctgggctgcctgggcagcgagaccagaagactgagcctgttcctggtgctggtggtgctgagcagcctgggcgagatggccatccccttcttcaccggcagactgaccgactggatcctgcaggacggcagcgccgacaccttcaccagaaacctgaccctgatgagcatcctgaccatcgccagcgccgtgctggagttcgtgggcgacggcatctacaacaacaccatgggccacgtgcacagccacctgcagggcgaggtgttcggcgccgtgctgagacaggagaccgagttcttccagcagaaccagaccggcaacatcatgagcagagtgaccgaggacaccagcaccctgagcgacagcctgagcgagaacctgagcctgttcctgtggtacctggtgagaggcctgtgcctgctgggcatcatgctgtggggcagcgtgagcctgaccatggtgaccctgatcaccctgcccctgctgttcctgctgcccaagaaggtgggcaagtggtaccagctgctggaggtgcaggtgagagagagcctggccaagagcagccaggtggccatcgaggccctgagcgccatgcccaccgtgagaagcttcgccaacgaggagggcgaggcccagaagttcagagagaagctgcaggagatcaagaccctgaaccagaaggaggccgtggcctacgccgtgaacagctggaccaccagcatcagcggcatgctgctgaaggtgggcatcctgtacatcggcggccagctggtgaccagcggcgccgtgagcagcggcaacctggtgaccttcgtgctgtaccagatgcagttcacccaggccgtggaggtgctgctgagcatctaccccagagtgcagaaggccgtgggcagcagcgagaagatcttcgagtacctggacagaacccccagatgcccccccagcggcctgctgacccccctgcacctggagggcctggtgcagttccaggacgtgagcttcgcctaccccaacagacccgacgtgctggtgctgcagggcctgaccttcaccctgagacccggcgaggtgaccgccctggtgggccccaacggcagcggcaagagcaccgtggccgccctgctgcagaacctgtaccagcccaccggcggccagctgctgctggacggcaagcccctgccccagtacgagcacagatacctgcacagacaggtggccgccgtgggccaggagccccaggtgttcggcagaagcctgcaggagaacatcgcctacggcctgacccagaagcccaccatggaggagatcaccgccgccgccgtgaagagcggcgcccacagcttcatcagcggcctgccccagggctacgacaccgaggtggacgaggccggcagccagctgagcggcggccagagacaggccgtggccctggccagagccctgatcagaaagccctgcgtgctgatcctggacgacgccaccagcgccctggacgccaacagccagctgcaggtggagcagctgctgtacgagagccccgagagatacagcagaagcgtgctgctgatcacccagcacctgagcctggtggagcaggccgaccacatcctgttcctggagggcggcgccatcagagagggcggcacccaccagcagctgatggagaagaagggctgctactgggccatggtgcaggcccccgccgacgcccccgagtag

SEQ ID NO: 103268 - DNA, 2427 bp, Artificial Sequence; identical to SEQ ID NO: 103261
  Description of Artificial Sequence: Synthetic coding sequence

SEQ ID NO: 103269 - DNA, 2427 bp, Artificial Sequence; identical to SEQ ID NO: 103261
  Description of Artificial Sequence: Synthetic coding sequence

SEQ ID NO: 103270 - DNA, 1644 bp, Artificial Sequence; identical to SEQ ID NO: 103266
  Description of Artificial Sequence: Synthetic coding sequence

SEQ ID NO: 103271 - DNA, 1644 bp, Artificial Sequence; identical to SEQ ID NO: 103266
  Description of Artificial Sequence: Synthetic coding sequence

SEQ ID NO: 103272 - DNA, 1644 bp, Artificial Sequence; identical to SEQ ID NO: 103266
  Description of Artificial Sequence: Synthetic coding sequence

SEQ ID NO: 103273 - DNA, 1644 bp, Artificial Sequence; identical to SEQ ID NO: 103266
  Description of Artificial Sequence: Synthetic coding sequence

SEQ ID NO: 103274 - DNA, 1644 bp, Artificial Sequence; identical to SEQ ID NO: 103266
  Description of Artificial Sequence: Synthetic coding sequence

SEQ ID NO: 103275 - DNA, 1644 bp, Artificial Sequence; identical to SEQ ID NO: 103266
  Description of Artificial Sequence: Synthetic coding sequence

SEQ ID NO: 103276 - DNA, 1644 bp, Artificial Sequence; identical to SEQ ID NO: 103266
  Description of Artificial Sequence: Synthetic coding sequence

SEQ ID NO: 103277 - DNA, 2061 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctggtgagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcgcctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccctgcaggactggaacagcagaggcgacagaaccgtgctggtgatcgcccacagactgcagaccgtgcagagagcccaccagatcctggtgctgcaggagggcaagctgcagaagctggcccagctgtag

SEQ ID NO: 103278 - DNA, 1962 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctggtgagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcgcctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccaagaccctgtggaagttcatgatcttctag

SEQ ID NO: 103279 - DNA, 2061 bp, Artificial Sequence; identical to SEQ ID NO: 103277
  Description of Artificial Sequence: Synthetic coding sequence

SEQ ID NO: 103280 - DNA, 1962 bp, Artificial Sequence; identical to SEQ ID NO: 103278
  Description of Artificial Sequence: Synthetic coding sequence

SEQ ID NO: 103281 - DNA, 2061 bp, Artificial Sequence; identical to SEQ ID NO: 103277
  Description of Artificial Sequence: Synthetic coding sequence

SEQ ID NO: 103282 - DNA, 1962 bp, Artificial Sequence; identical to SEQ ID NO: 103278
  Description of Artificial Sequence: Synthetic coding sequence

SEQ ID NO: 103283 - DNA, 1962 bp, Artificial Sequence; identical to SEQ ID NO: 103278
  Description of Artificial Sequence: Synthetic coding sequence

SEQ ID NO: 103284 - DNA, 2061 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctgatcagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcacctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccctgcaggactggaacagcagaggcgacagaaccgtgctggtgatcgcccacagactgcagaccgtgcagagagcccaccagatcctggtgctgcaggagggcaagctgcagaagctggcccagctgtag

SEQ ID NO: 103285 - DNA, 1962 bp, Artificial Sequence; identical to SEQ ID NO: 103278
  Description of Artificial Sequence: Synthetic coding sequence

SEQ ID NO: 103286 - DNA, 1962 bp, Artificial Sequence; identical to SEQ ID NO: 103278
  Description of Artificial Sequence: Synthetic coding sequence

SEQ ID NO: 103287 - DNA, 2061 bp, Artificial Sequence; identical to SEQ ID NO: 103277
  Description of Artificial Sequence: Synthetic coding sequence

SEQ ID NO: 103288 - DNA, 1962 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctgatcagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcacctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccaagaccctgtggaagttcatgatcttctag

SEQ ID NO: 103289 - DNA, 1962 bp, Artificial Sequence; identical to SEQ ID NO: 103278
  Description of Artificial Sequence: Synthetic coding sequence

SEQ ID NO: 103290 - DNA, 2112 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctggtgagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcgcctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccctgcaggactggaacagcagaggcgacagaaccgtgctggtgatcgcccacagactgcaggccgtgcagagagcccaccagatcctggtgctgcaggagggcaagctgcagaagctggcccagctgcaggagggccaggacctgtacagcagactggtgcagcagagactgatggactag

SEQ ID NO: 103291 - DNA, 2112 bp, Artificial Sequence; identical to SEQ ID NO: 103290
  Description of Artificial Sequence: Synthetic coding sequence

SEQ ID NO: 103292 - DNA, 2112 bp, Artificial Sequence; identical to SEQ ID NO: 103290
  Description of Artificial Sequence: Synthetic coding sequence

SEQ ID NO: 103293 - DNA, 2310 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctggtgagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcgcctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccaacggcttctgggtgggccccctgggcggcggcagcgccagcgagagcgaccccaccggcttcctgcacgacagcagacacagactgagcagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggtgcagcccgaggtgaccgtgtaccccgagagaacccccctgctgcaccagcacaacctgctgcactgcagcgtgaccggcttctaccccggcgacatcaagatcaagtggttcctgaacggccagtag

SEQ ID NO: 103294 - DNA, 2310 bp, Artificial Sequence; identical to SEQ ID NO: 103293
  Description of Artificial Sequence: Synthetic coding sequence

SEQ ID NO: 103295 - DNA, 2310 bp, Artificial Sequence; identical to SEQ ID NO: 103293
  Description of Artificial Sequence: Synthetic coding sequence

SEQ ID NO: 103296 - DNA, 2310 bp, Artificial Sequence
  Description of Artificial Sequence: Synthetic coding sequence
atgagactgcccgacctgagaccctggaccagcctgctgctggtggacgccgccctgctgtggctgctgcagggccccctgggcaccctgctgccccagggcctgcccggcctgtggctggagggcaccctgagactgggcggcctgtggggcctgctgaagctgagaggcctgctgggcttcgtgggcaccctgctgctgcccctgtgcctggccacccccctgaccgtgagcctgagagccctggtggccggcgccagcagagccccccccgccagagtggccagcgccccctggagctggctgctggtgggctacggcgccgccggcctgagctggagcctgtgggccgtgctgagcccccccggcgcccaggagaaggagcaggaccaggtgaacaacaaggtgctgatgtggagactgctgaagctgagcagacccgacctgcccctgctggtggccgccttcttcttcctggtgctggccgtgctgggcgagaccctgatcccccactacagcggcagagtgatcgacatcctgggcggcgacttcgacccccacgccttcgccagcgccatcttcttcatgtgcctgttcagcttcggcagcagcctgagcgccggctgcagaggcggctgcttcacctacaccatgagcagaatcaacctgagaatcagagagcagctgttcagcagcctgctgagacaggacctgggcttcttccaggagaccaagaccggcgagctgaacagcagactgagcagcgacaccaccctgatgagcaactggctgcccctgaacgccaacgtgctgctgagaagcctggtgaaggtggtgggcctgtacggcttcatgctgagcatcagccccagactgaccctgctgagcctgctgcacatgcccttcaccatcgccgccgagaaggtgtacaacaccagacaccaggaggtgctgagagagatccaggacgccgtggccagagccggccaggtggtgagagaggccgtgggcggcctgcagaccgtgagaagcttcggcgccgaggagcacgaggtgtgcagatacaaggaggccctggagcagtgcagacagctgtactggagaagagacctggagagagccctgtacctgctgatcagaagagtgctgcacctgggcgtgcagatgctgatgctgagctgcggcctgcagcagatgcaggacggcgagctgacccagggcagcctgctgagcttcatgatctaccaggagagcgtgggcagctacgtgcagaccctggtgtacatctacggcgacatgctgagcaacgtgggcgccgccgagaaggtgttcagctacatggacagacagcccaacctgcccagccccggcaccctggcccccaccaccctgcagggcgtggtgaagttccaggacgtgagcttcgcctaccccaacagacccgacagacccgtgctgaagggcctgaccttcaccctgagacccggcgaggtgaccgccctggtgggccccaacggcagcggcaagagcaccgtggccgccctgctgcagaacctgtaccagcccaccggcggccaggtgctgctggacgagaagcccatcagccagtacgagcactgctacctgcacagccaggtggtgagcgtgggccaggagcccgtgctgttcagcggcagcgtgagaaacaacatcacctacggcctgcagagctgcgaggacgacaaggtgatggccgccgcccaggccgcccacgccgacgacttcatccaggagatggagcacggcatctacaccgacgtgggcgagaagggcagccagctggccgccggccagaagcagagactggccatcgccagagccctggtgagagaccccagagtgctgatcctggacgaggccaccagcgccctggacgtgcagtgcgagcaggccaacggcttctgggtgggccccctgggcggcggcagcgccagcgagagcgaccccaccggcttcctgcacgacagcagacacagactgagcagcgacgtgggcatgttcgtggccctgaccaagctgggccagcccgacgccgagcagtggaacagcagactggacctgctggagagaagcagacaggccgtggacggcgtgtgcagacacaactacagactgggcgcccccttcaccgtgggcagaaaggtgcagcccgaggtgaccgtgtaccccgagagaacccccctgctgcaccagcacaacctgctgcactgcagcgtgaccggcttctaccccggcgacatcaagatcaagtggttcctgaacggccagtag

SEQ ID NO: 103297 - DNA, 2310 bp, Artificial Sequence; identical to SEQ ID NO: 103293
  Description of Artificial Sequence: Synthetic coding sequence

SEQ ID NO: 103298 - DNA, 2310 bp, Artificial Sequence; identical to SEQ ID NO: 103293
  Description of Artificial Sequence: Synthetic coding sequence

SEQ ID NO: 103299 - DNA, 2697 bp, Artificial Sequence
  Description of Artificial Sequence: Synthetic coding sequence
atggtgtgggacagacagaccaagatggagtacgagtggaagcccgacgagcagggcctgcagcagatcctgcagctgctgaaggagagccagagccccgacaccaccatccagagaaccgtgcagcagaagctggagcagctgaaccagtaccccgacttcaacaactacctgatcttcgtgctgaccaagctgaagagcgaggacgagcccaccagaagcctgagcggcctgatcctgaagaacaacgtgaaggcccacttccagaacttccccaacggcgtgaccgacttcatcaagagcgagtgcctgaacaacatcggcgacagcagccccctgatcagagccaccgtgggcatcctgatcaccaccatcgccagcaagggcgagctgcagaactggcccgacctgctgcccaagctgtgcagcctgctggacagcgaggactacaacacctgcgagggcgccttcggcgccctgcagaagatctgcgaggacagcgccgagatcctggacagcgacgtgctggacagacccctgaacatcatgatccccaagttcctgcagttcttcaagcacagcagccccaagatcagaagccacgccgtggcctgcgtgaaccagttcatcatcagcagaacccaggccctgatgctgcacatcgacagcttcatcgagaacctgttcgccctggccggcgacgaggagcccgaggtgagaaagaacgtgtgcagagccctggtgatgctgctggaggtgagaatggacagactgctgccccacatgcacaacatcgtggagtacatgctgcagagaacccaggaccaggacgagaacgtggccctggaggcctgcgagttctggctgaccctggccgagcagcccatctgcaaggacgtgctggtgagacacctgcccaagctgatccccgtgctggtgaacggcatgaagtacagcgacatcgacatcatcctgctgaagggcgacgtggaggaggacgagaccatccccgacagcgagcaggacatcagacccagattccacagaagcagaaccgtggcccagcagcacgacgaggacggcatcgaggaggaggacgacgacgacgacgagatcgacgacgacgacaccatcagcgactggaacctgagaaagtgcagcgccgccgccctggacgtgctggccaacgtgtacagagacgagctgctgccccacatcctgcccctgctgaaggagctgctgttccaccacgagtgggtggtgaaggagagcggcatcctggtgctgggcgccatcgccgagggctgcatgcagggcatgatcccctacctgcccgagctgatcccccacctgatccagtgcctgagcgacaagaaggccctggtgagaagcatcacctgctggaccctgagcagatacgcccactgggtggtgagccagccccccgacacctacctgaagcccctgatgaccgagctgctgaagagaatcctggacagcaacaagagagtgcaggaggccgcctgcagcgccttcgccaccctggaggaggaggcctgcaccgagctggtgccctacctggcctacatcctggacaccctggtgttcgccttcagcaagtaccagcacaagaacctgctgatcctgtacgacgccatcggcaccctggccgacagcgtgggccaccacctgaacaagcccgagtacatccagatgctgatgccccccctgatccagaagtggaacatgctgaaggacgaggacaaggacctgttccccctgctggagtgcctgagcagcgtggccaccgccctgcagagcggcttcctgccctactgcgagcccgtgtaccagagatgcgtgaacctggtgcagaagaccctggcccaggccatgctgaacaacgcccagcccgaccagtacgaggcccccgacaaggacttcatgatcgtggccctggacctgctgagcggcctggccgagggcctgggcggcaacatcgagcagctggtggccagaagcaacatcctgaccctgatgtaccagtgcatgcaggacaagatgcccgaggtgagacagagcagcttcgccctgctgggcgacctgaccaaggcctgcttccagcacgtgaagccctgcatcgccgacttcatgcccatcctgggcaccaacctgaaccccgagttcatcagcgtgtgcaacaacgccacctgggccatcggcgagatcagcatccagatgggcatcgagatgcagccctacatccccatggtgctgcaccagctggtggagatcatcaacagacccaacacccccaagaccctgctggagaacaccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcaccatgatcagcgtgaaccccagcggcgtgatccaggacttcatcttcttctgcgacgccgtggccagctggatcaaccccaaggacgacctgagagacatgttctgcaagatcctgcacggcttcaagaaccaggtgggcgacgagaactggagaagattcagcgaccagttccccctgcccctgaaggagagactggccgccttctacggcgtgtag

SEQ ID NO: 103300 - DNA, 387 bp, Artificial Sequence
  Description of Artificial Sequence: Synthetic coding sequence
atggagtacgagtggaagcccgacgagcagggcctgcagcagatcctgcagctgctgaaggagagccagagccccgacaccaccatccagagaaccgtgcagcagaagctggagcagctgaaccagtaccccgacttcaacaactacctgatcttcgtgctgaccaagctgaagagcgaggacgagcccaccagaagcctgagcggcctgatcctgaagaacaacgtgaaggcccacttccagaacttccccaacggcgtgaccgacttcatcaagagcgagtgcctgaacaacatcggcgacagcagccccctgatcagagccaccgtgggcctgaccctgctgcacgtgagcatcagcctgagcagcgtgggcctgaagctgtag

SEQ ID NO: 103301 - DNA, 2547 bp, Artificial Sequence
  Description of Artificial Sequence: Synthetic coding sequence
atggtgtgggacagacagaccaagatggagtacgagtggaagcccgacgagcagggcctgcagcagatcctgcagctgctgaaggagagccagagccccgacaccaccatccagagaaccgtgcagcagaagctggagcagctgaaccagtaccccgacttcaacaactacctgatcttcgtgctgaccaagctgaagagcgagggcatcctgatcaccaccatcgccagcaagggcgagctgcagaactggcccgacctgctgcccaagctgtgcagcctgctggacagcgaggactacaacacctgcgagggcgccttcggcgccctgcagaagatctgcgaggacagcgccgagatcctggacagcgacgtgctggacagacccctgaacatcatgatccccaagttcctgcagttcttcaagcacagcagccccaagatcagaagccacgccgtggcctgcgtgaaccagttcatcatcagcagaacccaggccctgatgctgcacatcgacagcttcatcgagaacctgttcgccctggccggcgacgaggagcccgaggtgagaaagaacgtgtgcagagccctggtgatgctgctggaggtgagaatggacagactgctgccccacatgcacaacatcgtggagtacatgctgcagagaacccaggaccaggacgagaacgtggccctggaggcctgcgagttctggctgaccctggccgagcagcccatctgcaaggacgtgctggtgagacacctgcccaagctgatccccgtgctggtgaacggcatgaagtacagcgacatcgacatcatcctgctgaagggcgacgtggaggaggacgagaccatccccgacagcgagcaggacatcagacccagattccacagaagcagaaccgtggcccagcagcacgacgaggacggcatcgaggaggaggacgacgacgacgacgagatcgacgacgacgacaccatcagcgactggaacctgagaaagtgcagcgccgccgccctggacgtgctggccaacgtgtacagagacgagctgctgccccacatcctgcccctgctgaaggagctgctgttccaccacgagtgggtggtgaaggagagcggcatcctggtgctgggcgccatcgccgagggctgcatgcagggcatgatcccctacctgcccgagctgatcccccacctgatccagtgcctgagcgacaagaaggccctggtgagaagcatcacctgctggaccctgagcagatacgcccactgggtggtgagccagccccccgacacctacctgaagcccctgatgaccgagctgctgaagagaatcctggacagcaacaagagagtgcaggaggccgcctgcagcgccttcgccaccctggaggaggaggcctgcaccgagctggtgccctacctggcctacatcctggacaccctggtgttcgccttcagcaagtaccagcacaagaacctgctgatcctgtacgacgccatcggcaccctggccgacagcgtgggccaccacctgaacaagcccgagtacatccagatgctgatgccccccctgatccagaagtggaacatgctgaaggacgaggacaaggacctgttccccctgctggagtgcctgagcagcgtggccaccgccctgcagagcggcttcctgccctactgcgagcccgtgtaccagagatgcgtgaacctggtgcagaagaccctggcccaggccatgctgaacaacgcccagcccgaccagtacgaggcccccgacaaggacttcatgatcgtggccctggacctgctgagcggcctggccgagggcctgggcggcaacatcgagcagctggtggccagaagcaacatcctgaccctgatgtaccagtgcatgcaggacaagatgcccgaggtgagacagagcagcttcgccctgctgggcgacctgaccaaggcctgcttccagcacgtgaagccctgcatcgccgacttcatgcccatcctgggcaccaacctgaaccccgagttcatcagcgtgtgcaacaacgccacctgggccatcggcgagatcagcatccagatgggcatcgagatgcagccctacatccccatggtgctgcaccagctggtggagatcatcaacagacccaacacccccaagaccctgctggagaacaccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcaccatgatcagcgtgaaccccagcggcgtgatccaggacttcatcttcttctgcgacgccgtggccagctggatcaaccccaaggacgacctgagagacatgttctgcaagatcctgcacggcttcaagaaccaggtgggcgacgagaactggagaagattcagcgaccagttccccctgcccctgaaggagagactggccgccttctacggcgtgtag

SEQ ID NO: 103302 - DNA, 2673 bp, Artificial Sequence
  Description of Artificial Sequence: Synthetic coding sequence
atggagtacgagtggaagcccgacgagcagggcctgcagcagatcctgcagctgctgaaggagagccagagccccgacaccaccatccagagaaccgtgcagcagaagctggagcagctgaaccagtaccccgacttcaacaactacctgatcttcgtgctgaccaagctgaagagcgaggacgagcccaccagaagcctgagcggcctgatcctgaagaacaacgtgaaggcccacttccagaacttccccaacggcgtgaccgacttcatcaagagcgagtgcctgaacaacatcggcgacagcagccccctgatcagagccaccgtgggcatcctgatcaccaccatcgccagcaagggcgagctgcagaactggcccgacctgctgcccaagctgtgcagcctgctggacagcgaggactacaacacctgcgagggcgccttcggcgccctgcagaagatctgcgaggacagcgccgagatcctggacagcgacgtgctggacagacccctgaacatcatgatccccaagttcctgcagttcttcaagcacagcagccccaagatcagaagccacgccgtggcctgcgtgaaccagttcatcatcagcagaacccaggccctgatgctgcacatcgacagcttcatcgagaacctgttcgccctggccggcgacgaggagcccgaggtgagaaagaacgtgtgcagagccctggtgatgctgctggaggtgagaatggacagactgctgccccacatgcacaacatcgtggagtacatgctgcagagaacccaggaccaggacgagaacgtggccctggaggcctgcgagttctggctgaccctggccgagcagcccatctgcaaggacgtgctggtgagacacctgcccaagctgatccccgtgctggtgaacggcatgaagtacagcgacatcgacatcatcctgctgaagggcgacgtggaggaggacgagaccatccccgacagcgagcaggacatcagacccagattccacagaagcagaaccgtggcccagcagcacgacgaggacggcatcgaggaggaggacgacgacgacgacgagatcgacgacgacgacaccatcagcgactggaacctgagaaagtgcagcgccgccgccctggacgtgctggccaacgtgtacagagacgagctgctgccccacatcctgcccctgctgaaggagctgctgttccaccacgagtgggtggtgaaggagagcggcatcctggtgctgggcgccatcgccgagggctgcatgcagggcatgatcccctacctgcccgagctgatcccccacctgatccagtgcctgagcgacaagaaggccctggtgagaagcatcacctgctggaccctgagcagatacgcccactgggtggtgagccagccccccgacacctacctgaagcccctgatgaccgagctgctgaagagaatcctggacagcaacaagagagtgcaggaggccgcctgcagcgccttcgccaccctggaggaggaggcctgcaccgagctggtgccctacctggcctacatcctggacaccctggtgttcgccttcagcaagtaccagcacaagaacctgctgatcctgtacgacgccatcggcaccctggccgacagcgtgggccaccacctgaacaagcccgagtacatccagatgctgatgccccccctgatccagaagtggaacatgctgaaggacgaggacaaggacctgttccccctgctggagtgcctgagcagcgtggccaccgccctgcagagcggcttcctgccctactgcgagcccgtgtaccagagatgcgtgaacctggtgcagaagaccctggcccaggccatgctgaacaacgcccagcccgaccagtacgaggcccccgacaaggacttcatgatcgtggccctggacctgctgagcggcctggccgagggcctgggcggcaacatcgagcagctggtggccagaagcaacatcctgaccctgatgtaccagtgcatgcaggacaagatgcccgaggtgagacagagcagcttcgccctgctgggcgacctgaccaaggcctgcttccagcacgtgaagccctgcatcgccgacttcatgcccatcctgggcaccaacctgaaccccgagttcatcagcgtgtgcaacaacgccacctgggccatcggcgagatcagcatccagatgggcatcgagatgcagccctacatccccatggtgctgcaccagctggtggagatcatcaacagacccaacacccccaagaccctgctggagaacaccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcaccatgatcagcgtgaaccccagcggcgtgatccaggacttcatcttcttctgcgacgccgtggccagctggatcaaccccaaggacgacctgagagacatgttctgcaagatcctgcacggcttcaagaaccaggtgggcgacgagaactggagaagattcagcgaccagttccccctgcccctgaaggagagactggccgccttctacggcgtgtag

SEQ ID NO: 103303 - DNA, 2664 bp, Artificial Sequence
  Description of Artificial Sequence: Synthetic coding sequence
atggactggcagcccgacgagcagggcctgcagcaggtgctgcagctgctgaaggacagccagagccccaacaccgccacccagagaatcgtgcaggacaagctgaagcagctgaaccagttccccgacttcaacaactacctgatcttcgtgctgaccagactgaagagcgaggacgagcccaccagaagcctgagcggcctgatcctgaagaacaacgtgaaggcccactaccagagcttccccccccccgtggccgacttcatcaagcaggagtgcctgaacaacatcggcgacgccagcagcctgatcagagccaccatcggcatcctgatcaccaccatcgccagcaagggcgagctgcagatgtggcccgagctgctgccccagctgtgcaacctgctgaacagcgaggactacaacacctgcgagggcgccttcggcgccctgcagaagatctgcgaggacagcagcgagctgctggacagcgacgccctgaacagacccctgaacatcatgatccccaagttcctgcagttcttcaagcactgcagccccaagatcagaagccacgccatcgcctgcgtgaaccagttcatcatggacagagcccaggccctgatggacaacatcgacaccttcatcgagcacctgttcgccctggccgtggacgacgaccccgaggtgagaaagaacgtgtgcagagccctggtgatgctgctggaggtgagaatcgacagactgatcccccacatgcacagcatcatccagtacatgctgcagagaacccaggaccacgacgagaacgtggccctggaggcctgcgagttctggctgaccctggccgagcagcccatctgcaaggaggtgctggccagccacctggtgcagctgatccccatcctggtgaacggcatgaagtacagcgagatcgacatcatcctgctgaagggcgacgtggaggaggacgaggccgtgcccgacagcgagcaggacatcaagcccagattccacaagagcagaaccgtgaccctgccccacgaggccgagagacccgacggcagcgaggacgccgaggacgacgacgacgacgacgccctgagcgactggaacctgagaaagtgcagcgccgccgccctggacgtgctggccaacgtgttcagagaggagctgctgccccacctgctgcccctgctgaagggcctgctgttccaccccgagtgggtggtgaaggagagcggcatcctggtgctgggcgccatcgccgagggctgcatgcagggcatggtgccctacctgcccgagctgatcccccacctgatccagtgcctgagcgacaagaaggccctggtgagaagcatcgcctgctggaccctgagcagatacgcccactgggtggtgagccagccccccgacatgcacctgaagcccctgatgaccgagctgctgaagagaatcctggacggcaacaagagagtgcaggaggccgcctgcagcgccttcgccaccctggaggaggaggcctgcaccgagctggtgccctacctgagctacatcctggacaccctggtgttcgccttcggcaagtaccagcacaagaacctgctgatcctgtacgacgccatcggcaccctggccgacagcgtgggccaccacctgaaccagcccgagtacatccagaagctgatgccccccctgatccagaagtggaacgagctgaaggacgaggacaaggacctgttccccctgctggagtgcctgagcagcgtggccaccgccctgcagagcggcttcctgccctactgcgagcccgtgtaccagagatgcgtgaccctggtgcagaagaccctggcccaggccatgatgtacacccagcaccccgagcagtacgaggcccccgacaaggacttcatgatcgtggccctggacctgctgagcggcctggccgagggcctgggcggccacgtggagcagctggtggccagaagcaacatcatgaccctgctgttccagtgcatgcaggacagcatgcccgaggtgagacagagcagcttcgccctgctgggcgacctgaccaaggcctgcttcatccacgtgaagccctgcatcgccgagttcatgcccatcctgggcaccaacctgaaccccgagttcatcagcgtgtgcaacaacgccacctgggccatcggcgagatctgcatgcagatgggcgccgagatgcagccctacgtgcagatggtgctgaacaacctggtggagatcatcaacagacccaacacccccaagaccctgctggagaacaccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcatgatgatcggcgtgaaccccggcggcgtggtgcaggacttcatcttcttctgcgacgccgtggccagctgggtgagccccaaggacgacctgagagacatgttctacaagatcctgcacggcttcaaggaccaggtgggcgaggacaactggcagcagttcagcgagcagttcccccccctgctgaaggagagactggccgccttctacggcgtgtag

SEQ ID NO: 103304 - DNA, 2100 bp, Artificial Sequence
  Description of Artificial Sequence: Synthetic coding sequence
atggactggcagcccgacgagcagggcctgcagcaggtgctgcagctgctgaaggacagccagagccccaacaccgccacccagagaatcgtgcaggacaagctgaagcagctgaaccagttccccgacttcaacaactacctgatcttcgtgctgaccagactgaagagcgaggacgagcccaccagaagcctgagcggcctgatcctgaagaacaacgtgaaggcccactaccagagcttccccccccccgtggccgacttcatcaagcaggagtgcctgaacaacatcggcgacgccagcagcctgatcagagccaccatcggcatcctgatcaccaccatcgccagcaagggcgagctgcagatgtggcccgagctgctgccccagctgtgcaacctgctgaacagcgaggactacaacacctgcgagggcgccttcggcgccctgcagaagatctgcgaggacagcagcgagctgctggacagcgacgccctgaacagacccctgaacatcatgatccccaagttcctgcagttcttcaagcactgcagccccaagatcagaagccacgccatcgcctgcgtgaaccagttcatcatggacagagcccaggccctgatggacaacatcgacaccttcatcgagcacctgttcgccctggccgtggacgacgaccccgaggtgagaaagaacgtgtgcagagccctggtgatgctgctggaggtgagaatcgacagactgatcccccacatgcacagcatcatccagtacatgctgcagagaacccaggaccacgacgagaacgtggccctggaggcctgcgagttctggctgaccctggccgagcagcccatctgcaaggaggtgctggccagccacctggtgcagctgatccccatcctggtgaacggcatgaagtacagcgagatcgacatcatcctgctgaagggcgacgtggaggaggacgaggccgtgcccgacagcgagcaggacatcaagcccagattccacaagagcagaaccgtgaccctgccccacgaggccgagagacccgacggcagcgaggacgccgaggacgacgacgacgacgacgccctgagcgactggaacctgagaaagtgcagcgccgccgccctggacgtgctggccaacgtgttcagagaggagctgctgccccacctgctgcccctgctgaagggcctgctgttccaccccgagtgggtggtgaaggagagcggcatcctggtgctgggcgccatcgccgagggctgcatgcagggcatggtgccctacctgcccgagctgatcccccacctgatccagtgcctgagcgacaagaaggccctggtgagaagcatcgcctgctggaccctgagcagatacgcccactgggtggtgagccagccccccgacatgcacctgaagcccctgatgaccgagctgctgaagagaatcctggacggcaacaagagagtgcaggaggccgcctgcagcgccttcgccaccctggaggaggaggcctgcaccgagctggtgccctacctgagctacatcctggacaccctggtgttcgccttcggcaagtaccagcacaagaacctgctgatcctgtacgacgccatcggcaccctggccgacagcgtgggccaccacctgaaccagcccgagtacatccagaagctgatgccccccctgatccagaagtggaacgagctgaaggacgaggacaaggacctgttccccctgctggagtgcctgagcagcgtggccaccgccctgcagagcggcttcctgccctactgcgagcccgtgtaccagagatgcgtgaccctggtgcagaagaccctggcccaggccatgatgtacacccagcaccccgagcagtacgaggcccccgacaaggacttcatgatcgtggccctggacctgctgagcggcctggccgagggcctgggcggccacgtggagcagctggtggcccacagccccagcttccccccccaccccctgccccccgccggcagcagagtgtgccccttcgtgaccgtgctgtgctggggcctggcccccagatggagagagatccccctggtgtag

SEQ ID NO: 103305 - DNA, 2694 bp, Artificial Sequence
  Description of Artificial Sequence: Synthetic coding sequence
atggactggcagcccgacgagcagggcctgcagcaggtgctgcagctgctgaaggacagccagagccccaacaccgccacccagagaatcgtgcaggacaagctgaagcagctgaaccagttccccgacttcaacaactacctgatcttcgtgctgaccagactgaagagcgaggacgagcccaccagaagcctgagcggcctgatcctgaagaacaacgtgaaggcccactaccagagcttccccccccccgtggccgacttcatcaagcaggagtgcctgaacaacatcggcgacgccagcagcctgatcagagccaccatcggcatcctgatcaccaccatcgccagcaagggcgagctgcagatgtggcccgagctgctgccccagctgtgcaacctgctgaacagcgaggactacaacacctgcgagggcgccttcggcgccctgcagaagatctgcgaggacagcagcgagctgctggacagcgacgccctgaacagacccctgaacatcatgatccccaagttcctgcagttcttcaagcactgcagccccaagatcagaagccacgccatcgcctgcgtgaaccagttcatcatggacagagcccaggccctgatggacaacatcgacaccttcatcgagcacctgttcgccctggccgtggacgacgaccccgaggtgagaaagaacgtgtgcagagccctggtgatgctgctggaggtgagaatcgacagactgatcccccacatgcacagcatcatccagtacatgctgcagagaacccaggaccacgacgagaacgtggccctggaggcctgcgagttctggctgaccctggccgagcagcccatctgcaaggaggtgctggccagccacctggtgcagctgatccccatcctggtgaacggcatgaagtacagcgagatcgacatcatcctgctgaagggcgacgtggaggaggacgaggccgtgcccgacagcgagcaggacatcaagcccagattccacaagagcagaaccgtgaccctgccccacgaggccgagagacccgacggcagcgaggacgccgaggacgacgacgacgacgacgccctgagcgactggaacctgagaaagtgcagcgccgccgccctggacgtgctggccaacgtgttcagagaggagctgctgccccacctgctgcccctgctgaagggcctgctgttccaccccgagtgggtggtgaaggagagcggcatcctggtgctgggcgccatcgccgagggctgcatgcagggcatggtgccctacctgcccgagctgatcccccacctgatccagtgcctgagcgacaagaaggccctggtgagaagcatcgcctgctggaccctgagcagatacgcccactgggtggtgagccagccccccgacatgcacctgaagcccctgatgaccgagctgctgaagagaatcctggacggcaacaagagagtgcaggaggccgcctgcagcgccttcgccaccctggaggaggaggcctgcaccgagctggtgccctacctgagctacatcctggacaccctggtgttcgccttcggcaagtaccagcacaagaacctgctgatcctgtacgacgccatcggcaccctggccgacagcgtgggccaccacctgaaccagcccgagtacatccagaagctgatgccccccctgatccagaagtggaacgagctgaaggacgaggacaaggacctgttccccctgctggagtgcctgagcagcgtggccaccgccctgcagagcggcttcctgccctactgcgagcccgtgtaccagagatgcgtgaccctggtgcagaagaccctggcccaggccatgatgtacacccagcaccccgagcagtacgaggcccccgacaaggacttcatgatcgtggccctggacctgctgagcggcctggccgagggcctgggcggccacgtggagcagctggtggccagaagcaacatcatgaccctgctgttccagtgcatgcaggacagcatgcccgaggtgagacagagcagcttcgccctgctgggcgacctgaccaaggcctgcttcatccacgtgaagccctgcatcgccgagttcatgcccatcctgggcaccaacctgaaccccgagttcatcagcgtgtgcaacaacgccacctgggccatcggcgagatctgcatgcagatgggcgccgagatgcagccctacgtgcagatggtgctgaacaacctggtggagatcatcaacagacccaacacccccaagaccctgctggagaacaccggcagactgaccagccccagcgccatccccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcatgatgatcggcgtgaaccccggcggcgtggtgcaggacttcatcttcttctgcgacgccgtggccagctgggtgagccccaaggacgacctgagagacatgttctacaagatcctgcacggcttcaaggaccaggtgggcgaggacaactggcagcagttcagcgagcagttcccccccctgctgaaggagagactggccgccttctacggcgtgtag

SEQ ID NO: 103306 - DNA, 2664 bp, Artificial Sequence; identical to SEQ ID NO: 103303
  Description of Artificial Sequence: Synthetic coding sequence

SEQ ID NO: 103307 - DNA, 2694 bp, Artificial Sequence; identical to SEQ ID NO: 103305
  Description of Artificial Sequence: Synthetic coding sequence

SEQ ID NO: 103308 - DNA, 3156 bp, Artificial Sequence
  Description of Artificial Sequence: Synthetic coding sequence
ggccagagcgtgggcggcagaggcctgttcagagactgcgcctgcatcgaggagaccaccggcgccggcgccctgagcagaagcggcgccggccccctggacgtggaggccgccggccccagccccagcagatgcgagggcggcggcagcctgagagccagaagcagaggccagagacacggccccccctgggacgagggcagcagcctgggccccatgagaatcagaagagcccccccccccccccccgtggccagattccacatccccccccccgccctgcccagccccagactgagaggcagaggctggagaagctggagaggccccagaacctgggccggcgtggacagaagacccccccccgtgagaagaggcagaagcagaagacacgccgccaccgccgccagcggcgccccccccggcagccacaccgagccccagagacccagcgccgaccccggcccctacctgagaagcctgccctgcgccatggactggcagcccgacgagcagggcctgcagcaggtgctgcagctgctgaaggacagccagagccccaacaccgccacccagagaatcgtgcaggacaagctgaagcagctgaaccagttccccgacttcaacaactacctgatcttcgtgctgaccagactgaagagcgaggacgagcccaccagaagcctgagcggcctgatcctgaagaacaacgtgaaggcccactaccagagcttccccccccccgtggccgacttcatcaagcaggagtgcctgaacaacatcggcgacgccagcagcctgatcagagccaccatcggcatcctgatcaccaccatcgccagcaagggcgagctgcagatgtggcccgagctgctgccccagctgtgcaacctgctgaacagcgaggactacaacacctgcgagggcgccttcggcgccctgcagaagatctgcgaggacagcagcgagctgctggacagcgacgccctgaacagacccctgaacatcatgatccccaagttcctgcagttcttcaagcactgcagccccaagatcagaagccacgccatcgcctgcgtgaaccagttcatcatggacagagcccaggccctgatggacaacatcgacaccttcatcgagcacctgttcgccctggccgtggacgacgaccccgaggtgagaaagaacgtgtgcagagccctggtgatgctgctggaggtgagaatcgacagactgatcccccacatgcacagcatcatccagtacatgctgcagagaacccaggaccacgacgagaacgtggccctggaggcctgcgagttctggctgaccctggccgagcagcccatctgcaaggaggtgctggccagccacctggtgcagctgatccccatcctggtgaacggcatgaagtacagcgagatcgacatcatcctgctgaagggcgacgtggaggaggacgaggccgtgcccgacagcgagcaggacatcaagcccagattccacaagagcagaaccgtgaccctgccccacgaggccgagagacccgacggcagcgaggacgccgaggacgacgacgacgacgacgccctgagcgactggaacctgagaaagtgcagcgccgccgccctggacgtgctggccaacgtgttcagagaggagctgctgccccacctgctgcccctgctgaagggcctgctgttccaccccgagtgggtggtgaaggagagcggcatcctggtgctgggcgccatcgccgagggctgcatgcagggcatggtgccctacctgcccgagctgatcccccacctgatccagtgcctgagcgacaagaaggccctggtgagaagcatcgcctgctggaccctgagcagatacgcccactgggtggtgagccagccccccgacatgcacctgaagcccctgatgaccgagctgctgaagagaatcctggacggcaacaagagagtgcaggaggccgcctgcagcgccttcgccaccctggaggaggaggcctgcaccgagctggtgccctacctgagctacatcctggacaccctggtgttcgccttcggcaagtaccagcacaagaacctgctgatcctgtacgacgccatcggcaccctggccgacagcgtgggccaccacctgaaccagcccgagtacatccagaagctgatgccccccctgatccagaagtggaacgagctgaaggacgaggacaaggacctgttccccctgctggagtgcctgagcagcgtggccaccgccctgcagagcggcttcctgccctactgcgagcccgtgtaccagagatgcgtgaccctggtgcagaagaccctggcccaggccatgatgtacacccagcaccccgagcagtacgaggcccccgacaaggacttcatgatcgtggccctggacctgctgagcggcctggccgagggcctgggcggccacgtggagcagctggtggccagaagcaacatcatgaccctgctgttccagtgcatgcaggacagcatgcccgaggtgagacagagcagcttcgccctgctgggcgacctgaccaaggcctgcttcatccacgtgaagccctgcatcgccgagttcatgcccatcctgggcaccaacctgaaccccgagttcatcagcgtgtgcaacaacgccacctgggccatcggcgagatctgcatgcagatgggcgccgagatgcagccctacgtgcagatggtgctgaacaacctggtggagatcatcaacagacccaacacccccaagaccctgctggagaacaccgccatcaccatcggcagactgggctacgtgtgcccccaggaggtggcccccatgctgcagcagttcatcagaccctggtgcaccagcctgagaaacatcagagacaacgaggagaaggacagcgccttcagaggcatctgcatgatgatcggcgtgaaccccggcggcgtggtgcaggacttcatcttcttctgcgacgccgtggccagctgggtgagccccaaggacgacctgagagacatgttctacaagatcctgcacggcttcaaggaccaggtgggcgaggacaactggcagcagttcagcgagcagttcccccccctgctgaaggagagactggccgccttctacggcgtgtag

SEQ ID NO: 103309 - DNA, 2316 bp, Artificial Sequence
  Description of Artificial Sequence: Synthetic coding sequence
atggactggcagcccgacgagcagggcctgcagcaggtgctgcagctgctgaaggacagccagagccccaacaccgccacccagagaatcgtgcaggacaagctgaagcagctgaaccagttccccgacttcaacaactacctgatcttcgtgctgaccagactgaagagcgaggacgagcccaccagaagcctgagcggcctgatcctgaagaacaacgtgaaggcccactaccagagcttccccccccccgtggccgacttcatcaagcaggagtgcctgaacaacatcggcgacgccagcagcctgatcagagccaccatcggcatcctgatcaccaccatcgccagcaagggcgagctgcagatgtggcccgagctgctgccccagctgtgcaacctgctgaacagcgaggactacaacacctgcgagggcgccttcggcgccctgcagaagatctgcgaggacagcagcgagctgctggacagcgacgccctgaacagacccctgaacatcatgatccccaagttcctgcagttcttcaagcactgcagccccaagatcagaagccacgccatcgcctgcgtgaaccagttcatcatggacagagcccaggccctgatggacaacatcgacaccttcatcgagcacctgttcgccctggccgtggacgacgaccccgaggtgagaaagaacgtgtgcagagccctggtgatgctgctggaggtgagaatcgacagactgatcccccacatgcacagcatcatccagtacatgctgcagagaacccaggaccacgacgagaacgtggccctggaggcctgcgagttctggctgaccctggccgagcagcccatctgcaaggaggtgctggccagccacctggtgcagctgatccccatcctggtgaacggcatgaagtacagcgagatcgacatcatcctgctgaagggcgacgtggaggaggacgaggccgtgcccgacagcgagcaggacatcaagcccagattccacaagagcagaaccgtgaccctgccccacgaggccgagagacccgacggcagcgaggacgccgaggacgacgacgacgacgacgccctgagcgactggaacctgagaaagtgcagcgccgccgccctggacgtgctggccaacgtgttcagagaggagctgctgccccacctgctgcccctgctgaagggcctgctgttccaccccgagtgggtggtgaaggagagcggcatcctggtgctgggcgccatcgccgagggctgcatgcagggcatggtgccctacctgcccgagctgatcccccacctgatccagtgcctgagcgacaagaaggccctggtgagaagcatcgcctgctggaccctgagcagatacgcccactgggtggtgagccagccccccgacatgcacctgaagcccctgatgaccgagctgctgaagagaatcctggacggcaacaagagagtgcaggaggccgcctgcagcgccttcgccaccctggaggaggaggcctgcaccgagctggtgccctacctgagctacatcctggacaccctggtgttcgccttcggcaagtaccagcacaagaacctgctgatcctgtacgacgccatcggcaccctggccgacagcgtgggccaccacctgaaccagcccgagtacatccagaagctgatgccccccctgatccagaagtggaacgagctgaaggacgaggacaaggacctgttccccctgctggagtgcctgagcagcgtggccaccgccctgcagagcggcttcctgccctactgcgagcccgtgtaccagagatgcgtgaccctggtgcagaagaccctggcccaggccatgatgtacacccagcaccccgagcagtacgaggcccccgacaaggacttcatgatcgtggccctggacctgctgagcggcctggccgagggcctgggcggccacgtggagcagctggtggccagaagcaacatcatgaccctgctgttccagtgcatgcaggacagcatgcccgaggtgagacagagcagcttcgccctgctgggcgacctgaccaaggcctgcttcatccacgtgaagccctgcatcgccgagttcatgcccatcctgggcaccaacctgaaccccgagttcatcagcgtgtgcaacaacgccacctgggccatcggcgagatctgcatgcagatgggcgccgagatgcagccctacgtgcagatggtgctgaacaacctggtggagatcatcaacagacccacccccagccagaagcagaacaagaccaagaagaacaagtag

SEQ ID NO: 103310 - DNA, 2772 bp, Artificial Sequence
  Description of Artificial Sequence: Synthetic coding sequence
atggagggcgccaagcccaccctgcagctggtgtaccaggccgtgcaggccctgtaccacgaccccgaccccagcggcaaggagagagccagcttctggctgggcgagctgcagagaagcgtgcacgcctgggagatcagcgaccagctgctgcagatcagacaggacgtggagagctgctacttcgccgcccagaccatgaagatgaagatccagaccagcttctacgagctgcccaccgacagccacgccagcctgagagacagcctgctgacccacatccagaacctgaaggacctgagccccgtgatcgtgacccagctggccctggccatcgccgacctggccctgcagatgcccagctggaagggctgcgtgcagaccctggtggagaagtacagcaacgacgtgaccagcctgcccttcctgctggagatcctgaccgtgctgcccgaggaggtgcacagcagaagcctgagaatcggcgccaacagaagaaccgagatcatcgaggacctggccttctacagcagcaccgtggtgagcctgctgatgacctgcgtggagaaggccggcaccgacgagaagatgctgatgaaggtgttcagatgcctgggcagctggttcaacctgggcgtgctggacagcaacttcatggccaacaacaagctgctggccctgctgttcgaggtgctgcagcaggacaagaccagcagcaacctgcacgaggccgccagcgactgcgtgtgcagcgccctgtacgccatcgagaacgtggagaccaacctgcccctggccatgcagctgttccagggcgtgctgaccctggagaccgcctaccacatggccgtggccagagaggacctggacaaggtgctgaactactgcagaatcttcaccgagctgtgcgagaccttcctggagaagatcgtgtgcacccccggccagggcctgggcgacctgagaaccctggagctgctgctgatctgcgccggccacccccagtacgaggtggtggagatcagcttcaacttctggtacagactgggcgagcacctgtacaagaccaacgacgaggtgatccacggcatcttcaaggcctacatccagagactgctgcacgccctggccagacactgccagctggagcccgaccacgagggcgtgcccgaggagaccgacgacttcggcgagttcagaatgagagtgagcgacctggtgaaggacctgatcttcctgatcggcagcatggagtgcttcgcccagctgtacagcaccctgaaggagggcaaccccccctgggaggtgaccgaggccgtgctgttcatcatggccgccatcgccaagagcgtggaccccgagaacaaccccaccctggtggaggtgctggagggcgtggtgagactgcccgagaccgtgcacaccgccgtgagatacaccagcatcgagctggtgggcgagatgagcgaggtggtggacagaaacccccagttcctggaccccgtgctgggctacctgatgaagggcctgtgcgagaagcccctggccagcgccgccgccaaggccatccacaacatctgcagcgtgtgcagagaccacatggcccagcacttcaacggcctgctggagatcgccagaagcctggacagcttcctgctgagccccgaggccgccgtgggcctgctgaagggcaccgccctggtgctggccagactgcccctggacaagatcaccgagtgcctgagcgagctgtgcagcgtgcaggtgatggccctgaagaagctgctgagccaggagcccagcaacggcatcagcagcgaccccaccgtgttcctggacagactggccgtgatcttcagacacaccaaccccatcgtggagaacggccagacccacccctgccagaaggtgatccaggagatctggcccgtgctgagcgagaccctgaacaagcacagagccgacaacagaatcgtggagagatgctgcagatgcctgagattcgccgtgagatgcgtgggcaagggcagcgccgccctgctgcagcccctggtgacccagatggtgaacgtgtaccacgtgcaccagcacagctgcttcctgtacctgggcagcatcctggtggacgagtacggcatggaggagggctgcagacagggcctgctggacatgctgcaggccctgtgcatccccaccttccagctgctggagcagcagaacggcctgcagaaccaccccgacaccgtggacgacctgttcagactggccaccagattcatccagagaagccccgtgaccctgctgagaagccaggtggtgatccccatcctgcagtgggccatcgccagcaccaccctggaccacagagacgccaactgcagcgtgatgagattcctgagagacctgatccacaccggcgtggccaacgaccacgaggaggacttcgagctgagaaaggagctgatcggccaggtgatgaaccagctgggccagcagctggtgagccagctgctgcacacctgctgcttctgcctgcccccctacaccctgcccgacgtggccgaggtgctgtgggagatcatgcaggtggacagacccaccttctgcagatggctggagaacagcctgaagggcctgcccaaggagaccaccgtgggcgccgtgaccgtgacccacaagcagctgaccgacttccacaagcaggtgaccagcgccgaggagtgcaagcaggtgtgctgggccctgagagacttcaccagactgttcagatag

SEQ ID NO: 103311 - DNA, 2874 bp, Artificial Sequence
  Description of Artificial Sequence: Synthetic coding sequence
atggagggcgccaagcccaccctgcagctggtgtaccaggccgtgcaggccctgtaccacgaccccgaccccagcggcaaggagagagccagcttctggctgggcgagctgcagagaagcgtgcacgcctgggagatcagcgaccagctgctgcagatcagacaggacgtggagagctgctacttcgccgcccagaccatgaagatgaagatccagaccagcttctacgagctgcccaccgacagccacgccagcctgagagacagcctgctgacccacatccagaacctgaaggacctgagccccgtgatcgtgacccagctggccctggccatcgccgacctggccctgcagatgcccagctggaagggctgcgtgcagaccctggtggagaagtacagcaacgacgtgaccagcctgcccttcctgctggagatcctgaccgtgctgcccgaggaggtgcacagcagaagcctgagaatcggcgccaacagaagaaccgagatcatcgaggacctggccttctacagcagcaccgtggtgagcctgctgatgacctgcgtggagaaggccggcaccgacgagaagatgctgatgaaggtgttcagatgcctgggcagctggttcaacctgggcgtgctggacagcaacttcatggccaacaacaagctgctggccctgctgttcgaggtgctgcagcaggacaagaccagcagcaacctgcacgaggccgccagcgactgcgtgtgcagcgccctgtacgccatcgagaacgtggagaccaacctgcccctggccatgcagctgttccagggcgtgctgaccctggagaccgcctaccacatggccgtggccagagaggacctggacaaggtgctgaactactgcagaatcttcaccgagctgtgcgagaccttcctggagaagatcgtgtgcacccccggccagggcctgggcgacctgagaaccctggagctgctgctgatctgcgccggccacccccagtacgaggtggtggagatcagcttcaacttctggtacagactgggcgagcacctgtacaagaccaacgacgaggtgatccacggcatcttcaaggcctacatccagagactgctgcacgccctggccagacactgccagctggagcccgaccacgagggcgtgcccgaggagaccgacgacttcggcgagttcagaatgagagtgagcgacctggtgaaggacctgatcttcctgatcggcagcatggagtgcttcgcccagctgtacagcaccctgaaggagggcaaccccccctgggaggtgaccgaggccgtgctgttcatcatggccgccatcgccaagagcgtggaccccaagaagcccttcagcaacgccgtgtgcagacacagcctgctgttcggccagaacatcaccagcgagatcagcaactgcgagtacctgccccccgtgctgagagagaacaaccccaccctggtggaggtgctggagggcgtggtgagactgcccgagaccgtgcacaccgccgtgagatacaccagcatcgagctggtgggcgagatgagcgaggtggtggacagaaacccccagttcctggaccccgtgctgggctacctgatgaagggcctgtgcgagaagcccctggccagcgccgccgccaaggccatccacaacatctgcagcgtgtgcagagaccacatggcccagcacttcaacggcctgctggagatcgccagaagcctggacagcttcctgctgagccccgaggccgccgtgggcctgctgaagggcaccgccctggtgctggccagactgcccctggacaagatcaccgagtgcctgagcgagctgtgcagcgtgcaggtgatggccctgaagaagctgctgagccaggagcccagcaacggcatcagcagcgaccccaccgtgttcctggacagactggccgtgatcttcagacacaccaaccccatcgtggagaacggccagacccacccctgccagaaggtgatccaggagatctggcccgtgctgagcgagaccctgaacaagcacagagccgacaacagaatcgtggagagatgctgcagatgcctgagattcgccgtgagatgcgtgggcaagggcagcgccgccctgctgcagcccctggtgacccagatggtgaacgtgtaccacgtgcaccagcacagctgcttcctgtacctgggcagcatcctggtggacgagtacggcatggaggagggctgcagacagggcctgctggacatgctgcaggccctgtgcatccccaccttccagctgctggagcagcagaacggcctgcagaaccaccccgacaccgtggacgacctgttcagactggccaccagattcatccagagaagccccgtgaccctgctgagaagccaggtggtgatccccatcctgcagtgggccatcgccagcaccaccctggaccacagagacgccaactgcagcgtgatgagattcctgagagacctgatccacaccggcgtggccaacgaccacgaggaggacttcgagctgagaaaggagctgatcggccaggtgatgaaccagctgggccagcagctggtgagccagctgctgcacacctgctgcttctgcctgcccccctacaccctgcccgacgtggccgaggtgctgtgggagatcatgcaggtggacagacccaccttctgcagatggctggagaacagcctgaagggcctgcccaaggagaccaccgtgggcgccgtgaccgtgacccacaagcagctgaccgacttccacaagcaggtgaccagcgccgaggagtgcaagcaggtgtgctgggccctgagagacttcaccagactgttcagatag

SEQ ID NO: 103312 - DNA, 2874 bp, Artificial Sequence; identical to SEQ ID NO: 103311
  Description of Artificial Sequence: Synthetic coding sequence

SEQ ID NO: 103313 - DNA, 2580 bp, Artificial Sequence
  Description of Artificial Sequence: Synthetic coding sequence
atggagggcgccaagcccaccctgcagctggtgtaccaggccgtgcaggccctgtaccacgaccccgaccccagcggcaaggagagagccagcttctggctgggcgagctgcagagaagcgtgcacgcctgggagatcagcgaccagctgctgcagatcagacaggacgtggagagctgctacttcgccgcccagaccatgaagatgaagatccagaccagcttctacgagctgcccaccgacagccacgccagcctgagagacagcctgctgacccacatccagaacctgaaggacctgagccccgtgatcgtgacccagctggccctggccatcgccgacctggccctgcagatgcccagctggaagggctgcgtgcagaccctggtggagaagtacagcaacgacgtgaccagcctgcccttcctgctggagatcctgaccgtgctgcccgaggaggtgcacagcagaagcctgagaatcggcgccaacagaagaaccgagatcatcgaggacctggccttctacagcagcaccgtggtgagcctgctgatgacctgcgtggagaaggccggcaccgacgagaagatgctgatgaaggtgttcagatgcctgggcagctggttcaacctgggcgtgctggacagcaacttcatggccaacaacaagctgctggccctgctgttcgaggtgctgcagcaggacaagaccagcagcaacctgcacgaggccgccagcgactgcgtgtgcagcgccctgtacgccatcgagaacgtggagaccaacctgcccctggccatgcagctgttccagggcgtgctgaccctggagaccgcctaccacatggccgtggccagagaggacctggacaaggtgctgaactactgcagaatcttcaccgagctgtgcgagaccttcctggagaagatcgtgtgcacccccggccagggcctgggcgacctgagaaccctggagctgctgctgatctgcgccggccacccccagtacgaggtggtggagatcagcttcaacttctggtacagactgggcgagcacctgtacaagaccaacgacgaggtgatccacggcatcttcaaggcctacatccagagactgctgcacgccctggccagacactgccagctggagcccgaccacgagggcgtgcccgaggagaccgacgacttcggcgagttcagaatgagagtgagcgacctggtgaaggacctgatcttcctgatcggcagcatggagtgcttcgcccagctgtacagcaccctgaaggagggcaaccccccctgggaggtgaccgaggccgtgctgttcatcatggccgccatcgccaagagcgtggaccccgagaacaaccccaccctggtggaggtgctggagggcgtggtgagactgcccgagaccgtgcacaccgccgtgagatacaccagcatcgagctggtgggcgagatgagcgaggtggtggacagaaacccccagttcctgggcaccgccctggtgctggccagactgcccctggacaagatcaccgagtgcctgagcgagctgtgcagcgtgcaggtgatggccctgaagaagctgctgagccaggagcccagcaacggcatcagcagcgaccccaccgtgttcctggacagactggccgtgatcttcagacacaccaaccccatcgtggagaacggccagacccacccctgccagaaggtgatccaggagatctggcccgtgctgagcgagaccctgaacaagcacagagccgacaacagaatcgtggagagatgctgcagatgcctgagattcgccgtgagatgcgtgggcaagggcagcgccgccctgctgcagcccctggtgacccagatggtgaacgtgtaccacgtgcaccagcacagctgcttcctgtacctgggcagcatcctggtggacgagtacggcatggaggagggctgcagacagggcctgctggacatgctgcaggccctgtgcatccccaccttccagctgctggagcagcagaacggcctgcagaaccaccccgacaccgtggacgacctgttcagactggccaccagattcatccagagaagccccgtgaccctgctgagaagccaggtggtgatccccatcctgcagtgggccatcgccagcaccaccctggaccacagagacgccaactgcagcgtgatgagattcctgagagacctgatccacaccggcgtggccaacgaccacgaggaggacttcgagctgagaaaggagctgatcggccaggtgatgaaccagctgggccagcagctggtgagccagctgctgcacacctgctgcttctgcctgcccccctacaccctgcccgacgtggccgaggtgctgtgggagatcatgcaggtggacagacccaccttctgcagatggctggagaacagcctgaagggcctgcccaaggagaccaccgtgggcgccgtgaccgtgacccacaagcagctgaccgacttccacaagcaggtgaccagcgccgaggagtgcaagcaggtgtgctgggccctgagagacttcaccagactgttcagatag

SEQ ID NO: 103314 - DNA, 4236 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtgagcaagaagaaccccgccagcctgcccctgacccaggccgccctgaaggtgctggcccagaaggccagcgaggcccagccccccgtggccagaacccagcccagcagcggcgtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103315 - DNA, 4470 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtgagcaagaagaaccccgccagcctgcccctgacccaggccgccctgaaggtgctggcccagaaggccagcgaggcccagccccccgtggccagaacccagcccagcagcggcgtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctggtgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103316 - DNA, 2877 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggaccaggagagcagctag

SEQ ID NO: 103317 - DNA, 4245 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaagtag

SEQ ID NO: 103318 - DNA, 4356 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctggtgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103319 - DNA, 4239 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtgagcaagaagaaccccgccagcctgcccctgacccaggccgccctgaaggtgctggcccagaaggccagcgaggcccagccccccgtggccagaacccagcccagcagcggcgtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctggtgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103320 - DNA, 4578 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccagaaggacagcaacagcaagcccgccagaagcaagaccctggcccccgccccccccgagagaaacaccgagggcagcagcgagagcagcgaggaggagctgcccctgacccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtgagcaagaagaaccccgccagcctgcccctgacccaggccgccctgaaggtgctggcccagaaggccagcgaggcccagccccccgtggccagaacccagcccagcagcggcgtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103321 - DNA, 4467 bp, Artificial Sequence
  Description of Artificial Sequence: Synthetic coding sequence
atggccgaggccagaaagagaagagagctgctgcccctgatctaccaccacctgctgagagccggctacgtgagagccgccagagaggtgaaggagcagagcggccagaagtgcttcctggcccagcccgtgaccctgctggacatctacacccactggcagcagaccagcgagctgggcagaaagagaaaggccgaggaggacgccgccctgcaggccaagaagaccagagtgagcgaccccatcagcaccagcgagagcagcgaggaggaggaggaggccgaggccgagaccgccaaggccacccccagactggccagcaccaacagcagcgtgctgggcgccgacctgcccagcagcatgaaggagaaggccaaggccgagaccgagaaggccggcaagaccggcaacagcatgccccaccccgccaccggcaagaccgtggccaacctgctgagcggcaagagccccagaaagagcgccgagcccagcgccaacaccaccctggtgagcgagaccgaggaggagggcagcgtgcccgccttcggcgccgccgccaagcccggcatggtgagcgccggccaggccgacagcagcagcgaggacaccagcagcagcagcgacgagaccgacgtggagggcaagcccagcgtgaagcccgcccaggtgaaggccagcagcgtgagcaccaaggagagccccgccagaaaggccgcccccgcccccggcaaggtgggcgacgtgaccccccaggtgaagggcggcgccctgccccccgccaagagagccaagaagcccgaggaggagagcgagagcagcgaggagggcagcgagagcgaggaggaggcccccgccggcaccagaagccaggtgaaggccagcgagaagatcctgcaggtgagagccgccagcgcccccgccaagggcacccccggcaagggcgccacccccgccccccccggcaaggccggcgccgtggccagccagaccaaggccggcaagcccgaggaggacagcgagagcagcagcgaggagagcagcgacagcgaggaggagacccccgccgccaaggccctgctgcaggccaaggccagcggcaagaccagccaggtgggcgccgccagcgcccccgccaaggagagccccagaaagggcgccgcccccgccccccccggcaagaccggccccgccgtggccaaggcccaggccggcaagagagaggaggacagccagagcagcagcgaggagagcgacagcgaggaggaggcccccgcccaggccaagcccagcggcaaggccccccaggtgagagccgccagcgcccccgccaaggagagccccagaaagggcgccgcccccgccccccccagaaagaccggccccgccgccgcccaggtgcaggtgggcaagcaggaggaggacagcagaagcagcagcgaggagagcgacagcgacagagaggccctggccgccatgaacgccgcccaggtgaagcccctgggcaagagcccccaggtgaagcccgccagcaccatgggcatgggccccctgggcaagggcgccggccccgtgccccccggcaaggtgggccccgccacccccagcgcccaggtgggcaagtgggaggaggacagcgagagcagcagcgaggagagcagcgacagcagcgacggcgaggtgcccaccgccgtggcccccgcccaggagaagagcctgggcaacatcctgcaggccaagcccaccagcagccccgccaagggccccccccagaaggccggccccgtggccgtgcaggtgaaggccgagaagcccatggacaacagcgagagcagcgaggagagcagcgacagcgccgacagcgaggaggcccccgccgccatgaccgccgcccaggccaagcccgccctgaagatcccccagaccaaggcctgccccaagaagaccaacaccaccgccagcgccaaggtggcccccgtgagagtgggcacccaggcccccagaaaggccggcaccgccaccagccccgccggcagcagccccgccgtggccggcggcacccagagacccgccgaggacagcagcagcagcgaggagagcgacagcgaggaggagaagaccggcctggccgtgaccgtgggccaggccaagagcgtgggcaagggcctgcaggtgaaggccgccagcgtgcccgtgaagggcagcctgggccagggcaccgcccccgtgctgcccggcaagaccggccccaccgtgacccaggtgaaggccgagaagcaggaggacagcgagagcagcgaggaggagagcgacagcgaggaggccgccgccagccccgcccaggtgaagaccagcgtgaagaagacccaggccaaggccaaccccgccgccgccagagcccccagcgccaagggcaccatcagcgcccccggcaaggtggtgaccgccgccgcccaggccaagcagagaagccccagcaaggtgaagccccccgtgagaaacccccagaacagcaccgtgctggccagaggccccgccagcgtgcccagcgtgggcaaggccgtggccaccgccgcccaggcccagaccggccccgaggaggacagcggcagcagcgaggaggagagcgacagcgaggaggaggccgagaccctggcccaggtgaagcccagcggcaagacccaccagatcagagccgccctggcccccgccaaggagagccccagaaagggcgccgcccccaccccccccggcaagaccggccccagcgccgcccaggccggcaagcaggacgacagcggcagcagcagcgaggagagcgacagcgacggcgaggcccccgccgccgtgaccagcgcccaggtgatcaagccccccctgatcttcgtggaccccaacagaagccccgccggccccgccgccacccccgcccaggcccaggccgccagcacccccagaaaggccagagccagcgagagcaccgccagaagcagcagcagcgagagcgaggacgaggacgtgatccccgccacccagtgcctgacccccggcatcagaaccaacgtggtgaccatgcccaccgcccaccccagaatcgcccccaaggccagcatggccggcgccagcagcagcaaggagagcagcagaatcagcgacggcaagaagcaggagggccccgccacccaggtgagcaagaagaaccccgccagcctgcccctgacccaggccgccctgaaggtgctggcccagaaggccagcgaggcccagccccccgtggccagaacccagcccagcagcggcgtggacagcgccgtgggcaccctgcccgccaccagcccccagagcaccagcgtgcaggccaagggcaccaacaagctgagaaagcccaagctgcccgaggtgcagcaggccaccaaggcccccgagagcagcgacgacagcgaggacagcagcgacagcagcagcggcagcgaggaggacggcgagggcccccagggcgccaagagcgcccacaccctgggccccacccccagcagaaccgagaccctggtggaggagaccgccgccgagagcagcgaggacgacgtggtggcccccagccagagcctgctgagcggctacatgacccccggcctgacccccgccaacagccaggccagcaaggccacccccaagctggacagcagccccagcgtgagcagcaccctggccgccaaggacgaccccgacggcaagcaggaggccaagccccagcaggccgccggcatgctgagccccaagaccggcggcaaggaggccgccagcggcaccaccccccagaagagcagaaagcccaagaagggcgccggcaacccccaggccagcaccctggccctgcagagcaacatcacccagtgcctgctgggccagccctggcccctgaacgaggcccaggtgcaggccagcgtggtgaaggtgctgaccgagctgctggagcaggagagaaagaaggtggtggacaccaccaaggagagcagcagaaagggctgggagagcagaaagagaaagctgagcggcgaccagcccgccgccagaacccccagaagcaagaagaagaagaagctgggcgccggcgagggcggcgaggccagcgtgagccccgagaagaccagcaccaccagcaagggcaaggccaagagagacaaggccagcggcgacgtgaaggagaagaagggcaagggcagcctgggcagccagggcgccaaggacgagcccgaggaggagctgcagaagggcatgggcaccgtggagggcggcgaccagagcaaccccaagagcaagaaggagaagaagaagagcgacaagagaaagaaggacaaggagaagaaggagaagaagaagaaggccaagaaggccagcaccaaggacagcgagagccccagccagaagaagaagaagaagaagaagaagaccgccgagcagaccgtgtag

SEQ ID NO: 103322 - DNA, 255 bp, Artificial Sequence
  Description of Artificial Sequence: Synthetic coding sequence
atggccaccatggagaacaaggtgatctgcgccctggtgctggtgagcatgctggccctgggcaccctggccgaggcccagaccgagacctgcaccgtggcccccagagagagacagaactgcggcttccccggcgtgacccccagccagtgcgccaacaagggctgctgcttcgacgacaccgtgagaggcgtgccctggtgcttctaccccaacaccatcgacgtgccccccgaggaggagtgcgagttctag

SEQ ID NO: 103323 - DNA, 390 bp, Artificial Sequence
  Description of Artificial Sequence: Synthetic coding sequence
atgggcagaagagacgcccagctgctggccgccctgctggtgctgggcctgtgcgccctggccggcagcgagaagcccagcccctgccagtgcagcagactgagcccccacaacagaaccaactgcggcttccccggcatcaccagcgaccagtgcttcgacaacggctgctgcttcgacagcagcgtgaccggcgtgccctggtgcttccaccccctgcccaagcaggagagcgaccagtgcgtgatggaggtgagcgacagaagaaactgcggctaccccggcatcagccccgaggagtgcgccagcagaaagtgctgcttcagcaacttcatcttcgaggtgccctggtgcttcttccccaagagcgtggaggactgccactactag

SEQ ID NO: 103324 - DNA, 1749 bp, Artificial Sequence
  Description of Artificial Sequence: Synthetic coding sequence
atgcccggcagaacctgggagctgtgcctgctgctgctgctgggcctgggcctgggcagccaggaggccctgccccccccctgcgagagcgagatctactgccacggcgagctgctgaaccaggtgcagatggccaagctgtaccaggacgacaagcagttcgtggacatgcccctgagcatcgcccccgagcaggtgctgcagaccttcaccgagctgagcagagaccacaaccacagcatccccagagagcagctgcaggccttcgtgcacgagcacttccaggccaagggccaggagctgcagccctggacccccgccgactggaaggacagcccccagttcctgcagaagatcagcgacgccaagctgagagcctgggccggccagctgcaccagctgtggaagaagctgggcaagaagatgaagcccgaggtgctgagccaccccgagagattcagcctgatctacagcgagcaccccttcatcgtgcccggcggcagattcgtggagttctactactgggacagctactgggtgatggagggcctgctgctgagcgagatggccgagaccgtgaagggcatgctgcagaacttcctggacctggtgaagacctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactgggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggccccaagctgcccttcctggagccccactgcctggccaccctgctgcccagcctgctgctgagcctgctgccctggtag

SEQ ID NO: 103325 - DNA, 1656 bp, Artificial Sequence
  Description of Artificial Sequence: Synthetic coding sequence
atgcccggcagaacctgggagctgtgcctgctgctgctgctgggcctgggcctgggcagccaggaggccctgccccccccctgcgagagcgagatctactgccacggcgagctgctgaaccaggtgcagatggccaagctgtaccaggacgacaagcagttcgtggacatgcccctgagcatcgcccccgagcaggtgctgcagaccttcaccgagctgagcagagaccacaaccacagcatccccagagagcagctgcaggccttcgtgcacgagcacttccaggccaagggccaggagctgcagccctggacccccgccgactggaaggacagcccccagttcctgcagaagatcagcgacgccaagctgagagcctgggccggccagctgcaccagctgtggaagaagctgggcaagaagatgaagcccgaggtgctgagccaccccgagagattcagcctgatctacagcgagcaccccttcatcgtgcccggcggcagattcgtggagttctactactgctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactgggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggccccaagctgcccttcctggagccccactgcctggccaccctgctgcccagcctgctgctgagcctgctgccctggtag

SEQ ID NO: 103326 - DNA, 1380 bp, Artificial Sequence
  Description of Artificial Sequence: Synthetic coding sequence
atgcccaactgcgtgcccggccagggcagctgcatcagcagcggcagaagctggggcagaagataccagagacccggccccgcccagggcctgaccaagggcaccgaggagagaaacgtgcccggcgcccacagcgtgttcggcgcccagatcagagacagctactgggtgatggagggcctgctgctgagcgagatggccgagaccgtgaagggcatgctgcagaacttcctggacctggtgaagacctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactgggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggccccaagctgcccttcctggagccccactgcctggccaccctgctgcccagcctgctgctgagcctgctgccctggtag

SEQ ID NO: 103327 - DNA, 1641 bp, Artificial Sequence
  Description of Artificial Sequence: Synthetic coding sequence
atgcccggcagaacctgggagctgtgcctgctgctgctgctgggcctgggcctgggcagccaggaggccctgccccccccctgcgagagcgagatctactgccacggcgagctgctgaaccaggtgcagatggccaagctgtaccaggacgacaagcagttcgtggacatgcccctgagcatcgcccccgagcaggtgctgcagaccttcaccgagctgagcagagaccacaaccacagcatccccagagagcagctgcaggccttcgtgcacgagcacttccaggccaagggccaggagctgcagccctggacccccgccgactggaaggacagcccccagttcctgcagaagatcagcgacgccaagctgagagcctgggccggccagctgcaccagctgtggaagaagctgggcaagaagatgaagcccgaggtgctgagccaccccgagagattcagcctgatctacagcgagcaccccttcatcgtgcccggcggcagattcgtggagttctactactgctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactgggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggccccaagctgcccttcctggagccccactgcctgggcccccccttctgccccgccagctgctag

SEQ ID NO: 103328 - DNA, 1734 bp, Artificial Sequence
  Description of Artificial Sequence: Synthetic coding sequence
atgcccggcagaacctgggagctgtgcctgctgctgctgctgggcctgggcctgggcagccaggaggccctgccccccccctgcgagagcgagatctactgccacggcgagctgctgaaccaggtgcagatggccaagctgtaccaggacgacaagcagttcgtggacatgcccctgagcatcgcccccgagcaggtgctgcagaccttcaccgagctgagcagagaccacaaccacagcatccccagagagcagctgcaggccttcgtgcacgagcacttccaggccaagggccaggagctgcagccctggacccccgccgactggaaggacagcccccagttcctgcagaagatcagcgacgccaagctgagagcctgggccggccagctgcaccagctgtggaagaagctgggcaagaagatgaagcccgaggtgctgagccaccccgagagattcagcctgatctacagcgagcaccccttcatcgtgcccggcggcagattcgtggagttctactactgggacagctactgggtgatggagggcctgctgctgagcgagatggccgagaccgtgaagggcatgctgcagaacttcctggacctggtgaagacctacggccacgtgcccaacggcggcagagtgtactacctgcagagaagccagccccccctgctgaccctgatgatggactgctacctgacccacaccaacgacaccgccttcctgcaggagaacatcgagaccctggccctggagctggacttctggaccaagaacagaaccgtgagcgtgagcctggagggcaagaactacctgctgaacagatactacgtgccctacggcggccccagacccgagagctacagcaaggacgtggagctggccgacaccctgcccgagggcgacagagaggccctgtgggccgagctgaaggccggcgccgagagcggctgggacttcagcagcagatggctgatcggcggccccaaccccaacagcctgagcggcatcagaaccagcaagctggtgcccgtggacctgaacgccttcctgtgccaggccgaggagctgatgagcaacttctacagcagactgggcaacgacagccaggccaccaagtacagaatcctgagaagccagagactggccgccctgaacaccgtgctgtgggacgagcagaccggcgcctggttcgactacgacctggagaagaagaagaagaacagagagttctaccccagcaacctgacccccctgtgggccggctgcttcagcgaccccggcgtggccgacaaggccctgaagtacctggaggacaacagaatcctgacctaccagtacggcatccccaccagcctgcagaagaccggccagcagtgggacttccccaacgcctgggcccccctgcaggacctggtgatcagaggcctggccaaggcccccctgagaagagcccaggaggtggccttccagctggcccagaactggatcagaaccaacttcgacgtgtacagccagaagagcgccatgtacgagaagtacgacgtgagcaacggcggccagcccggcggcggcggcgagtacgaggtgcaggagggcttcggctggaccaacggcgtggtgctgatgctgctggacagatacggcgacagactgaccagcggccccaagctgcccttcctggagccccactgcctgggcccccccttctgccccgccagctgctag

SEQ ID NO: 103329 - DNA, 273 bp, Artificial Sequence
  Description of Artificial Sequence: Synthetic coding sequence
atggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggactggagcgccaacagcagcaccatcagaaccctgaagctgacccagctgaagcccatctacatctgcacctag

SEQ ID NO: 103330 - DNA, 654 bp, Artificial Sequence
  Description of Artificial Sequence: Synthetic coding sequence
atggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaagggcttccccggccccggcatcagaaacagcagctactactgccagtacatcaagggccagatcaacgcctggaacgacctgagaaccagcctgctgcccatcccctacctgagctgcggcaagatgtgcagcaacttcaacaactag

SEQ ID NO: 103331 - DNA, 2166 bp, Artificial Sequence
  Description of Artificial Sequence: Synthetic coding sequence
atgaccgagatcaccgccgagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaaggaccagtacgccttctgcagatacatgatcgacatcttcgtgcacggcgacctgaagcccggccagagccccgccatccccccccccctgcccaccgagcaggccagcagacccacccccgccagccccgccctggaggagaaggagggcgagaagaagaaggccgagaagaaggtgaccagcgagaccaagaagaaggagaaggaggacatcaagaagaagagcgagaaggagaccgccatcgacgtggagaagaaggagcccggcaaggccagcgagaccaagcagggcaccgtgaagatcgccgcccaggccgccgccaagaaggacgagaagaaggaggacagcaagaagaccaagaagcccgccgaggtggagcagcccaagggcaagaagcaggagaagaaggagaagcacgtggagcccgccaagagccccaagaaggagcacagcgtgcccagcgacaagcaggtgaaggccaagaccgagagagccaaggaggagatcggcgccgtgagcatcaagaaggccgtgcccggcaagaaggaggagaagaccaccaagaccgtggagcaggagatcagaaaggagaagagcggcaagaccagcagcatcctgaaggacaaggagcccatcaagggcaaggaggagaaggtgcccgccagcctgaaggagaaggagcccgagaccaagaaggacgagaagatgagcaaggccggcaaggaggtgaagcccaagcccccccagctgcagggcaagaaggaggagaagcccgagccccagatcaagaaggaggccaagcccgccatcagcgagaaggtgcagatccacaagcaggacatcgtgaagcccgagaagaccgtgagccacggcaagcccgaggagaaggtgctgaagcaggtgaaggccgtgaccatcgagaagaccgccaagcccaagcccaccaagaaggccgagcacagagagagagagccccccagcatcaagaccgacaagcccaagcccacccccaagggcaccagcgaggtgaccgagagcggcaagaagaagaccgagatcagcgagaaggagagcaaggagaaggccgacatgaagcacctgagagaggagaaggtgagcaccagaaaggagagcctgcagctgcacaacgtgaccaaggaggacgtggaggacgtgcccgccagcaagaaggccaaggagggcaccgaggacgtgagccccaccaagcagaagagccccatcagcttcttccagtgcgtgtacctggacggctacaacggctacggcttccagttccccttcacccccgccgacagacccggcgagagcagcggccaggccaacagccccggccagaagcagcagggccagtag

SEQ ID NO: 103332 - DNA, 81 bp, Artificial Sequence
  Description of Artificial Sequence: Synthetic coding sequence
tgaatccacaaggacaagaccgagaagcaggagaagcccgagagaaagatccagaccaaggaggtgggccacagcagctag

SEQ ID NO: 103333 - DNA, 456 bp, Artificial Sequence
  Description of Artificial Sequence: Synthetic coding sequence
tgaacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaagggcttccccggccccggcatcagaaacagcagctactactgccagtacatcaagggccagatcaacgcctggaacgacctgagaaccagcctgctgcccatcccctacctgagctgcggcaagatgtgcagcaacttcaacaactag

SEQ ID NO: 103334 - DNA, 2196 bp, Artificial Sequence
  Description of Artificial Sequence: Synthetic coding sequence
atcgtggagatctacccccagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaaggaccagtacgccttctgcagatacatgatcgacatcttcgtgcacggcgacctgaagcccggccagagccccgccatccccccccccctgcccaccgagcaggccagcagacccacccccgccagccccgccctggaggagaaggagggcgagaagaagaaggccgagaagaaggtgaccagcgagaccaagaagaaggagaaggaggacatcaagaagaagagcgagaaggagaccgccatcgacgtggagaagaaggtgcaggagcccggcaaggccagcgagaccaagcagggcaccgtgaagatcgccgcccaggccgccgccaagaaggacgagaagaaggaggacagcaagaagaccaagaagcccgccgaggtggagcagcccaagggcaagaagcaggagaagaaggagaagcacgtggagcccgccaagagccccaagaaggagcacagcgtgcccagcgacaagcaggtgaaggccaagaccgagagagccaaggaggagatcggcgccgtgagcatcaagaaggccgtgcccggcaagaaggaggagaagaccaccaagaccgtggagcaggagatcagaaaggagaagagcggcaagaccagcagcatcctgaaggacaaggagcccatcaagggcaaggaggagaaggtgcccgccagcctgaaggagaaggagcccgagaccaagaaggacgagaagatgagcaaggccggcaaggaggtgaagcccaagcccccccagctgcagggcaagaaggaggagaagcccgagccccagatcaagaaggaggccaagcccgccatcagcgagaaggtgcagatccacaagcaggacatcgtgaagcccgagaagaccgtgagccacggcaagcccgaggagaaggtgctgaagcaggtgaaggccgtgaccatcgagaagaccgccaagcccaagcccaccaagaaggccgagcacagagagagagagccccccagcatcaagaccgacaagcccaagcccacccccaagggcaccagcgaggtgaccgagagcggcaagaagaagaccgagatcagcgagaaggagagcaaggagaaggccgacatgaagcacctgagagaggagaaggtgagcaccagaaaggagagcctgcagctgcacaacgtgaccaaggccgaggaggtggacagcaccctggaggacgtggaggacgtgcccgccagcaagaaggccaaggagggcaccgaggacgtgagccccaccaagcagaagagccccatcagcttcttccagtgcgtgtacctggacggctacaacggctacggcttccagttccccttcacccccgccgacagacccggcgagagcagcggccaggccaacagccccggccagaagcagcagggccagtag

SEQ ID NO: 103335 - DNA, 2190 bp, Artificial Sequence
  Description of Artificial Sequence: Synthetic coding sequence
atgaccgagatcaccgccgagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaaggaccagtacgccttctgcagatacatgatcgacatcttcgtgcacggcgacctgaagcccggccagagccccgccatccccccccccctgcccaccgagcaggccagcagacccacccccgccagccccgccctggaggagaaggagggcgagaagaagaaggccgagaagaaggtgaccagcgagaccaagaagaaggagaaggaggacatcaagaagaagagcgagaaggagaccgccatcgacgtggagaagaaggagcccggcaaggccagcgagaccaagcagggcaccgtgaagatcgccgcccaggccgccgccaagaaggacgagaagaaggaggacagcaagaagaccaagaagcccgccgaggtggagcagcccaagggcaagaagcaggagaagaaggagaagcacgtggagcccgccaagagccccaagaaggagcacagcgtgcccagcgacaagcaggtgaaggccaagaccgagagagccaaggaggagatcggcgccgtgagcatcaagaaggccgtgcccggcaagaaggaggagaagaccaccaagaccgtggagcaggagatcagaaaggagaagagcggcaagaccagcagcatcctgaaggacaaggagcccatcaagggcaaggaggagaaggtgcccgccagcctgaaggagaaggagcccgagaccaagaaggacgagaagatgagcaaggccggcaaggaggtgaagcccaagcccccccagctgcagggcaagaaggaggagaagcccgagccccagatcaagaaggaggccaagcccgccatcagcgagaaggtgcagatccacaagcaggacatcgtgaagcccgagaagaccgtgagccacggcaagcccgaggagaaggtgctgaagcaggtgaaggccgtgaccatcgagaagaccgccaagcccaagcccaccaagaaggccgagcacagagagagagagccccccagcatcaagaccgacaagcccaagcccacccccaagggcaccagcgaggtgaccgagagcggcaagaagaagaccgagatcagcgagaaggagagcaaggagaaggccgacatgaagcacctgagagaggagaaggtgagcaccagaaaggagagcctgcagctgcacaacgtgaccaaggccgagaagcccgccagagtgagcaaggacgtggaggacgtgcccgccagcaagaaggccaaggagggcaccgaggacgtgagccccaccaagcagaagagccccatcagcttcttccagtgcgtgtacctggacggctacaacggctacggcttccagttccccttcacccccgccgacagacccggcgagagcagcggccaggccaacagccccggccagaagcagcagggccagtag

SEQ ID NO: 103336 - DNA, 135 bp, Artificial Sequence
  Description of Artificial Sequence: Synthetic coding sequence
tgaatccacaaggacaagaccgagaagcaggagaagcccgagagaaagatccagaccaaggactggagcgccaacagcagcaccatcagaaccctgaagctgacccagctgaagcccatctacatctgcacctag

SEQ ID NO: 103337 - DNA, 1038 bp, Artificial Sequence
  Description of Artificial Sequence: Synthetic coding sequence
atcgtggagatctacccccagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaaggaccagtacgccttctgcagatacatgatcgacatcttcgtgcacggcgacctgaagcccggccagagccccgccatccccccccccctgcccaccgagcaggccagcagacccacccccgccagccccgccctggaggagaaggagggcgagaagaagaaggccgagaagaaggtgaccagcgagaccaagaagaaggagaaggaggacatcaagaagaagaagaagaagaagaagaagaagtag

SEQ ID NO: 103338 - DNA, 504 bp, Artificial Sequence
  Description of Artificial Sequence: Synthetic coding sequence
atgaccgagatcaccgccgagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggaggtgggccacagcagctag

SEQ ID NO: 103339 - DNA, 987 bp, Artificial Sequence
  Description of Artificial Sequence: Synthetic coding sequence
atgaccgagatcaccgccgagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaaggaccagtacgccttctgcagatacatgatcgacatcttcgtgcacggcgacctgaagcccggccagagccccgccatccccccccccctgcccaccgagcaggccagcagacccacccccgccagccccgccctggagggcgacaaggccagcaaggagaagaagagaaagatgaagagaatgagcgagaagtag

SEQ ID NO: 103340 - DNA, 894 bp, Artificial Sequence
  Description of Artificial Sequence: Synthetic coding sequence
atgaccgagatcaccgccgagggcaacgccagcaccaccaccaccgtgatcgacagcaagaacggcagcgtgcccaagagccccggcaaggtgctgaagagaaccgtgaccgaggacatcgtgaccaccttcagcagccccgccgcctggctgctggtgatcgccctgatcatcacctggagcgccgtggccatcgtgatgttcgacctggtggactacaagaacttcagcgccagcagcatcgccaagatcggcagcgaccccctgaagctggtgagagacgccatggaggagaccaccgactggatctacggcttcttcagcctgctgagcgacatcatcagcagcgaggacgaggaggacgacgacggcgacgaggacaccgacaagggcgagatcgacgagccccccctgagaaagaaggagatccacaaggacaagaccgagaagcaggagaagcccgagagaaagatccagaccaaggtgacccacaaggagaaggagaagggcaaggagaaggtgagagagaaggagaagcccgagaagaaggccacccacaaggagaagatcgagaagaaggagaagcccgagaccaagaccctggccaaggagcagaagaaggccaagaccgccgagaagagcgaggagaagaccaagaaggaggtgaagggcggcaagcaggagaaggtgaagcagaccgccgccaaggtgaaggaggtgcagaagacccccagcaagcccaaggagaaggaggacaaggagaaggccgccgtgagcaagcacgagcagaagggccagagccccgccatccccccccccctgcccaccgagcaggccagcagacccacccccgccagccccgccctggagggcaagtacttcttcttcagctag

SEQ ID NO: 103341 - DNA, 5832 bp, Artificial Sequence
  Description of Artificial Sequence: Synthetic coding sequence
atgagccccctgctgagaagcatctgcgacatcaccgagatcttcaaccagtacgtgagccacgactgcgacggcgccgccctgaccaagaaggacctgaagaacctgctggagagagagttcggcgccgtgctgagaagaccccacgaccccaagaccgtggacctgatcctggagctgctggacctggacagcaacggcagagtggacttcaacgagttcctgctgttcatcttcaaggtggcccaggcctgctactacgccctgggccaggccaccggcctggacgaggagaagagagccagatgcgacggcaaggagagcctgctgcaggacagaagacaggaggaggaccagagaagattcgagcccagagacagacagctggaggaggagcccggccagagaagaagacagaagagacaggagcaggagagagagctggccgagggcgaggagcagagcgagaagcaggagagactggagcagagagacagacagagaagagacgaggagctgtggagacagagacaggagtggcaggagagagaggagagaagagccgaggaggagcagctgcagagctgcaagggccacgagaccgaggagttccccgacgaggagcagctgagaagaagagagctgctggagctgagaagaaagggcagagaggagaagcagcagcagagaagagagagacaggacagagtgttccaggaggaggaggagaaggagtggagaaagagagagaccgtgctgagaaaggaggaggagaagctgcaggaggaggagccccagagacagagagagctgcaggaggaggaggagcagctgagaaagctggagagacaggagctgagaagagagagacaggaggaggagcagcagcagcagagactgagaagagagcagcagctgagaagaaagcaggaggaggagagaagagagcagcaggaggagagaagagagcagcaggagagaagagagcagcaggaggagagaagagagcagcagctgagaagagagcaggaggagagaagagagcagcagctgagaagagagcaggaggaggagagaagagagcagcagctgagaagagagcaggaggaggagagaagagagcagcagctgagaagagagcagcagctgagaagagagcagcagctgagaagagagcagcagctgagaagagagcagcagctgagaagagagcagcagctgagaagagagcagcagctgagaagagagcagcagctgagaagagagcagcagctgagaagagagcaggaggaggagagacacgagcagaagcacgagcaggagagaagagagcagagactgaagagagagcaggaggagagaagagactggctgaagagagaggaggagaccgagagacacgagcaggagagaagaaagcagcagctgaagagagaccaggaggaggagagaagagagagatggctgaagctggaggaggaggagagaagagagcagcaggagagaagagagcagcagctgagaagagagcaggaggagagaagagagcagagactgaagagacaggaggaggaggagagactgcagcagagactgagaagcgagcagcagctgagaagagagcaggaggagagaagagagcagctgctgaagagagaggaggagaagagactggagcaggagagaagagagcagagactgaagagagagcaggaggagagaagagaccagctgctgaagagagaggaggagagaagacagcagagactgaagagagagcaggaggagagactggagcagagactgaagagagaggaggtggagagactggagcaggaggagagaagagagcagagactgaagagagaggagcccgaggaggagagaagacagcagctgctgaagagcgaggagcaggaggagagaagacagcagcagctgagaagagagcagcaggagagaagagagcagagactgaagagagaggaggaggaggagagactggagcagagactgaagagagagcacgaggaggagagaagagagcaggagctggccgaggaggagcaggagcaggccagagagagaatcaagagcagaatccccaagtggcagtggcagctggagagcgaggccgacgccagacagagcaaggtgtacagcagacccagaaagcaggagggccagagaagaagacaggagcaggaggagaagagaagaagaagagagagcgagctgcagtggcaggaggaggagagagcccacagacagcagcaggaggaggagcagagaagagacttcacctggcagtggcaggccgaggagaagagcgagagaggcagacagagactgagcgccagaccccccctgagagagcagagagagagacagctgagagccgaggagagacagcagagagagcagagattcctgcccgaggaggaggagaaggagcagagaagaagacagagaagagagagagagaaggagctgcagttcctggaggaggaggagcagctgcagagaagagagagagcccagcagctgcaggaggaggaggacggcctgcaggaggaccaggagagaagaagaagccaggagcagagaagagaccagaagtggagatggcagctggaggaggagagaaagagaagaagacacaccctgtacgccaagcccgccctgcaggagcagctgagaaaggagcagcagctgctgcaggaggaggaggaggagctgcagagagaggagagagagaagagaagaagacaggagcaggagagacagtacagagaggaggagcagctgcagcaggaggaggagcagctgctgagagaggagagagagaagagaagaagacaggagagagagagacagtacagaaaggacaagaagctgcagcagaaggaggagcagctgctgggcgaggagcccgagaagagaagaagacaggagagagagaagaagtacagagaggaggaggagctgcagcaggaggaggagcagctgctgagagaggagagagagaagagaagaagacaggagtgggagagacagtacagaaagaaggacgagctgcagcaggaggaggagcagctgctgagagaggagagagagaagagaagactgcaggagagagagagacagtacagagaggaggaggagctgcagcaggaggaggagcagctgctgggcgaggagagagagaccagaagaagacaggagctggagagacagtacagaaaggaggaggagctgcagcaggaggaggagcagctgctgagagaggagcccgagaagagaagaagacaggagagagagagacagtgcagagaggaggaggagctgcagcaggaggaggagcagctgctgagagaggagagagagaagagaagaagacaggagctggagagacagtacagagaggaggaggaggtgcagcaggaggaggagcagctgctgagagaggagcccgagaagagaagaagacaggagctggagagacagtacagagaggaggaggagctgcagcaggaggaggagcagctgctgagagaggagcaggagaagagaagacaggagagagagagacagtacagagaggaggaggagctgcagagacagaagagaaagcagagatacagagacgaggaccagagaagcgacctgaagtggcagtgggagcccgagaaggagaacgccgtgagagacaacaaggtgtactgcaagggcagagagaacgagcagttcagacagctggaggacagccagctgagagacagacagagccagcaggacctgcagcacctgctgggcgagcagcaggagagagacagagagcaggagagaagaagatggcagcagagagacagacacttccccgaggaggagcagctggagagagaggagcagaaggaggccaagagaagagacagaaagagccaggaggagaagcagctgctgagagaggagagagaggagaagagaagaagacaggagaccgacagaaagttcagagaggaggagcagctgctgcaggagagagaggagcagcccctgagaagacaggagagagacagaaagttcagagaggaggagctgagacaccaggagcagggcagaaagttcctggaggaggagcagagactgagaagacaggagagagagagaaagttcctgaaggaggagcagcagctgagatgccaggagagagagcagcagctgagacaggacagagacagaaagttcagagaggaggagcagcagctgagcagacaggagagagacagaaagttcagagaggaggagcagcaggtgagaagacaggagagagagagaaagttcctggaggaggagcagcagctgagacaggagagacacagaaagttcagagaggaggagcagctgctgcaggagagagaggagcagcagctgcacagacaggagagagacagaaagttcctggaggaggagcagcagctgagaagacaggagagagacagaaagttcagagagcaggagctgagaagccaggagcccgagagaaagttcctggaggaggagcagcagctgcacagacagcagagacagagaaagttcctgcaggaggagcagcagctgagaagacaggagagaggccagcagagaagacaggacagagacagaaagttcagagaggaggagcagctgagacaggagagagaggagcagcagctgagcagacaggagagagacagaaagttcagactggaggagcagaaggtgagaagacaggagcaggagagaaagttcatggaggacgagcagcagctgagaagacaggagggccagcagcagctgagacaggagagagacagaaagttcagagaggacgagcagctgctgcaggagagagaggagcagcagctgcacagacaggagagagacagaaagttcctggaggaggagccccagctgagaagacaggagagagagcagcagctgagacacgacagagacagaaagttcagagaggaggagcagctgctgcaggagggcgaggagcagcagctgagaagacaggagagagacagaaagttcagagaggaggagcagcagctgagaagacaggagagagagagaaagttcctgcaggaggagcagcagctgagaagacaggagctggagagaaagttcagagaggaggagcagctgagacaggagaccgagcaggagcagctgagaagacaggagagatacagaaagatcctggaggaggagcagctgagacccgagagagaggagcagcagctgagaagacaggagagagacagaaagttcagagaggaggagcagctgagacaggagagagaggagcagcagctgagaagccaggagagcgacagaaagttcagagaggaggagcagctgagacaggagagagaggagcagcagctgagaccccagcagagagacggcaagtacagatgggaggaggagcagctgcagctggaggagcaggagcagagactgagacaggagagagacagacagtacagagccgaggagcagttcgccacccaggagaagagcagaagagaggagcaggagctgtggcaggaggaggagcagaagagaagacaggagagagagagaaagctgagagaggagcacatcagaagacagcagaaggaggagcagagacacagacaggtgggcgagatcaagagccaggagggcaagggccacggcagactgctggagcccggcacccaccagttcgccagcgtgcccgtgagaagcagccccctgtacgagtacatccaggagcagagaagccagtacagaccctag

SEQ ID NO: 103342 - DNA, 540 bp, Artificial Sequence
  Description of Artificial Sequence: Synthetic coding sequence
atggccaagaccgccatggcctacaaggagaagatgaaggagctgagcatgctgagcctgatctgcagctgcttctaccccgagcccagaaacatcaacatctacacctacgacgacatggaggtgaagcagatcaacaagagagccagcggccaggccttcgagctgatcctgaagccccccagccccatcagcgaggcccccagaaccctggccagccccaagaagaaggacctgagcctggaggagatccagaagaagctggaggccgccgaggagagaagaaagagccaggaggcccaggtgctgaagcagctggccgagaagagagagcacgagagagaggtgctgcagaaggccctggaggagaacaacaacttcagcaagatggccgaggagaagctgatcctgaagatggagcagatcaaggagaacagagaggccaacctggccgccatcatcgagagactgcaggagaaggagagacacgccgccgaggtgagaagaaacaaggagctgcaggtggagctgagcggctag

SEQ ID NO: 103343 - DNA, 3885 bp, Artificial Sequence
  Description of Artificial Sequence: Synthetic coding sequence
atgccctacgaggtgaacgccggctacgacttcaccaacatggtgagaaagaagaacccccccctgagaaacgtggccagcgagggcgagggccagatcctggagcccatcggcaccgagagcaaggtgagcggcaagaacaaggagttcagcgccgaccagatgagcgagaacaccgaccagagcgacgccgccgagctgaaccacaaggaggagcacagcctgcacgtgcaggaccccagcagcagcagcaagaaggacctgaagagcgccgtgctgagcgagaaggccggcttcaactacgagagccccagcaagggcggcaacttccccagcttcccccacgacgaggtgaccgacagaaacatgctggccttcagcagccccgccgccggcggcgtgtgcgagcccctgaagagcccccagagagccgaggccgacgacccccaggacatggcctgcacccccagcggcgacagcctggagaccaaggaggaccagaagatgagccccaaggccaccgaggagaccggccaggcccagagcggccaggccaactgccagggcctgagccccgtgagcgtggccagcaagaacccccaggtgcccagcgacggcggcgtgagactgaacaagagcaagaccgacctgctggtgaacgacaaccccgaccccgcccccctgagccccgagctgcaggacttcaagtgcaacatctgcggctacggctactacggcaacgaccccaccgacctgatcaagcacttcagaaagtaccacctgggcctgcacaacagaaccagacaggacgccgagctggacagcaagatcctggccctgcacaacatggtgcagttcagccacagcaaggacttccagaaggtgaacagaagcgtgttcagcggcgtgctgcaggacatcaacagcagcagacccgtgctgctgaacggcacctacgacgtgcaggtgaccagcggcggcaccttcatcggcatcggcagaaagacccccgactgccagggcaacaccaagtacttcagatgcaagttctgcaacttcacctacatgggcaacagcagcaccgagctggagcagcacttcctgcagacccaccccaacaagatcaaggccagcctgcccagcagcgaggtggccaagcccagcgagaagaacagcaacaagagcatccccgccctgcagagcagcgacagcggcgacctgggcaagtggcaggacaagatcaccgtgaaggccggcgacgacacccccgtgggctacagcgtgcccatcaagcccctggacagcagcagacagaacggcaccgaggccaccagctactactggtgcaagttctgcagcttcagctgcgagagcagcagcagcctgaagctgctggagcactacggcaagcagcacggcgccgtgcagagcggcggcctgaaccccgagctgaacgacaagctgagcagaggcagcgtgatcaaccagaacgacctggccaagagcagcgagggcgagaccatgaccaagaccgacaagagcagcagcggcgccaagaagaaggacttcagcagcaagggcgccgaggacaacatggtgaccagctacaactgccagttctgcgacttcagatacagcaagagccacggccccgacgtgatcgtggtgggccccctgctgagacactaccagcagctgcacaacatccacaagtgcaccatcaagcactgccccttctgccccagaggcctgtgcagccccgagaagcacctgggcgagatcacctaccccttcgcctgcagaaagagcaactgcagccactgcgccctgctgctgctgcacctgagccccggcgccgccggcagcagcagagtgaagcaccagtgccaccagtgcagcttcaccacccccgacgtggacgtgctgctgttccactacgagagcgtgcacgagagccaggccagcgacgtgaagcaggaggccaaccacctgcagggcagcgacggccagcagagcgtgaaggagagcaaggagcacagctgcaccaagtgcgacttcatcacccaggtggaggaggagatcagcagacactacagaagagcccacagctgctacaagtgcagacagtgcagcttcaccgccgccgacacccagagcctgctggagcacttcaacaccgtgcactgccaggagcaggacatcaccaccgccaacggcgaggaggacggccacgccatcagcaccatcaaggaggagcccaagatcgacttcagagtgtacaacctgctgacccccgacagcaagatgggcgagcccgtgagcgagagcgtggtgaagagagagaagctggaggagaaggacggcctgaaggagaaggtgtggaccgagagcagcagcgacgacctgagaaacgtgacctggagaggcgccgacatcctgagaggcagccccagctacacccaggccagcctgggcctgctgacccccgtgagcggcacccaggagcagaccaagaccctgagagacagccccaacgtggaggccgcccacctggccagacccatctacggcctggccgtggagaccaagggcttcctgcagggcgcccccgccggcggcgagaagagcggcgccctgccccagcagtaccccgccagcggcgagaacaagagcaaggacgagagccagagcctgctgagaagaagaagaggcagcggcgtgttctgcgccaactgcctgaccaccaagaccagcctgtggagaaagaacgccaacggcggctacgtgtgcaacgcctgcggcctgtaccagaagctgcacagcacccccagacccctgaacatcatcaagcagaacaacggcgagcagatcatcagaagaagaaccagaaagagactgaaccccgaggccctgcaggccgagcagctgaacaagcagcagagaggcagcaacgaggagcaggtgaacggcagccccctggagagaagaagcgaggaccacctgaccgagagccaccagagagagatccccctgcccagcctgagcaagtacgaggcccagggcagcctgaccaagagccacagcgcccagcagcccgtgctggtgagccagaccctggacatccacaagagaatgcagcccctgcacatccagatcaagagcccccaggagagcaccggcgaccccggcaacagcagcagcgtgagcgagggcaagggcagcagcgagagaggcagccccatcgagaagtacatgagacccgccaagcaccccaactacagcccccccggcagccccatcgagaagtaccagtaccccctgttcggcctgcccttcgtgcacaacgacttccagagcgaggccgactggctgagattctggagcaagtacaagctgagcgtgcccggcaacccccactacctgagccacgtgcccggcctgcccaacccctgccagaactacgtgccctaccccaccttcaacctgcccccccacttcagcgccgtgggcagcgacaacgacatccccctggacctggccatcaagcacagcagacccggccccaccgccaacggcgccagcaaggagaagaccaaggccccccccaacgtgaagaacgagggccccctgaacgtggtgaagaccgagaaggtggacagaagcacccaggacgagctgagcaccaagtgcgtgcactgcggcatcgtgttcctggacgaggtgatgtacgccctgcacatgagctgccacggcgacagcggccccttccagtgcagcatctgccagcacctgtgcaccgacaagtacgacttcaccacccacatccagagaggcctgcacagaaacaacgcccaggtggagaagaacggcaagcccaaggagtag

SEQ ID NO: 103344 - DNA, 3858 bp, Artificial Sequence
  Description of Artificial Sequence: Synthetic coding sequence
atgcagagcaacatggtgagaaagaagaacccccccctgagaaacgtggccagcgagggcgagggccagatcctggagcccatcggcaccgagagcaaggtgagcggcaagaacaaggagttcagcgccgaccagatgagcgagaacaccgaccagagcgacgccgccgagctgaaccacaaggaggagcacagcctgcacgtgcaggaccccagcagcagcagcaagaaggacctgaagagcgccgtgctgagcgagaaggccggcttcaactacgagagccccagcaagggcggcaacttccccagcttcccccacgacgaggtgaccgacagaaacatgctggccttcagcagccccgccgccggcggcgtgtgcgagcccctgaagagcccccagagagccgaggccgacgacccccaggacatggcctgcacccccagcggcgacagcctggagaccaaggaggaccagaagatgagccccaaggccaccgaggagaccggccaggcccagagcggccaggccaactgccagggcctgagccccgtgagcgtggccagcaagaacccccaggtgcccagcgacggcggcgtgagactgaacaagagcaagaccgacctgctggtgaacgacaaccccgaccccgcccccctgagccccgagctgcaggacttcaagtgcaacatctgcggctacggctactacggcaacgaccccaccgacctgatcaagcacttcagaaagtaccacctgggcctgcacaacagaaccagacaggacgccgagctggacagcaagatcctggccctgcacaacatggtgcagttcagccacagcaaggacttccagaaggtgaacagaagcgtgttcagcggcgtgctgcaggacatcaacagcagcagacccgtgctgctgaacggcacctacgacgtgcaggtgaccagcggcggcaccttcatcggcatcggcagaaagacccccgactgccagggcaacaccaagtacttcagatgcaagttctgcaacttcacctacatgggcaacagcagcaccgagctggagcagcacttcctgcagacccaccccaacaagatcaaggccagcctgcccagcagcgaggtggccaagcccagcgagaagaacagcaacaagagcatccccgccctgcagagcagcgacagcggcgacctgggcaagtggcaggacaagatcaccgtgaaggccggcgacgacacccccgtgggctacagcgtgcccatcaagcccctggacagcagcagacagaacggcaccgaggccaccagctactactggtgcaagttctgcagcttcagctgcgagagcagcagcagcctgaagctgctggagcactacggcaagcagcacggcgccgtgcagagcggcggcctgaaccccgagctgaacgacaagctgagcagaggcagcgtgatcaaccagaacgacctggccaagagcagcgagggcgagaccatgaccaagaccgacaagagcagcagcggcgccaagaagaaggacttcagcagcaagggcgccgaggacaacatggtgaccagctacaactgccagttctgcgacttcagatacagcaagagccacggccccgacgtgatcgtggtgggccccctgctgagacactaccagcagctgcacaacatccacaagtgcaccatcaagcactgccccttctgccccagaggcctgtgcagccccgagaagcacctgggcgagatcacctaccccttcgcctgcagaaagagcaactgcagccactgcgccctgctgctgctgcacctgagccccggcgccgccggcagcagcagagtgaagcaccagtgccaccagtgcagcttcaccacccccgacgtggacgtgctgctgttccactacgagagcgtgcacgagagccaggccagcgacgtgaagcaggaggccaaccacctgcagggcagcgacggccagcagagcgtgaaggagagcaaggagcacagctgcaccaagtgcgacttcatcacccaggtggaggaggagatcagcagacactacagaagagcccacagctgctacaagtgcagacagtgcagcttcaccgccgccgacacccagagcctgctggagcacttcaacaccgtgcactgccaggagcaggacatcaccaccgccaacggcgaggaggacggccacgccatcagcaccatcaaggaggagcccaagatcgacttcagagtgtacaacctgctgacccccgacagcaagatgggcgagcccgtgagcgagagcgtggtgaagagagagaagctggaggagaaggacggcctgaaggagaaggtgtggaccgagagcagcagcgacgacctgagaaacgtgacctggagaggcgccgacatcctgagaggcagccccagctacacccaggccagcctgggcctgctgacccccgtgagcggcacccaggagcagaccaagaccctgagagacagccccaacgtggaggccgcccacctggccagacccatctacggcctggccgtggagaccaagggcttcctgcagggcgcccccgccggcggcgagaagagcggcgccctgccccagcagtaccccgccagcggcgagaacaagagcaaggacgagagccagagcctgctgagaagaagaagaggcagcggcgtgttctgcgccaactgcctgaccaccaagaccagcctgtggagaaagaacgccaacggcggctacgtgtgcaacgcctgcggcctgtaccagaagctgcacagcacccccagacccctgaacatcatcaagcagaacaacggcgagcagatcatcagaagaagaaccagaaagagactgaaccccgaggccctgcaggccgagcagctgaacaagcagcagagaggcagcaacgaggagcaggtgaacggcagccccctggagagaagaagcgaggaccacctgaccgagagccaccagagagagatccccctgcccagcctgagcaagtacgaggcccagggcagcctgaccaagagccacagcgcccagcagcccgtgctggtgagccagaccctggacatccacaagagaatgcagcccctgcacatccagatcaagagcccccaggagagcaccggcgaccccggcaacagcagcagcgtgagcgagggcaagggcagcagcgagagaggcagccccatcgagaagtacatgagacccgccaagcaccccaactacagcccccccggcagccccatcgagaagtaccagtaccccctgttcggcctgcccttcgtgcacaacgacttccagagcgaggccgactggctgagattctggagcaagtacaagctgagcgtgcccggcaacccccactacctgagccacgtgcccggcctgcccaacccctgccagaactacgtgccctaccccaccttcaacctgcccccccacttcagcgccgtgggcagcgacaacgacatccccctggacctggccatcaagcacagcagacccggccccaccgccaacggcgccagcaaggagaagaccaaggccccccccaacgtgaagaacgagggccccctgaacgtggtgaagaccgagaaggtggacagaagcacccaggacgagctgagcaccaagtgcgtgcactgcggcatcgtgttcctggacgaggtgatgtacgccctgcacatgagctgccacggcgacagcggccccttccagtgcagcatctgccagcacctgtgcaccgacaagtacgacttcaccacccacatccagagaggcctgcacagaaacaacgcccaggtggagaagaacggcaagcccaaggagtag

SEQ ID NO: 103345 - DNA, 705 bp, Artificial Sequence
  Description of Artificial Sequence: Synthetic coding sequence
atgagaaagaccagactgtggggcctgctgtggatgctgttcgtgagcgagctgagagccgccaccaagctgaccgaggagaagtacgagctgaaggagggccagaccctggacgtgaagtgcgactacaccctggagaagttcgccagcagccagaaggcctggcagatcatcagagacggcgagatgcccaagaccctggcctgcaccgagagacccagcaagaacagccaccccgtgcaggtgggcagaatcatcctggaggactaccacgaccacggcctgctgagagtgagaatggtgaacctgcaggtggaggacagcggcctgtaccagtgcgtgatctaccagccccccaaggagccccacatgctgttcgacagaatcagactggtggtgaccaagggcttcagcggcacccccggcagcaacgagaacagcacccagaacgtgtacaagatcccccccaccaccaccaaggccctgtgccccctgtacaccagccccagaaccgtgacccaggccccccccaagagcaccgccgacgtgagcacccccgacagcgagatcaacctgaccaacgtgaccgacatcatcagagtgcccgtgttcaacatcgtgatcctgctggccggcggcttcctgagcaagagcctggtgttcagcgtgctgttcgccgtgaccctgagaagcttcgtgccctag

SEQ ID NO: 103346 - DNA, 453 bp, Artificial Sequence
  Description of Artificial Sequence: Synthetic coding sequence
atgagaaagaccagactgtggggcctgctgtggatgctgttcgtgagcgagctgagagccgccaccaagctgaccgaggagaagtacgagctgaaggagggccagaccctggacgtgaagtgcgactacaccctggagaagttcgccagcagccagaaggcctggcagatcatcagagacggcgagatgcccaagaccctggcctgcaccgagagacccagcaagaacagccaccccgtgcaggtgggcagaatcatcctggaggactaccacgaccacggcctgctgagagtgagaatggtgaacctgcaggtggaggacagcggcctgtaccagtgcgtgatctaccagccccccaaggagccccacatgctgttcgacagaatcagactggtggtgaccaagggcttcagatgcagcaccctgagcttcagctggctggtggacagctag

SEQ ID NO: 103347 - DNA, 678 bp, Artificial Sequence
  Description of Artificial Sequence: Synthetic coding sequence
atgagaaagaccagactgtggggcctgctgtggatgctgttcgtgagcgagctgagagccgccaccaagctgaccgaggagaagtacgagctgaaggagggccagaccctggacgtgaagtgcgactacaccctggagaagttcgccagcagccagaaggcctggcagatcatcagagacggcgagatgcccaagaccctggcctgcaccgagagacccagcaagaacagccaccccgtgcaggtgggcagaatcatcctggaggactaccacgaccacggcctgctgagagtgagaatggtgaacctgcaggtggaggacagcggcctgtaccagtgcgtgatctaccagccccccaaggagccccacatgctgttcgacagaatcagactggtggtgaccaagggcttcagcggcacccccggcagcaacgagaacagcacccagaacgtgtacaagatcccccccaccaccaccaaggccctgtgccccctgtacaccagccccagaaccgtgacccaggccccccccaagagcaccgccgacgtgagcacccccgacagcgagatcaacctgaccaacgtgaccgacatcatcagatacagcttccaggtgcccggccccctggtgtggaccctgagccccctgttccccagcctgtgcgccgagagaatgtag

SEQ ID NO: 103348 - DNA, 501 bp, Artificial Sequence
  Description of Artificial Sequence: Synthetic coding sequence
atggagcccctgagactgctgatcctgctgttcgtgaccgagctgagcggcgcccacaacaccaccgtgttccagggcgtggccggccagagcctgcaggtgagctgcccctacgacagcatgaagcactggggcagaagaaaggcctggtgcagacagctgggcgagaagggcccctgccagagagtggtgagcacccacaacctgtggctgctgagcttcctgagaagatggaacggcagcaccgccatcaccgacgacaccctgggcggcaccctgaccatcaccctgagaaacctgcagccccacgacgccggcctgtaccagtgccagagcctgcacggcagcgaggccgacaccctgagaaaggtgctggtggaggtgctggccgaccccctggaccacagagacgccggcgacctgtggttccccggcgagagcgagagcttcgaggacgcccacgtggagcacagcatcagcagagccgagagacacgtgtag

SEQ ID NO: 103349 - DNA, 693 bp, Artificial Sequence
  Description of Artificial Sequence: Synthetic coding sequence
atggagcccctgagactgctgatcctgctgttcgtgaccgagctgagcggcgcccacaacaccaccgtgttccagggcgtggccggccagagcctgcaggtgagctgcccctacgacagcatgaagcactggggcagaagaaaggcctggtgcagacagctgggcgagaagggcccctgccagagagtggtgagcacccacaacctgtggctgctgagcttcctgagaagatggaacggcagcaccgccatcaccgacgacaccctgggcggcaccctgaccatcaccctgagaaacctgcagccccacgacgccggcctgtaccagtgccagagcctgcacggcagcgaggccgacaccctgagaaaggtgctggtggaggtgctggccgaccccctggaccacagagacgccggcgacctgtggttccccggcgagagcgagagcttcgaggacgcccacgtggagcacagcatcagcagaagcctgctggagggcgagatccccttcccccccaccagcatcctgctgctgctggcctgcatcttcctgatcaagatcctggccgccagcgccctgtgggccgccgcctggcacggccagaagcccggcacccacccccccagcgagctggactgcggccacgaccccggctaccagctgcagaccctgcccggcctgagagacacctag

SEQ ID NO: 103350 - DNA, 660 bp, Artificial Sequence
  Description of Artificial Sequence: Synthetic coding sequence
atggagcccctgagactgctgatcctgctgttcgtgaccgagctgagcggcgcccacaacaccaccgtgttccagggcgtggccggccagagcctgcaggtgagctgcccctacgacagcatgaagcactggggcagaagaaaggcctggtgcagacagctgggcgagaagggcccctgccagagagtggtgagcacccacaacctgtggctgctgagcttcctgagaagatggaacggcagcaccgccatcaccgacgacaccctgggcggcaccctgaccatcaccctgagaaacctgcagccccacgacgccggcctgtaccagtgccagagcctgcacggcagcgaggccgacaccctgagaaaggtgctggtggaggtgctggccgaccccctggaccacagagacgccggcgacctgtggttccccggcgagagcgagagcttcgaggacgcccacgtggagcacagcatcagcagagccgagagacacgtgaaggaggacgacggcagaaagagccccggcgaggtgccccccggcaccagccccgcctgcatcctggccacctggccccccggcctgctggtgctgctgtggcaggagaccaccctgcccgagcactgcttcagctggaccctggaggccggcaccggctag

SEQ ID NO: 103351 - DNA, 936 bp, Artificial Sequence
  Description of Artificial Sequence: Synthetic coding sequence
atgggcctgaccctgctgctgctgctgctgctgggcctggagggccagggcatcgtgggcagcctgcccgaggtgctgcaggcccccgtgggcagcagcatcctggtgcagtgccactacagactgcaggacgtgaaggcccagaaggtgtggtgcagattcctgcccgagggctgccagcccctggtgagcagcgccgtggacagaagagcccccgccggcagaagaaccttcctgaccgacctgggcggcggcctgctgcaggtggagatggtgaccctgcaggaggaggacgccggcgagtacggctgcatggtggacggcgccagaggcccccagatcctgcacagagtgagcctgaacatcctgccccccgaggaggaggaggagacccacaagatcggcagcctggccgagaacgccttcagcgaccccgccggcagcgccaaccccctggagcccagccaggacgagaagagcatccccctgatctggggcgccgtgctgctggtgggcctgctggtggccgccgtggtgctgttcgccgtgatggccaagagaaagcagggcaacagactgggcgtgtgcggcagattcctgagcagcagagtgagcggcatgaaccccagcagcgtggtgcaccacgtgagcgacagcggccccgccgccgagctgcccctggacgtgccccacatcagactggacagcccccccagcttcgacaacaccacctacaccagcctgcccctggacagccccagcggcaagcccagcctgcccgcccccagcagcctgccccccctgccccccaaggtgctggtgtgcagcaagcccgtgacctacgccaccgtgatcttccccggcggcaacaagggcggcggcaccagctgcggccccgcccagaacccccccaacaaccagacccccagcagctag

SEQ ID NO: 103352 - DNA, 600 bp, Artificial Sequence
  Description of Artificial Sequence: Synthetic coding sequence
atgggcctgaccctgctgctgctgctgctgctgggcctggagggccagggcatcgtgggcagcctgcccgaggtgctgcaggcccccgtgggcagcagcatcctggtgcagtgccactacagactgcaggacgtgaaggcccagaaggtgtggtgcagattcctgcccgagggctgccagcccctggtgagcagcgccgtggacagaagagcccccgccggcagaagaaccttcctgaccgacctgggcggcggcctgctgcaggtggagatggtgaccctgcaggaggaggacgccggcgagtacggctgcatggtggacggcgccagaggcccccagatcctgcacagagtgagcctgaacatcctgccccccgaggaggaggaggagacccacaagatcggcagcctggccgagaacgccttcagcgaccccgccggcagcgccaaccccctggagcccagccaggacgagaagagcatccccctgatctggggcgccgtgctgctggtgggcctgctggtggccgccgtggtgctgttcgccgtgatggccaagagaaagcaggagagcctgctgagcggcccccccagacagtag

SEQ ID NO: 103353 - DNA, 603 bp, Artificial Sequence
  Description of Artificial Sequence: Synthetic coding sequence
atgggcctgaccctgctgctgctgctgctgctgggcctggaggaggaggaggaggagacccacaagatcggcagcctggccgagaacgccttcagcgaccccgccggcagcgccaaccccctggagcccagccaggacgagaagagcatccccctgatctggggcgccgtgctgctggtgggcctgctggtggccgccgtggtgctgttcgccgtgatggccaagagaaagcagggcaacagactgggcgtgtgcggcagattcctgagcagcagagtgagcggcatgaaccccagcagcgtggtgcaccacgtgagcgacagcggccccgccgccgagctgcccctggacgtgccccacatcagactggacagcccccccagcttcgacaacaccacctacaccagcctgcccctggacagccccagcggcaagcccagcctgcccgcccccagcagcctgccccccctgccccccaaggtgctggtgtgcagcaagcccgtgacctacgccaccgtgatcttccccggcggcaacaagggcggcggcaccagctgcggccccgcccagaacccccccaacaaccagacccccagcagctag

SEQ ID NO: 103354 - DNA, 966 bp, Artificial Sequence
  Description of Artificial Sequence: Synthetic coding sequence
atggcccccgccttcctgctgctgctgctgctgtggccccagggctgcgtgagcggccccagcgccgacagcgtgtacaccaaggtgagactgctggagggcgagaccctgagcgtgcagtgcagctacaagggctacaagaacagagtggagggcaaggtgtggtgcaagatcagaaagaagaagtgcgagcccggcttcgccagagtgtgggtgaagggccccagatacctgctgcaggacgacgcccaggccaaggtggtgaacatcaccatggtggccctgaagctgcaggacagcggcagatactggtgcatgagaaacaccagcggcatcctgtaccccctgatgggcttccagctggacgtgagccccgccccccagaccgagagaaacatccccttcacccacctggacaacatcctgaagagcggcaccgtgaccaccggccaggcccccaccagcggccccgacgcccccttcaccaccggcgtgatggtgttcacccccggcctgatcaccctgcccagactgctggccagcaccagacccgccagcaagaccggctacagcttcaccgccaccagcaccaccagccagggccccagaagaaccatgggcagccagaccgtgaccgccagccccagcaacgccagagacagcagcgccggccccgagagcatcagcaccaagagcggcgacctgagcaccagaagccccaccaccggcctgtgcctgaccagcagaagcctgctgaacagactgcccagcatgcccagcatcagacaccaggacgtgtacagcaccgtgctgggcgtggtgctgaccctgctggtgctgatgctgatcatggtgtacggcttctggaagaagagacacatggccagctacagcatgtgcagcgaccccagcaccagagacccccccggcagacccgagccctacgtggaggtgtacctgatctag

SEQ ID NO: 103355 - DNA, 2562 bp, Artificial Sequence
  Description of Artificial Sequence: Synthetic coding sequence
atgtgctgcgagaagtggagcagagtggccgagatgttcctgttcatcgaggagagagaggactgcaagatcctgtgcctgtgcagcagagccttcgtggaggacagaaagctgtacaacctgggcctgaagggctactacatcagagacagcggcaacaacagcggcgaccaggccaccgaggaggaggagggcggctacagctgcggcaccgccgagagccacgacagcaagggcatcggcctggacgagagcgagctggacagcgaggccgagctgatgagaagcatgggcctgcccctgcagttcggcagaatcaccgcccacaaggacttcgaggtgagcatgaacaccagaaacaaggtgaagatcaagaagaagaagcaccagaagaagtacctggacgagatcgtgcaggagagctggagaaaggagtacgaggaggacgacatcctggccagcgacgaccccagcagcatcgagcagtacgagaacaccagaacctacgagctgcagagcaagaaggacaccgagaccgagaacccccccgtggagaacaccctgagccccaagctggagatcaccgagaagtgggagaagtactggaacgagtacggcggcggcctgctgtggcagagctggcaggagaagcaccccggccaggccctgagcagcgagccctggaacttccccgacaccaaggaggagtgggagcagcactacagccagctgtactggtactacctggagcagttccagtactgggaggcccagggctggaccttcgacgccagccagagctgcgacaccgacacctacaccagcaagaccgaggccgacgacaagaacgacgagaagtgcatgaaggtggacctggtgagcttccccagcagccccatcatggtggacaacgacagcagcggcaccagcgacaaggaccacagcgagatcctggacggcatcagcaacatcaagctgaacagcgaggaggtgacccagagccagctggacagctgcaccagccacgacggccaccagcagctgagcgaggtgagcagcaagagagagtgccccgccagcggccagagcgagcccagaaacggcggcaccaacgaggagagcaacagcagcggcaacaccaacaccgacccccccgccgaggacagccagaagagcagcggcgccaacaccagcaaggacagaccccacgccagcggcaccgacggcgacgagagcgaggaggacccccccgagcacaagcccagcaagctgaagagaagccacgagctggacatcgacgagaaccccgccagcgacttcgacgacagcggcagcctgctgggcttcaagtacggcagcggccagaagtacggcggcatccccaacttcagccacagacaggtgagatacctggagaagaacgtgaagctgaagagcaagtacctggacatgagaagacagatcaagatgaagaacaagcacatcttcttcaccaaggagagcgagaagcccttcttcaagaagagcaagatcctgagcaaggtggagaagttcctgacctgggtgaacaagcccatggacgaggaggccagccaggagagcagcagccacgacaacgtgcacgacgccagcaccagcagcgacagcgaggagcaggacatgagcgtgaagaagggcgacgacctgctggagaccaacaaccccgagcccgagaagtgccagagcgtgagcagcgccggcgagctggagaccgagaactacgagagagacagcctgctggccaccgtgcccgacgagcaggactgcgtgacccaggaggtgcccgacagcagacaggccgagaccgaggccgaggtgaagaagaagaagaacaagaagaagaacaagaaggtgaacggcctgccccccgagatcgccgccgtgcccgagctggccaagtactgggcccagagatacagactgttcagcagattcgacgacggcatcaagctggacagagagggctggttcagcgtgacccccgagaagatcgccgagcacatcgccggcagagtgagccagagcttcaagtgcgacgtggtggtggacgccttctgcggcgtgggcggcaacaccatccagttcgccctgaccggcatgagagtgatcgccatcgacatcgaccccgtgaagatcgccctggccagaaacaacgccgaggtgtacggcatcgccgacaagatcgagttcatctgcggcgacttcctgctgctggccagcttcctgaaggccgacgtggtgttcctgagccccccctggggcggccccgactacgccaccgccgagaccttcgacatcagaaccatgatgagccccgacggcttcgagatcttcagactgagcaagaagatcaccaacaacatcgtgtacttcctgcccagaaacgccgacatcgaccaggtggccagcctggccggccccggcggccaggtggagatcgagcagaacttcctgaacaacaagctgaagaccatcaccgcctacttcggcgacctgatcagaagacccgccagcgagacctag

SEQ ID NO: 103356 - DNA, 1266 bp, Artificial Sequence
  Description of Artificial Sequence: Synthetic coding sequence
atgtggtaccacagactgagccacctgcacagcagactgcaggacctgctgaagggcggcgtgatctaccccgccctgccccagcccaacttcaagagcctgctgcccctggccgtgcactggcaccacaccgccagcaagagcctgacctgcgcctggcagcagcacgaggaccacttcgagctgaagtacgccaacaccgtgatgagattcgactacgtgtggctgagagaccactgcagaagcgccagctgctacaacagcaagacccaccagagaagcctggacaccgccagcgtggacctgtgcatcaagcccaagaccatcagactggacgagaccaccctgttcttcacctggcccgacggccacgtgaccaagtacgacctgaactggctggtgaagaacagctacgagggccagaagcagaaggtgatccagcccagaatcctgtggaacgccgagatctaccagcaggcccaggtgcccagcgtggactgccagagcttcctggagaccaacgagggcctgaagaagttcctgcagaacttcctgctgtacggcatcgccttcgtggagaacgtgccccccacccaggagcacaccgagaagctggccgagagaatcagcctgatcagagagaccatctacggcagaatgtggtacttcaccagcgacttcagcagaggcgacaccgcctacaccaagctggccctggacagacacaccgacaccacctacttccaggagccctgcggcatccaggtgttccactgcctgaagcacgagggcaccggcggcagaaccctgctggtggacggcttctacgccgccgagcaggtgctgcagaaggcccccgaggagttcgagctgctgagcaaggtgcccctgaagcacgagtacatcgaggacgtgggcgagtgccacaaccacatgatcggcatcggccccgtgctgaacatctacccctggaacaaggagctgtacctgatcagatacaacaactacgacagagccgtgatcaacaccgtgccctacgacgtggtgcacagatggtacaccgcccacagaaccctgaccatcgagctgagaagacccgagaacgagttctgggtgaagctgaagcccggcagagtgctgttcatcgacaactggagagtgctgcacggcagagagtgcttcaccggctacagacagctgtgcggctgctacctgaccagagacgacgtgctgaacaccgccagactgctgggcctgcaggcctag

SEQ ID NO: 103357 - DNA, 1131 bp, Artificial Sequence
  Description of Artificial Sequence: Synthetic coding sequence
atgtggtaccacagactgagccacctgcacagcagactgcaggacctgctgaagggcggcgtgatctaccccgccctgccccagcccaacttcaagagcctgctgcccctggccgtgcactggcaccacaccgccagcaagagcctgacctgcgcctggcagcagcacgaggaccacttcgagctgaagtacgccaacaccgtgatgagattcgactacgtgtggctgagagaccactgcagaagcgccagctgctacaacagcaagacccaccagagaagcctggacaccgccagcgtggacctgtgcatcaagcccaagaccatcagactggacgagaccaccctgttcttcacctggcccgacggccacgtgaccaagtacgacctgaactggctggtgaagaacagctacgagggccagaagcagaaggtgatccagcccagaatcctgtggaacgccgagatctaccagcaggcccaggtgcccagcgtggactgccagagcttcctggagaccaacgagggcctgaagaagttcctgcagaacttcctgctgtacggcatcgccttcgtggagaacgtgccccccacccaggagcacaccgagaagctggccgagagaatcagcctgatcagagagaccatctacggcagaatgtggtacttcaccagcgacttcagcagaggcgacaccgcctacaccaagctggccctggacagacacaccgacaccacctacttccaggagccctgcggcatccaggtgttccactgcctgaagcacgagggcaccggcggcagaaccctgctggtggacggcttctacgccgccgagcaggtgctgcagaaggcccccgaggagttcgagctgctgagcaaggtgcccctgaagcacgagtacatcgaggacgtgggcgagtgccacaaccacatgatcggcatcggccccgtgctgaacatctacccctggaacaaggagctgtacctgatcagactgttcaaggagaagcagaacaccgtgaacagacagtggaacagcagcctgcagtgcgacatccccgagagaatcctgacctacagacacttcgtgagcggcaccagcatcgagcacagaggcagcctgatctag

SEQ ID NO: 103358 - DNA, 5889 bp, Artificial Sequence
  Description of Artificial Sequence: Synthetic coding sequence
atgagagagctggaggccaaggccaccaaggacgtggagagaaacctgagcagagacctggtgcaggaggaggagcagctgatggaggagaagaagaagaagaaggacgacaagaagaagaaggaggccgcccagaagaaggccaccgagcagaagatcaaggtgcccgagcagatcaagcccagcgtgagccagccccagcccgccaacagcaacaacggcaccagcaccgccaccagcaccaacaacaacgccaagagagccaccgccaacaaccagcagccccagcagcagcagcagcagcagcagccccagcagcagcagccccagcagcagccccagccccagccccagcagcagcagccccagcagcagccccaggccctgcccagataccccagagaggtgccccccagattcagacaccaggagcacaagcagctgctgaagagaggccagcacttccccgtgatcgccgccaacctgggcagcgccgtgaaggtgctgaacagccagagcgagagcagcgccctgaccaaccagcagccccagaacaacggcgaggtgcagaacagcaagaaccagagcgacatcaaccacagcaccagcggcagccactacgagaacagccagagaggccccgtgagcagcaccagcgacagcagcaccaactgcaagaacgccgtggtgagcgacctgagcgagaaggaggcctggcccagcgcccccggcagcgaccccgagctggccagcgagtgcatggacgccgacagcgccagcagcagcgagagcgagagaaacatcaccatcatggccagcggcaacaccggcggcgagaaggacggcctgagaaacagcaccggcctgggcagccagaacaagttcgtggtgggcagcagcagcaacaacgtgggccacggcagcagcaccggcccctggggcttcagccacggcgccatcatcagcacctgccaggtgagcgtggacgcccccgagagcaagagcgagagcagcaacaacagaatgaacgcctggggcaccgtgagcagcagcagcaacggcggcctgaaccccagcaccctgaacagcgccagcaaccacggcgcctggcccgtgctggagaacaacggcctggccctgaagggccccgtgggcagcggcagcagcggcatcaacatccagtgcagcaccatcggccagatgcccaacaaccagagcatcaacagcaaggtgagcggcggcagcacccacggcacctggggcagcctgcaggagacctgcgagagcgaggtgagcggcacccagaaggtgagcttcagcggccagccccagaacatcaccaccgagatgaccggccccaacaacaccaccaacttcatgaccagcagcctgcccaacagcggcagcgtgcagaacaacgagctgcccagcagcaacaccggcgcctggagagtgagcaccatgaaccacccccagatgcaggcccccagcggcatgaacggcaccagcctgagccacctgagcaacggcgagagcaagagcggcggcagctacggcaccacctggggcgcctacggcagcaactacagcggcgacaagtgcagcggccccaacggccaggccaacggcgacaccgtgaacgccaccctgatgcagcccggcgtgaacggccccatgggcaccaacttccaggtgaacaccaacaagggcggcggcgtgtgggagagcggcgccgccaacagccagagcaccagctggggcagcggcaacggcgccaacagcggcggcagcagaagaggctggggcacccccgcccagaacaccggcaccaacctgcccagcgtggagtggaacaagctgcccagcaaccagcacagcaacgacagcgccaacggcaacggcaagaccttcaccaacggctggaagagcaccgaggaggaggaccagggcagcgccaccagccagaccaacgagcagagcagcgtgtgggccaagaccggcggcaccgtggagagcgacggcagcaccgagagcaccggcagactggaggagaagggcaccggcgagagccagagcagagacagaagaaagatcgaccagcacaccctgctgcagagcatcgtgaacagaaccgacctggaccccagagtgctgagcaacagcggctggggccagacccccatcaagcagaacaccgcctgggacaccgagaccagccccagaggcgagagaaagaccgacaacggcaccgaggcctggggcagcagcgccacccagaccttcaacagcggcgcctgcatcgacaagaccagccccaacggcaacgacaccagcagcgtgagcggctggggcgaccccaagcccgccctgagatggggcgacagcaagggcagcaactgccagggcggctgggaggacgacagcgccgccaccggcatggtgaagagcaaccagtggggcaactgcaaggaggagaaggccgcctggaacgacagccagaagaacaagcagggctggggcgacggccagaagagcagccagggctggagcgtgagcgccagcgacaactggggcgagaccagcagaaacaaccactggggcgaggccaacaagaagagcagcagcggcggcagcgacagcgacagaagcgtgagcggctggaacgagctgggcaagaccagcagcttcacctggggcaacaacatcaaccccaacaacagcagcggctgggacgagagcagcaagcccacccccagccagggctggggcgacccccccaagagcaaccagagcctgggctggggcgacagcagcaagcccgtgagcagccccgactggaacaagcagcaggacatcgtgggcagctggggcatcccccccgccaccggcaagccccccggcaccggctggctgggcggccccatccccgcccccgccaaggaggaggagcccaccggctgggaggagcccagccccgagagcatcagaagaaagatggagatcgacgacggcaccagcgcctggggcgaccccagcaagtacaactacaagaacgtgaacatgtggaacaagaacgtgcccaacggcaacagcagaagcgaccagcaggcccaggtgcaccagctgctgacccccgccagcgccatcagcaacaaggaggccagcagcggcagcggctggggcgagccctggggcgagcccagcacccccgccaccaccgtggacaacggcaccagcgcctggggcaagcccatcgacagcggccccagctggggcgagcccatcgccgccgccagcagcaccagcacctggggcagcagcagcgtgggcccccaggccctgagcaagagcggccccaagagcatgcaggacggctggtgcggcgacgacatgcccctgcccggcaacagacccaccggctgggaggaggaggaggacgtggagatcggcatgtggaacagcaacagcagccaggagctgaacagcagcctgaactggcccccctacaccaagaagatgagcagcaagggcctgagcggcaagaagagaagaagagagagaggcatgatgaagggcggcaacaagcaggaggaggcctggatcaaccccttcgtgaagcagttcagcaacatcagcttcagcagagacagccccgaggagaacgtgcagagcaacaagatggacctgagcggcggcatgctgcaggacaagagaatggagatcgacaagcacagcctgaacatcggcgactacaacagaaccgtgggcaagggccccggcagcagaccccagatcagcaaggagagcagcatggagagaaacccctacttcgacaaggacggcatcgtggccgacgagagccagaacatgcagttcatgagcagccagagcatgaagctgccccccagcaacagcgccctgcccaaccaggccctgggcagcatcgccggcctgggcatgcagaacctgaacagcgtgagacagaacggcaaccccagcatgttcggcgtgggcaacaccgccgcccagcccagaggcatgcagcagccccccgcccagcccctgagcagcagccagcccaacctgagagcccaggtgcccccccccctgctgagcccccaggtgcccgtgagcctgctgaagtacgcccccaacaacggcggcctgaaccccctgttcggcccccagcaggtggccatgctgaaccagctgagccagctgaaccagctgagccagatcagccagctgcagagactgctggcccagcagcagagagcccagagccagagaagcgtgcccagcggcaacagaccccagcaggaccagcagggcagacccctgagcgtgcagcagcagatgatgcagcagagcagacagctggaccccaacctgctggtgaagcagcagaccccccccagccagcagcagcccctgcaccagcccgccatgaagagcttcctggacaacgtgatgccccacaccacccccgagctgcagaagggccccagccccatcaacgccttcagcaacttccccatcggcctgaacagcaacctgaacgtgaacatggacatgaacagcatcaaggagccccagagcagactgagaaagtggaccaccgtggacagcatcagcgtgaacaccagcctggaccagaacagcagcaagcacggcgccatcagcagcggcttcagactggaggagagccccttcgtgccctacgacttcatgaacagcagcaccagccccgccagcccccccggcagcatcggcgacggctggcccagagccaagagccccaacggcagcagcagcgtgaactggccccccgagttcagacccggcgagccctggaagggctaccccaacatcgaccccgagaccgacccctacgtgacccccggcagcgtgatcaacaacctgagcatcaacaccgtgagagaggtggaccacctgagagacagaaacagcggcagcagcagcagcctgaacaccaccctgcccagcaccagcgcctggagcagcatcagagccagcaactacaacgtgcccctgagcagcaccgcccagagcaccagcgccagaaacagcgacagcaagctgacctggagccccggcagcgtgaccaacaccagcctggcccacgagctgtggaaggtgcccctgccccccaagaacatcaccgcccccagcagacccccccccggcctgaccggccagaagccccccctgagcacctgggacaacagccccctgagaatcggcggcggctggggcaacagcgacgccagatacacccccggcagcagctggggcgagagcagcagcggcagaatcaccaactggctggtgctgaagaacctgaccccccagatcgacggcagcaccctgagaaccctgtgcatgcagcacggccccctgatcaccttccacctgaacctgccccacggcaacgccctggtgagatacagcagcaaggaggaggtggtgaaggcccagaagagcctgcacatgtgcgtgctgggcaacaccaccatcctggccgagttcgccagcgaggaggagatcagcagattcttcgcccagagccagagcctgacccccagccccggctggcagagcctgggcagcagccagagcagactgggcagcctggactgcagccacagcttcagcagcagaaccgacctgaaccactggaacggcgccggcctgagcggcaccaactgcggcgacctgcacggcaccagcctgtggggcaccccccactacagcaccagcctgtggggcccccccagcagcagcgaccccagaggcatcagcagccccagccccatcaacgccttcctgagcgtggaccacctgggcggcggcggcgagagcatgtag

SEQ ID NO: 103359 - DNA, 1323 bp, Artificial Sequence
  Description of Artificial Sequence: Synthetic coding sequence
atggacatgaacagcatcaaggagccccagagcagactgagaaagtggaccaccgtggacagcatcagcgtgaacaccagcctggaccagaacagcagcaagcacggcgccatcagcagcggcttcagactggaggagagccccttcgtgccctacgacttcatgaacagcagcaccagccccgccagcccccccggcagcatcggcgacggctggcccagagccaagagccccaacggcagcagcagcgtgaactggccccccgagttcagacccggcgagccctggaagggctaccccaacatcgaccccgagaccgacccctacgtgacccccggcagcgtgatcaacaacctgagcatcaacaccgtgagagaggtggaccacctgagagacagaaacagcggcagcagcagcagcctgaacaccaccctgcccagcaccagcgcctggagcagcatcagagccagcaactacaacgtgcccctgagcagcaccgcccagagcaccagcgccagaaacagcgacagcaagctgacctggagccccggcagcgtgaccaacaccagcctggcccacgagctgtggaaggtgcccctgccccccaagaacatcaccgcccccagcagacccccccccggcctgaccggccagaagccccccctgagcacctgggacaacagccccctgagaatcggcggcggctggggcaacagcgacgccagatacacccccggcagcagctggggcgagagcagcagcggcagaatcaccaactggctggtgctgaagaacctgaccccccagatcgacggcagcaccctgagaaccctgtgcatgcagcacggccccctgatcaccttccacctgaacctgccccacggcaacgccctggtgagatacagcagcaaggaggaggtggtgaaggcccagaagagcctgcacatgtgcgtgctgggcaacaccaccatcctggccgagttcgccagcgaggaggagatcagcagattcttcgcccagagccagagcctgacccccagccccggctggcagagcctgggcagcagccagagcagactgggcagcctggactgcagccacagcttcagcagcagaaccgacctgaaccactggaacggcgccggcctgagcggcaccaactgcggcgacctgcacggcaccagcctgtggggcaccccccactacagcaccagcctgtggggcccccccagcagcagcgaccccagaggcatcagcagccccagccccatcaacgccttcctgagcgtggaccacctgggcggcggcggcgagagcatgtag

SEQ ID NO: 103360 - DNA, 5073 bp, Artificial Sequence
  Description of Artificial Sequence: Synthetic coding sequence
atggccaccggcagcgcccagggcaacttcaccggccacaccaagaagaccaacggcaacaacggcaccaacggcgccctggtgcagagccccagcaaccagagcgccctgggcgccggcggcgccaacagcaacggcagcgccgccagagtgtggggcgtggccaccggcagcagcagcggcctggcccactgcagcgtgagcggcggcgacggcaagatggacaccatgatcggcgacggcagaagccagaactgctggggcgccagcaacagcaacgccggcatcaacctgaacctgaaccccaacgccaaccccgccgcctggcccgtgctgggccacgagggcaccgtggccaccggcaaccccagcagcatctgcagccccgtgagcgccatcggccagaacatgggcaaccagaacggcaaccccaccggcaccctgggcgcctggggcaacctgctgccccaggagagcaccgagccccagaccagcaccagccagaacgtgagcttcagcgcccagccccagaacctgaacaccgacggccccaacaacaccaaccccatgaacagcagccccaaccccatcaacgccatgcagaccaacggcctgcccaactggggcatggccgtgggcatgggcgccatcatccccccccacctgcagggcctgcccggcgccaacggcagcagcgtgagccaggtgagcggcggcagcgccgagggcatcagcaacagcgtgtggggcctgagccccggcaaccccgccaccggcaacagcaacagcggcttcagccagggcaacggcgacaccgtgaacagcgccctgagcgccaagcagaacggcagcagcagcgccgtgcagaaggagggcagcggcggcaacgcctgggacagcggcccccccgccggccccggcatcctggcctggggcagaggcagcggcaacaacggcgtgggcaacatccacagcggcgcctggggccaccccagcagaagcaccagcaacggcgtgaacggcgagtggggcaagccccccaaccagcacagcaacagcgacatcaacggcaagggcagcaccggctgggagagccccagcgtgaccagccagaaccccaccgtgcagcccggcggcgagcacatgaacagctgggccaaggccgccagcagcggcaccaccgccagcgagggcagcagcgacggcagcggcaaccacaacgagggcagcaccggcagagagggcaccggcgagggcagaagaagagacaagggcatcatcgaccagggccacatccagctgcccagaaacgacctggaccccagagtgctgagcaacaccggctggggccagacccccgtgaagcagaacaccgcctgggagttcgaggagagccccagaagcgagagaaagaacgacaacggcaccgaggcctggggctgcgccgccacccaggccagcaacagcggcggcaagaacgacggcagcatcatgaacagcaccaacaccagcagcgtgagcggctgggtgaacgccccccccgccgccgtgcccgccaacaccggctggggcgacagcaacaacaaggcccccagcggccccggcgtgtggggcgacagcatcagcagcaccgccgtgagcaccgccgccgccgccaagagcggccacgcctggagcggcgccgccaaccaggaggacaagagccccacctggggcgagccccccaagcccaagagccagcactggggcgacggccagagaagcaaccccgcctggagcgccggcggcggcgactgggccgacagcagcagcgtgctgggccacctgggcgacggcaagaagaacggcagcggctgggacgccgacagcaacagaagcggcagcggctggaacgacaccaccagaagcggcaacagcggctggggcaacagcaccaacaccaaggccaaccccggcaccaactggggcgagaccctgaagcccggcccccagcagaactgggccagcaagccccaggacaacaacgtgagcaactggggcggcgccgccagcgtgaagcagaccggcaccggctggatcggcggccccgtgcccgtgaagcagaaggacagcagcgaggccaccggctgggaggagcccagcccccccagcatcagaagaaagatggagatcgacgacggcaccagcgcctggggcgaccccagcaactacaacaacaagaccgtgaacatgtgggacagaaacaaccccgtgatccagagcagcaccaccaccaacaccaccaccaccaccaccaccaccaccagcaacaccacccacagagtggagaccccccccccccaccaggccggcacccagctgaacagaagccccctgctgggccccggcagaaaggtgagcagcggctggggcgagatgcccaacgtgcacagcaagaccgagaacagctggggcgagcccagcagccccagcaccctggtggacaacggcaccgccgcctggggcaagccccccagcagcggcagcggctggggcgaccaccccgccgagccccccgtggccttcggcagagccggcgcccccgtggccgccagcgccctgtgcaagcccgccagcaagagcatgcaggagggctggggcagcggcggcgacgagatgaacctgagcaccagccagtgggaggacgaggagggcgacgtgtggaacaacgccgccagccaggagagcaccagcagctgcagcagctggggcaacgcccccaagaagggcctgcagaagggcatgaagaccagcggcaagcaggacgaggcctggatcatgagcagactgatcaagcagctgaccgacatgggcttccccagagagcccgccgaggaggccctgaagagcaacaacatgaacctggaccaggccatgagcgccctgctggagaagaaggtggacgtggacaagagaggcctgggcgtgaccgaccacaacggcatggccgccaagcccctgggctgcagaccccccatcagcaaggagagcagcgtggacagacccaccttcctggacaaggacggcggcctggtggaggagcccacccccagccccttcctgcccagccccagcctgaagctgcccctgagccacagcgccctgcccagccaggccctgggcggcatcgccagcggcctgggcatgcagaacctgaacagcagcagacagatccccagcggcaacctgggcatgttcggcaacagcggcgccgcccaggccagaaccatgcagcagcccccccagccccccgtgcagcccctgaacagcagccagcccagcctgagagcccaggtgccccagttcctgagcccccaggtgcaggcccagctgctgcagttcgccgccaagaacatcggcctgaaccccgccctgctgaccagccccatcaacccccagcacatgaccatgctgaaccagctgtaccagctgcagctggcctaccagagactgcagatccagcagcagatgctgcaggcccagagaaacgtgagcggcagcatgagacagcaggagcagcaggtggccagaaccatcaccaacctgcagcagcagatccagcagcaccagagacagctggcccaggccctgctggtgaagcagcccccccccccccccccccccccccacctgagcctgcaccccagcgccggcaagagcgccatggacagcttccccagccacccccagacccccggcctgcccgacctgcagaccaaggagcagcagagcagccccaacaccttcgccccctaccccctggccggcctgaaccccaacatgaacgtgaacagcatggacatgaccggcggcctgagcgtgaaggaccccagccagagccagagcagactgccccagtggacccaccccaacagcatggacaacctgcccagcgccgccagccccctggagcagaaccccagcaagcacggcgccatccccggcggcctgagcatcggcccccccggcaagagcagcatcgacgacagctacggcagatacgacctgatccagaacagcgagagccccgccagcccccccgtggccgtgccccacagctggagcagagccaagagcgacagcgacaagatcagcaacggcagcagcatcaactggccccccgagttccaccccggcgtgccctggaagggcctgcagaacatcgaccccgagaacgaccccgacgtgacccccggcagcgtgcccaccggccccaccatcaacaccaccatccaggacgtgaacagatacctgctgaagagcggcggcaagctgagcgacatcaagagcacctggagcagcggccccaccagccacacccaggccagcctgagccacgagctgtggaaggtgcccagaaacagcaccgcccccaccagacccccccccggcctgaccaaccccaagcccagcagcacctggggcgccagccccctgggctggaccagcagctacagcagcggcagcgcctggagcaccgacaccagcggcagaaccagcagctggctggtgctgagaaacctgaccccccagatcgacggcagcaccctgagaaccctgtgcctgcagcacggccccctgatcaccttccacctgaacctgacccagggcaacgccgtggtgagatacagcagcaaggaggaggccgccaaggcccagaagagcctgcacatgtgcgtgctgggcaacaccaccatcctggccgagttcgccggcgaggaggaggtgaacagattcctggcccagggccaggccctgccccccaccagcagctggcagagcagcagcgccagcagccagcccagactgagcgccgccggcagcagccacggcctggtgagaagcgacgccggccactggaacgccccctgcctgggcggcaagggcagcagcgagctgctgtggggcggcgtgccccagtacagcagcagcctgtggggcccccccagcgccgacgacagcagagtgatcggcagccccacccccctgaccaccctgctgcccggcgacctgctgagcggcgagagcctgtag

SEQ ID NO: 103361 - DNA, 5181 bp, Artificial Sequence
  Description of Artificial Sequence: Synthetic coding sequence
atggccaccggcagcgcccagggcaacttcaccggccacaccaagaagaccaacggcaacaacggcaccaacggcgccctggtgcagagccccagcaaccagagcgccctgggcgccggcggcgccaacagcaacggcagcgccgccagagtgtggggcgtggccaccggcagcagcagcggcctggcccactgcagcgtgagcggcggcgacggcaagatggacaccatgatcggcgacggcagaagccagaactgctggggcgccagcaacagcaacgccggcatcaacctgaacctgaaccccaacgccaaccccgccgcctggcccgtgctgggccacgagggcaccgtggccaccggcaaccccagcagcatctgcagccccgtgagcgccatcggccagaacatgggcaaccagaacggcaaccccaccggcaccctgggcgcctggggcaacctgctgccccaggagagcaccgagccccagaccagcaccagccagaacgtgagcttcagcgcccagccccagaacctgaacaccgacggccccaacaacaccaaccccatgaacagcagccccaaccccatcaacgccatgcagaccaacggcctgcccaactggggcatggccgtgggcatgggcgccatcatccccccccacctgcagggcctgcccggcgccaacggcagcagcgtgagccaggtgagcggcggcagcgccgagggcatcagcaacagcgtgtggggcctgagccccggcaaccccgccaccggcaacagcaacagcggcttcagccagggcaacggcgacaccgtgaacagcgccctgagcgccaagcagaacggcagcagcagcgccgtgcagaaggagggcagcggcggcaacgcctgggacagcggcccccccgccggccccggcatcctggcctggggcagaggcagcggcaacaacggcgtgggcaacatccacagcggcgcctggggccaccccagcagaagcaccagcaacggcgtgaacggcgagtggggcaagccccccaaccagcacagcaacagcgacatcaacggcaagggcagcaccggctgggagagccccagcgtgaccagccagaaccccaccgtgcagcccggcggcgagcacatgaacagctgggccaaggccgccagcagcggcaccaccgccagcgagggcagcagcgacggcagcggcaaccacaacgagggcagcaccggcagagagggcaccggcgagggcagaagaagagacaagggcatcatcgaccagggccacatccagctgcccagaaacgacctggaccccagagtgctgagcaacaccggctggggccagacccccgtgaagcagaacaccgcctgggagttcgaggagagccccagaagcgagagaaagaacgacaacggcaccgaggcctggggctgcgccgccacccaggccagcaacagcggcggcaagaacgacggcagcatcatgaacagcaccaacaccagcagcgtgagcggctgggtgaacgccccccccgccgccgtgcccgccaacaccggctggggcgacagcaacaacaaggcccccagcggccccggcgtgtggggcgacagcatcagcagcaccgccgtgagcaccgccgccgccgccaagagcggccacgcctggagcggcgccgccaaccaggaggacaagagccccacctggggcgagccccccaagcccaagagccagcactggggcgacggccagagaagcaaccccgcctggagcgccggcggcggcgactgggccgacagcagcagcgtgctgggccacctgggcgacggcaagaagaacggcagcggctgggacgccgacagcaacagaagcggcagcggctggaacgacaccaccagaagcggcaacagcggctggggcaacagcaccaacaccaaggccaaccccggcaccaactggggcgagaccctgaagcccggcccccagcagaactgggccagcaagccccaggacaacaacgtgagcaactggggcggcgccgccagcgtgaagcagaccggcaccggctggatcggcggccccgtgcccgtgaagcagaaggacagcagcgaggccaccggctgggaggagcccagcccccccagcatcagaagaaagatggagatcgacgacggcaccagcgcctggggcgaccccagcaactacaacaacaagaccgtgaacatgtgggacagaaacaaccccgtgatccagagcagcaccaccaccaacaccaccaccaccaccaccaccaccaccagcaacaccacccacagagtggagaccccccccccccaccaggccggcacccagctgaacagaagccccctgctgggccccgtgagcagcggctggggcgagatgcccaacgtgcacagcaagaccgagaacagctggggcgagcccagcagccccagcaccctggtggacaacggcaccgccgcctggggcaagccccccagcagcggcagcggctggggcgaccaccccgccgagccccccgtggccttcggcagagccggcgcccccgtggccgccagcgccctgtgcaagcccgccagcaagagcatgcaggagggctggggcagcggcggcgacgagatgaacctgagcaccagccagtgggaggacgaggagggcgacgtgtggaacaacgccgccagccaggagagcaccagcagctgcagcagctggggcaacgcccccaagaagggcctgcagaagggcatgaagaccagcggcaagcaggacgaggcctggatcatgagcagactgatcaagcagctgaccgacatgggcttccccagagagcccgccgaggaggccctgaagagcaacaacatgaacctggaccaggccatgagcgccctgctggagaagaaggtggacgtggacaagagaggcctgggcgtgaccgaccacaacggcatggccgccaagcccctgggctgcagaccccccatcagcaaggagagcagcgtggacagacccaccttcctggacaaggacggcggcctggtggaggagcccacccccagccccttcctgcccagccccagcctgaagctgcccctgagccacagcgccctgcccagccaggccctgggcggcatcgccagcggcctgggcatgcagaacctgaacagcagcagacagatccccagcggcaacctgggcatgttcggcaacagcggcgccgcccaggccagaaccatgcagcagcccccccagccccccgtgcagcccctgaacagcagccagcccagcctgagagcccaggtgccccagttcctgagcccccaggtgcaggcccagctgctgcagttcgccgccaagaacatcggcctgaaccccgccctgctgaccagccccatcaacccccagcacatgaccatgctgaaccagctgtaccagctgcagctggcctaccagagactgcagatccagcagcagatgctgcaggcccagagaaacgtgagcggcagcatgagacagcaggagcagcaggtggccagaaccatcaccaacctgcagcagcagatccagcagcaccagagacagctggcccaggccctgctggtgaagcagcccccccccccccccccccccccccacctgagcctgcaccccagcgccggcaagagcgccatggacagcttccccagccacccccagacccccggcctgcccgacctgcagaccaaggagcagcagagcagccccaacaccttcgccccctaccccctggccggcctgaaccccaacatgaacgtgaacagcatggacatgaccggcggcctgagcgtgaaggaccccagccagagccagagcagactgccccagtggacccaccccaacagcatggacaacctgcccagcgccgccagccccctggagcagaaccccagcaagcacggcgccatccccggcggcctgagcatcggcccccccggcaagagcagcatcgacgacagctacggcagatacgacctgatccagaacagcgagagccccgccagcccccccgtggccgtgccccacagctggagcagagccaagagcgacagcgacaagatcagcaacggcagcagcatcaactggccccccgagttccaccccggcgtgccctggaagggcctgcagaacatcgaccccgagaacgaccccgacgtgacccccggcagcgtgcccaccggccccaccatcaacaccaccatccaggacgtgaacagatacctgctgaagagcggcggcagcagcccccccagcagccagaacgccaccctgcccagcagcagcgcctggcccctgagcgccagcggctacagcagcagcttcagcagcatcgccagcgcccccagcgtggccggcaagctgagcgacatcaagagcacctggagcagcggccccaccagccacacccaggccagcctgagccacgagctgtggaaggtgcccagaaacagcaccgcccccaccagacccccccccggcctgaccaaccccaagcccagcagcacctggggcgccagccccctgggctggaccagcagctacagcagcggcagcgcctggagcaccgacaccagcggcagaaccagcagctggctggtgctgagaaacctgaccccccagatcgacggcagcaccctgagaaccctgtgcctgcagcacggccccctgatcaccttccacctgaacctgacccagggcaacgccgtggtgagatacagcagcaaggaggaggccgccaaggcccagaagagcctgcacatgtgcgtgctgggcaacaccaccatcctggccgagttcgccggcgaggaggaggtgaacagattcctggcccagggccaggccctgccccccaccagcagctggcagagcagcagcgccagcagccagcccagactgagcgccgccggcagcagccacggcctggtgagaagcgacgccggccactggaacgccccctgcctgggcggcaagggcagcagcgagctgctgtggggcggcgtgccccagtacagcagcagcctgtggggcccccccagcgccgacgacagcagagtgatcggcagccccacccccctgaccaccctgctgcccggcgacctgctgagcggcgagagcctgtag

SEQ ID NO: 103362 - DNA, 5181 bp, Artificial Sequence; identical to SEQ ID NO: 103361
  Description of Artificial Sequence: Synthetic coding sequence

SEQ ID NO: 103363 - DNA, 5073 bp, Artificial Sequence; identical to SEQ ID NO: 103360
  Description of Artificial Sequence: Synthetic coding sequence

SEQ ID NO: 103364 - DNA, 5073 bp, Artificial Sequence; identical to SEQ ID NO: 103360
  Description of Artificial Sequence: Synthetic coding sequence

SEQ ID NO: 103365 - DNA, 5181 bp, Artificial Sequence; identical to SEQ ID NO: 103361
  Description of Artificial Sequence: Synthetic coding sequence

SEQ ID NO: 103366 - DNA, 1959 bp, Artificial Sequence
  Description of Artificial Sequence: Synthetic coding sequence
atgggcggctggaagggccccggccagagaagaggcaaggagggccccgaggccagaagaagagccgccgagagaggcggcggcggcggcggcggcggcgtgcccgcccccagaagccccgccagagagcccagacccagaagctgcctgctgctgccccccccctggggcgccgccatgacccccgacctgctgaacttcaagaagggctggatgagcatcctggacgagcccggcgagccccccagccccagcctgaccaccaccagcaccagccagtggaagaagcactggttcgtgctgaccgacagcagcctgaagtactacagagacagcaccgccgaggaggccgacgagctggacggcgagatcgacctgagaagctgcaccgacgtgaccgagtacgccgtgcagagaaactacggcttccagatccacaccaaggacgccgtgtacaccctgagcgccatgaccagcggcatcagaagaaactggatcgaggccctgagaaagaccgtgagacccaccagcgcccccgacgtgaccaagctgagcgacagcaacaaggagaacgccctgcacagctacagcacccagaagggccccctgaaggccggcgagcagagagccggcagcgaggtgatcagcagaggcggccccagaaaggccgacggccagagacaggccctggactacgtggagctgagccccctgacccaggccagcccccagagagccagaacccccgccagaacccccgacagactggccaagcaggaggagctggagagagacctggcccagagaagcgaggagagaagaaagtggttcgaggccaccgacagcagaacccccgaggtgcccgccggcgagggccccagaagaggcctgggcgcccccctgaccgaggaccagcagaacagactgagcgaggagatcgagaagaagtggcaggagctggagaagctgcccctgagagagaacaagagagtgcccctgaccgccctgctgaaccagagcagaggcgagagaagaggcccccccagcgacggccacgaggccctggagaaggaggtgcaggccctgagagcccagctggaggcctggagactgcagggcgaggccccccagagcgccctgagaagccaggaggacggccacatcccccccggctacatcagccaggaggcctgcgagagaagcctggccgagatggagagcagccaccagcaggtgatggaggagctgcagagacaccacgagagagagctgcagagactgcagcaggagaaggagtggctgctggccgaggagaccgccgccaccgccagcgccatcgaggccatgaagaaggcctaccaggaggagctgagcagagagctgagcaagaccagaagcctgcagcagggccccgacggcctgagaaagcagcaccagagcgacgtggaggccctgaagagagagctgcaggtgctgagcgagcagtacagccagaagtgcctggagatcggcgccctgatgagacaggccgaggagagagagcacaccctgagaagatgccagcaggagggccaggagctgctgagacacaaccaggagctgcacggcagactgagcgaggagatcgaccagctgagaggcttcatcgccagccagggcatgggcaacggctgcggcagaagcaacgagagaagcagctgcgagctggaggtgctgctgagagtgaaggagaacgagctgcagtacctgaagaaggaggtgcagtgcctgagagacgagctgcagatgatgcagaaggacaagagattcaccagcggcaagtaccaggacgtgtacgtggagctgagccacatcaagaccagaagcgagagagagatcgagcagctgaaggagcacctgagactggccatggccgccctgcaggagaaggagagcatgagaaacagcctggccgagtag

SEQ ID NO: 103367 - DNA, 7098 bp, Artificial Sequence
  Description of Artificial Sequence: Synthetic coding sequence
atggaggaggtgcccggcgacgccctgtgcgagcacttcgaggccaacatcctgacccagaacagatgccagaactgcttccaccccgaggaggcccacggcgccagataccaggagctgagaagccccagcggcgccgaggtgccctactgcgacctgcccagatgcccccccgcccccgaggaccccctgagcgccagcaccagcggctgccagagcgtggtggaccccggcctgagacccggccccaagagaggccccagccccagcgccggcctgcccgaggagggccccaccgccgcccccagaagcagaagcagagagctggaggccgtgccctacctggagggcctgaccaccagcctgtgcggcagctgcaacgaggaccccggcagcgaccccaccagcagccccgacagcgccacccccgacgacaccagcaacagcagcagcgtggactgggacaccgtggagagacaggaggaggaggcccccagctgggacgagctggccgtgatgatccccagaagacccagagagggccccagagccgacagcagccagagagcccccagcctgctgaccagaagccccgtgggcggcgacgccgccggccagaagaaggaggacaccggcggcggcggcagaagcgccggccagcactgggccagactgagaggcgagagcggcctgagcctggagagacacagaagcaccctgacccaggccagcagcatgaccccccacagcggccccagaagcaccaccagccaggccagccccgcccagagagacaccgcccaggccgccagcaccagagagatccccagagccagcagcccccacagaatcacccagagagacaccagcagagccagcagcacccagcaggagatcagcagagccagcagcacccagcaggagaccagcagagccagcagcacccaggaggacacccccagagccagcagcacccaggaggacacccccagagccagcagcacccagtggaacacccccagagccagcagccccagcagaagcacccagctggacaaccccagaaccagcagcacccagcaggacaacccccagaccagcttccccacctgcaccccccagagagagaaccccagaaccccctgcgtgcagcaggacgaccccagagccagcagccccaacagaaccacccagagagagaacagcagaaccagctgcgcccagagagacaaccccaaggccagcagaaccagcagccccaacagagccaccagagacaaccccagaaccagctgcgcccagagagacaaccccagagccagcagccccagcagagccaccagagacaaccccaccaccagctgcgcccagagagacaaccccagagccagcagaaccagcagccccaacagagccaccagagacaaccccagaaccagctgcgcccagagagacaaccccagagccagcagccccagcagagccaccagagacaaccccaccaccagctgcgcccagagagacaaccccagagccagcagaaccagcagccccaacagagccaccagagacaaccccagaaccagctgcgcccagagagacaaccccagagccagcagccccaacagagccgccagagacaaccccaccaccagctgcgcccagagagacaaccccagagccagcagaaccagcagccccaacagagccaccagagacaaccccagaaccagctgcgcccagagagacaaccccagagccagcagccccaacagagccaccagagacaaccccaccaccagctgcgcccagagagacaaccccagagccagcagaaccagcagccccaacagagccaccagagacaaccccagaaccagctgcgcccagagagacaaccccagagccagcagccccaacagaaccacccagcaggacagccccagaaccagctgcgccagaagagacgaccccagagccagcagccccaacagaaccatccagcaggagaaccccagaaccagctgcgccctgagagacaaccccagagccagcagccccagcagaaccatccagcaggagaaccccagaaccagctgcgcccagagagacgaccccagagccagcagccccaacagaaccacccagcaggagaaccccagaaccagctgcgccagaagagacaaccccagagccagcagcagaaacagaaccatccagagagacaaccccagaaccagctgcgcccagagagacaaccccagagccagcagccccaacagaaccatccagcaggagaacctgagaaccagctgcaccagacaggacaaccccagaaccagcagccccaacagagccaccagagacaaccccagaaccagctgcgcccagagagacaacctgagagccagcagccccatcagagccacccagcaggacaaccccagaacctgcatccagcagaacatccccagaagcagcagcacccagcaggacaaccccaagaccagctgcaccaagagagacaacctgagacccacctgcacccagagagacagaacccagagcttcagcttccagagagacaaccccggcaccagcagcagccagtgctgcacccagaaggagaacctgagacccagcagcccccacagaagcacccagtggaacaaccccagaaacagcagcccccacagaaccaacaaggacatcccctgggccagcttccccctgagacccacccagagcgacggccccagaaccagcagccccagcagaagcaagcagagcgaggtgccctgggccagcatcgccctgagacccacccagggcgacagaccccagaccagcagccccagcagacccgcccagcacgaccccccccagagcagcttcggccccacccagtacaacctgcccagcagagccaccagcagcagccacaaccccggccaccagagcaccagcagaaccagcagccccgtgtaccccgccgcctacggcgcccccctgaccagccccgagcccagccagcccccctgcgccgtgtgcatcggccacagagacgcccccagagccagcagcccccccagatacctgcagcacgaccccttccccttcttccccgagcccagagcccccgagagcgagcccccccaccacgagcccccctacatcccccccgccgtgtgcatcggccacagagacgcccccagagccagcagcccccccagacacacccagttcgaccccttccccttcctgcccgacaccagcgacgccgagcaccagtgccagagcccccagcacgagcccctgcagctgcccgcccccgtgtgcatcggctacagagacgcccccagagccagcagcccccccagacaggcccccgagcccagcctgctgttccaggacctgcccagagccagcaccgagagcctggtgcccagcatggacagcctgcacgagtgcccccacatccccacccccgtgtgcatcggccacagagacgcccccagcttcagcagcccccccagacaggcccccgagcccagcctgttcttccaggacccccccggcaccagcatggagagcctggcccccagcaccgacagcctgcacggcagccccgtgctgatcccccaggtgtgcatcggccacagagacgcccccagagccagcagcccccccagacacccccccagcgacctggccttcctggcccccagccccagccccggcagcagcggcggcagcagaggcagcgccccccccggcgagaccagacacaacctggagagagaggagtacaccgtgctggccgacctgcccccccccagaagactggcccagagacagcccggcccccaggcccagtgcagcagcggcggcagaacccacagccccggcagagccgaggtggagagactgttcggccaggagagaagaaagagcgaggccgccggcgccttccaggcccaggacgagggcagaagccagcagcccagccagggccagagccagctgctgagaagacagagcagccccgcccccagcagacaggtgaccatgctgcccgccaagcaggccgagctgaccagaagaagccaggccgagcccccccacccctggagccccgagaagagacccgagggcgacagacagctgcagggcagccccctgccccccagaaccagcgccagaacccccgagagagagctgagaacccagagacccctggagagcggccaggccggccccagacagcccctgggcgtgtggcagagccaggaggagccccccggcagccagggcccccacagacacctggagagaagctggagcagccaggagggcggcctgggccccggcggctggtggggctgcggcgagcccagcctgggcgccgccaaggcccccgagggcgcctggggcggcaccagcagagagtacaaggagagctggggccagcccgaggcctgggaggagaagcccacccacgagctgcccagagagctgggcaagagaagccccctgaccagcccccccgagaactggggcggccccgccgagagcagccagagctggcacagcggcacccccaccgccgtgggctggggcgccgagggcgcctgcccctaccccagaggcagcgagagaagacccgagctggactggagagacctgctgggcctgctgagagcccccggcgagggcgtgtgggccagagtgcccagcctggactgggagggcctgctggagctgctgcaggccagactgcccagaaaggaccccgccggccacagagacgacctggccagagccctgggccccgagctgggcccccccggcaccaacgacgtgcccgagcaggagagccacagccagcccgagggctgggccgaggccacccccgtgaacggccacagccccgccctgcagagccagagccccgtgcagctgcccagccccgcctgcaccagcacccagtggcccaagatcaaggtgaccagaggccccgccaccgccaccctggccggcctggagcagaccggccccctgggcagcagaagcaccgccaagggccccagcctgcccgagctgcagttccagcccgaggagcccgaggagagcgagcccagcagaggccaggaccccctgaccgaccagaagcaggccgacagcgccgacaagagacccgccgagggcaaggccggcagccccctgaagggcagactggtgaccagctggagaatgcccggcgacagacccaccctgttcaaccccttcctgctgagcctgggcgtgctgagatggagaagacccgacctgctgaacttcaagaagggctggatgagcatcctggacgagcccggcgagccccccagccccagcctgaccaccaccagcaccagccagtggaagaagcactggttcgtgctgaccgacagcagcctgaagtactacagagacagcaccgccgaggaggccgacgagctggacggcgagatcgacctgagaagctgcaccgacgtgaccgagtacgccgtgcagagaaactacggcttccagatccacaccaaggacgccgtgtacaccctgagcgccatgaccagcggcatcagaagaaactggatcgaggccctgagaaagaccgtgagacccaccagcgcccccgacgtgaccaagctgagcgacagcaacaaggagaacgccctgcacagctacagcacccagaagggccccctgaaggccggcgagcagagagccggcagcgaggtgatcagcagaggcggccccagaaaggccgacggccagagacaggccctggactacgtggagctgagccccctgacccaggccagcccccagagagccagaacccccgccagaacccccgacagactggccaagcaggaggagctggagagagacctggcccagagaagcgaggagagaagaaagtggttcgaggccaccgacagcagaacccccgaggtgcccgccggcgagggccccagaagaggcctgggcgcccccctgaccgaggaccagcagaacagactgagcgaggagatcgagaagaagtggcaggagctggagaagctgcccctgagagagaacaagagagtgcccctgaccgccctgctgaaccagagcagaggcgagagaagaggcccccccagcgacggccacgaggccctggagaaggaggtgcaggccctgagagcccagctggaggcctggagactgcagggcgaggccccccagagcgccctgagaagccaggaggacggccacatcccccccggctacatcagccaggaggcctgcgagagaagcctggccgagatggagagcagccaccagcaggtgatggaggagctgcagagacaccacgagagagagctgcagagactgcagcaggagaaggagtggctgctggccgaggagaccgccgccaccgccagcgccatcgaggccatgaagaaggcctaccaggaggagctgagcagagagctgagcaagaccagaagcctgcagcagggccccgacggcctgagaaagcagcaccagagcgacgtggaggccctgaagagagagctgcaggtgctgagcgagcagtacagccagaagtgcctggagatcggcgccctgatgagacaggccgaggagagagagcacaccctgagaagatgccagcaggagggccaggagctgctgagacacaaccaggagctgcacggcagactgagcgaggagatcgaccagctgagaggcttcatcgccagccagggcatgggcaacggctgcggcagaagcaacgagagaagcagctgcgagctggaggtgctgctgagagtgaaggagaacgagctgcagtacctgaagaaggaggtgcagtgcctgagagacgagctgcagatgatgcagaaggacaagagattcaccagcggcaagtaccaggacgtgtacgtggagctgagccacatcaagaccagaagcgagagagagatcgagcagctgaaggagcacctgagactggccatggccgccctgcaggagaaggagagcatgagaaacagcctggccgagtag

SEQ ID NO: 103368 - DNA, 1296 bp, Artificial Sequence
  Description of Artificial Sequence: Synthetic coding sequence
atgggcggctggaagggccccggccagagaagaggcaaggagggccccgaggccagaagaagagccgccgagagaggcggcggcggcggcggcggcggcgtgcccgcccccagaagccccgccagagagcccagacccagaagctgcctgctgctgccccccccctggggcgccgccatgacccccgacctgctgaacttcaagaagggctggatgagcatcctggacgagcccggcgagccccccagccccagcctgaccaccaccagcaccagccagtggaagaagcactggttcgtgctgaccgacagcagcctgaagtactacagagacagcaccgccgaggaggccgacgagctggacggcgagatcgacctgagaagctgcaccgacgtgaccgagtacgccgtgcagagaaactacggcttccagatccacaccaaggacgccgtgtacaccctgagcgccatgaccagcggcatcagaagaaactggatcgaggccctgagaaagaccgtgagacccaccagcgcccccgacgtgaccaagctgagcgacagcaacaaggagaacgccctgcacagctacagcacccagaagggccccctgaaggccggcgagcagagagccggcagcgaggtgatcagcagaggcggccccagaaaggccgacggccagagacaggccctggactacgtggagctgagccccctgacccaggccagcccccagagagccagaacccccgccagaacccccgacagactggccaagcaggaggagctggagagagacctggcccagagaagcgaggagagaagaaagtggttcgaggccaccgacagcagaacccccgaggtgcccgccggcgagggccccagaagaggcctgggcgcccccctgaccgaggaccagcagaacagactgagcgaggagatcgagaagaagtggcaggagctggagaagctgcccctgagagagaacaagagagtgcccctgaccgccctgctgaaccagagcagaggcgagagaagaggcccccccagcgacggccacgaggccctggagaaggaggtgcaggccctgagagcccagctggaggcctggagactgcagggcgaggccccccagagcgccctgagaagccaggaggacggccacatcccccccggctacatcagccagctggtgggcgtgatcaccgtgcccgtgctgcagaccagacccctgagcagcgagagactgtgcgacctgcccaaggtgaccccccccgccggcctgaagggcggcatctag

SEQ ID NO: 103369 - DNA, 5070 bp, Artificial Sequence
  Description of Artificial Sequence: Synthetic coding sequence
atggaggaggtgcccggcgacgccctgtgcgagcacttcgaggccaacatcctgacccagaacagatgccagaactgcttccaccccgaggaggcccacggcgccagataccaggagctgagaagccccagcggcgccgaggtgccctactgcgacctgcccagatgcccccccgcccccgaggaccccctgagcgccagcaccagcggctgccagagcgtggtggaccccggcctgagacccggccccaagagaggccccagccccagcgccggcctgcccgaggagggccccaccgccgcccccagaagcagaagcagagagctggaggccgtgccctacctggagggcctgaccaccagcctgtgcggcagctgcaacgaggaccccggcagcgaccccaccagcagccccgacagcgccacccccgacgacaccagcaacagcagcagcgtggactgggacaccgtggagagacaggaggaggaggcccccagctgggacgagctggccgtgatgatccccagaagacccagagagggccccagagccgacagcagccagagagcccccagcctgctgaccagaagccccgtgggcggcgacgccgccggccagaagaaggaggacaccggcggcggcggcagaagcgccggccagcactgggccagactgagaggcgagagcggcctgagcctggagagacacagaagcaccctgacccaggccagcagcatgaccccccacagcggccccagaagcaccaccagccaggccagccccgcccagagagacaccgcccaggccgccagcaccagagagatccccagagccagcagcccccacagaatcacccagagagacaccagcagagccagcagcacccagcaggagatcagcagagccagcagcacccagcaggagaccagcagagccagcagcacccaggaggacacccccagagccagcagcacccaggaggacacccccagagccagcagcacccagtggaacacccccagagccagcagccccagcagaagcacccagctggacaaccccagaaccagcagcacccagcaggacaacccccagaccagcttccccacctgcaccccccagagagagaaccccagaaccccctgcgtgcagcaggacgaccccagagccagcagccccaacagaaccacccagagagagaacagcagaaccagctgcgcccagagagacaaccccaaggccagcagaaccagcagccccaacagagccaccagagacaaccccagaaccagctgcgcccagagagacaaccccagagccagcagccccagcagagccaccagagacaaccccaccaccagctgcgcccagagagacaaccccagagccagcagaaccagcagccccaacagagccaccagagacaaccccagaaccagctgcgcccagagagacaaccccagagccagcagccccagcagagccaccagagacaaccccaccaccagctgcgcccagagagacaaccccagagccagcagaaccagcagccccaacagagccaccagagacaaccccagaaccagctgcgcccagagagacaaccccagagccagcagccccaacagagccgccagagacaaccccaccaccagctgcgcccagagagacaaccccagagccagcagaaccagcagccccaacagagccaccagagacaaccccagaaccagctgcgcccagagagacaaccccagagccagcagccccaacagagccaccagagacaaccccaccaccagctgcgcccagagagacaaccccagagccagcagaaccagcagccccaacagagccaccagagacaaccccagaaccagctgcgcccagagagacaaccccagagccagcagccccaacagaaccacccagcaggacagccccagaaccagctgcgccagaagagacgaccccagagccagcagccccaacagaaccatccagcaggagaaccccagaaccagctgcgccctgagagacaaccccagagccagcagccccagcagaaccatccagcaggagaaccccagaaccagctgcgcccagagagacgaccccagagccagcagccccaacagaaccacccagcaggagaaccccagaaccagctgcgccagaagagacaaccccagagccagcagcagaaacagaaccatccagagagacaaccccagaaccagctgcgcccagagagacaaccccagagccagcagccccaacagaaccatccagcaggagaacctgagaaccagctgcaccagacaggacaaccccagaaccagcagccccaacagagccaccagagacaaccccagaaccagctgcgcccagagagacaacctgagagccagcagccccatcagagccacccagcaggacaaccccagaacctgcatccagcagaacatccccagaagcagcagcacccagcaggacaaccccaagaccagctgcaccaagagagacaacctgagacccacctgcacccagagagacagaacccagagcttcagcttccagagagacaaccccggcaccagcagcagccagtgctgcacccagaaggagaacctgagacccagcagcccccacagaagcacccagtggaacaaccccagaaacagcagcccccacagaaccaacaaggacatcccctgggccagcttccccctgagacccacccagagcgacggccccagaaccagcagccccagcagaagcaagcagagcgaggtgccctgggccagcatcgccctgagacccacccagggcgacagaccccagaccagcagccccagcagacccgcccagcacgaccccccccagagcagcttcggccccacccagtacaacctgcccagcagagccaccagcagcagccacaaccccggccaccagagcaccagcagaaccagcagccccgtgtaccccgccgcctacggcgcccccctgaccagccccgagcccagccagcccccctgcgccgtgtgcatcggccacagagacgcccccagagccagcagcccccccagatacctgcagcacgaccccttccccttcttccccgagcccagagcccccgagagcgagcccccccaccacgagcccccctacatcccccccgccgtgtgcatcggccacagagacgcccccagagccagcagcccccccagacacacccagttcgaccccttccccttcctgcccgacaccagcgacgccgagcaccagtgccagagcccccagcacgagcccctgcagctgcccgcccccgtgtgcatcggctacagagacgcccccagagccagcagcccccccagacaggcccccgagcccagcctgctgttccaggacctgcccagagccagcaccgagagcctggtgcccagcatggacagcctgcacgagtgcccccacatccccacccccgtgtgcatcggccacagagacgcccccagcttcagcagcccccccagacaggcccccgagcccagcctgttcttccaggacccccccggcaccagcatggagagcctggcccccagcaccgacagcctgcacggcagccccgtgctgatcccccaggtgtgcatcggccacagagacgcccccagagccagcagcccccccagacacccccccagcgacctggccttcctggcccccagccccagccccggcagcagcggcggcagcagaggcagcgccccccccggcgagaccagacacaacctggagagagaggagtacaccgtgctggccgacctgcccccccccagaagactggcccagagacagcccggcccccaggcccagtgcagcagcggcggcagaacccacagccccggcagagccgaggtggagagactgttcggccaggagagaagaaccatgctgcccgccaagcaggccgagctgaccagaagaagccaggccgagcccccccacccctggagccccgagaagagacccgagggcgacagacagctgcagggcagccccctgccccccagaaccagcgccagaacccccgagagagagctgagaacccagagacccctggagagcggccaggccggccccagacagcccctgggcgtgtggcagagccaggaggagccccccggcagccagggcccccacagacacctggagagaagctggagcagccaggagggcggcctgggccccggcggctggtggggctgcggcgagcccagcctgggcgccgccaaggcccccgagggcgcctggggcggcaccagcagagagtacaaggagagctggggccagcccgaggcctgggaggagaagcccacccacgagctgcccagagagctgggcaagagaagccccctgaccagcccccccgagaactggggcggccccgccgagagcagccagagctggcacagcggcacccccaccgccgtgggctggggcgccgagggcgcctgcccctaccccagaggcagcgagagaagacccgagctggactggagagacctgctgggcctgctgagagcccccggcgagggcgtgtgggccagagtgcccagcctggactgggagggcctgctggagctgctgcaggccagactgcccagaaaggaccccgccggccacagagacgacctggccagagccctgggccccgagctgggcccccccggcaccaacgacgtgcccgagcaggagagccacagccagcccgagggctgggccgaggccacccccgtgaacggccacagccccgccctgcagagccagagccccgtgcagctgcccagccccgcctgcaccagcacccagtggcccaagatcaaggtgaccagaggccccgccaccgccaccctggccggcctggagcagaccggccccctgggcagcagaagcaccgccaagggccccagcctgcccgagctgcagttccagcccgaggagcccgaggagagcgagcccagcagaggccaggaccccctgaccgaccagaagcaggccgacagctag

SEQ ID NO: 103370 - DNA, 771 bp, Artificial Sequence
  Description of Artificial Sequence: Synthetic coding sequence
atgagcatcctggacgagcccggcgagccccccagccccagcctgaccaccaccagcaccagccagtggaagaagcactggttcgtgctgaccgacagcagcctgaagtactacagagacagcaccgccgaggaggccgacgagctggacggcgagatcgacctgagaagctgcaccgacgtgaccgagtacgccgtgcagagaaactacggcttccagatccacaccaaggacgccgtgtacaccctgagcgccatgaccagcggcatcagaagaaactggatcgaggccctgagaaagaccgtgagacccaccagcgcccccgacgtgaccaagctgagcgacagcaacaaggagaacgccctgcacagctacagcacccagaagggccccctgaaggccggcgagcagagagccggcagcgaggtgatcagcagaggcggccccagaaaggccgacggccagagacaggccctggactacgtggagctgagccccctgacccaggccagcccccagagagccagaacccccgccagaacccccgacagactggccaagcaggaggagctggagagagacctggcccagagaagcgaggagagaagaaagtggttcgaggccaccgacagcagaacccccgaggtgcccgccggcgagggccccagaagaggcctgggcgcccccctgaccgaggaccagcagaacagactgagcgaggagatcgagaagaagtggcaggagctggagaagctgcccctgagagagtag

SEQ ID NO: 103371 - DNA, 252 bp, Artificial Sequence
  Description of Artificial Sequence: Synthetic coding sequence
atgagcatcctggacgagcccggcgagccccccagccccagcctgaccaccaccagcaccagccagtggaagaagcactggttcgtgctgaccgacagcagcctgaagtactacagagacagcaccgccgaggaggccgacgagctggacggcgagatcgacctgagaagctgcaccgacgtgaccgagtacgccgtgcagagaaactacggcttccagatccacaccaaggacgccgtgtacaccctgtag

SEQ ID NO: 103372 - DNA, 2577 bp, Artificial Sequence
  Description of Artificial Sequence: Synthetic coding sequence
atggccgagctgagcgaggaggccctgctgagcgtgctgcccaccatcagagtgcccaaggccggcgacagagtgcacaaggacgagtgcgccttcagcttcgacacccccgagagcgagggcggcctgtacatctgcatgaacaccttcctgggcttcggcaagcagtacgtggagagacacttcaacaagaccggccagagagtgtacctgcacctgagaagaaccagaagacccaaggaggaggaccccgccaccggcaccggcgacccccccagaaagaagcccaccagactggccatcggcgtggagggcggcttcgacctgagcgaggagaagttcgagctggacgaggacgtgaagatcgtgatcctgcccgactacctggagatcgccagagacggcctgggcggcctgcccgacatcgtgagagacagagtgaccagcgccgtggaggccctgctgagcgccgacagcgccagcagaaagcaggaggtgcaggcctgggacggcgaggtgagacaggtgagcaagcacgccttcagcctgaagcagctggacaaccccgccagaatccccccctgcggctggaagtgcagcaagtgcgacatgagagagaacctgtggctgaacctgaccgacggcagcatcctgtgcggcagaagatacttcgacggcagcggcggcaacaaccacgccgtggagcactacagagagaccggctaccccctggccgtgaagctgggcaccatcacccccgacggcgccgacgtgtacagctacgacgaggacgacatggtgctggaccccagcctggccgagcacctgagccacttcggcatcgacatgctgaagatgcagaagaccgacaagaccatgaccgagctggagatcgacatgaaccagagaatcggcgagtgggagctgatccaggagagcggcgtgcccctgaagcccctgttcggccccggctacaccggcatcagaaacctgggcaacagctgctacctgaacagcgtggtgcaggtgctgttcagcatccccgacttccagagaaagtacgtggacaagctggagaagatcttccagaacgcccccaccgaccccacccaggacttcagcacccaggtggccaagctgggccacggcctgctgagcggcgagtacagcaagcccgtgcccgagagcggcgacggcgagagagtgcccgagcagaaggaggtgcaggacggcatcgcccccagaatgttcaaggccctgatcggcaagggccaccccgagttcagcaccaacagacagcaggacgcccaggagttcttcctgcacctgatcaacatggtggagagaaactgcagaagcagcgagaaccccaacgaggtgttcagattcctggtggaggagaagatcaagtgcctggccaccgagaaggtgaagtacacccagagagtggactacatcatgcagctgcccgtgcccatggacgccgccctgaacaaggaggagctgctggagtacgaggagaagaagagacaggccgaggaggagaagatggccctgcccgagctggtgagagcccaggtgcccttcagcagctgcctggaggcctacggcgcccccgagcaggtggacgacttctggagcaccgccctgcaggccaagagcgtggccgtgaagaccaccagattcgccagcttccccgactacctggtgatccagatcaagaagttcaccttcggcctggactgggtgcccaagaagctggacgtgagcatcgagatgcccgaggagctggacatcagccagctgagaggcaccggcctgcagcccggcgaggaggagctgcccgacatcgccccccccctggtgacccccgacgagcccaagggcagcctgggcttctacggcaacgaggacgaggacagcttctgcagcccccacttcagcagccccaccagccccatgctggacgagagcgtgatcatccagctggtggagatgggcttccccatggacgcctgcagaaaggccgtgtactacaccggcaacagcggcgccgaggccgccatgaactgggtgatgagccacatggacgaccccgacttcgccaaccccctgatcctgcccggcagcagcggccccggcagcaccagcgccgccgccgaccccccccccgaggactgcgtgaccaccatcgtgagcatgggcttcagcagagaccaggccctgaaggccctgagagccaccaacaacagcctggagagagccgtggactggatcttcagccacatcgacgacctggacgccgaggccgccatggacatcagcgagggcagaagcgccgccgacagcatcagcgagagcgtgcccgtgggccccaaggtgagagacggccccggcaagtaccagctgttcgccttcatcagccacatgggcaccagcaccatgtgcggccactacgtgtgccacatcaagaaggagggcagatgggtgatctacaacgaccagaaggtgtgcgccagcgagaagccccccaaggacctgggctacatctacttctaccagagagtggccagctag

SEQ ID NO: 103373 - DNA, 750 bp, Artificial Sequence
  Description of Artificial Sequence: Synthetic coding sequence
atggcccccagcagaaagttcttcgtgggcggcaactggaagatgaacggcagaaagcagagcctgggcgagctgatcggcaccctgaacgccgccaaggtgcccgccgacaccgaggtggtgtgcgccccccccaccgcctacatcgacttcgccagacagaagctggaccccaagatcgccgtggccgcccagaactgctacaaggtgaccaacggcgccttcaccggcgagatcagccccggcatgatcaaggactgcggcgccacctgggtggtgctgggccacagcgagagaagacacgtgttcggcgagagcgacgagctgatcggccagaaggtggcccacgccctggccgagggcctgggcgtgatcgcctgcatcggcgagaagctggacgagagagaggccggcatcaccgagaaggtggtgttcgagcagaccaaggtgatcgccgacaacgtgaaggactggagcaaggtggtgctggcctacgagcccgtgtgggccatcggcaccggcaagaccgccaccccccagcaggcccaggaggtgcacgagaagctgagaggctggctgaagagcaacgtgagcgacgccgtggcccagagcaccagaatcatctacggcggcagcgtgaccggcgccacctgcaaggagctggccagccagcccgacgtggacggcttcctggtgggcggcgccagcctgaagcccgagttcgtggacatcatcaacgccaagcagtag

SEQ ID NO: 103374 - DNA, 504 bp, Artificial Sequence
  Description of Artificial Sequence: Synthetic coding sequence
atgatcaaggactgcggcgccacctgggtggtgctgggccacagcgagagaagacacgtgttcggcgagagcgacgagctgatcggccagaaggtggcccacgccctggccgagggcctgggcgtgatcgcctgcatcggcgagaagctggacgagagagaggccggcatcaccgagaaggtggtgttcgagcagaccaaggtgatcgccgacaacgtgaaggactggagcaaggtggtgctggcctacgagcccgtgtgggccatcggcaccggcaagaccgccaccccccagcaggcccaggaggtgcacgagaagctgagaggctggctgaagagcaacgtgagcgacgccgtggcccagagcaccagaatcatctacggcggcagcgtgaccggcgccacctgcaaggagctggccagccagcccgacgtggacggcttcctggtgggcggcgccagcctgaagcccgagttcgtggacatcatcaacgccaagcagtag

SEQ ID NO: 103375 - DNA, 1233 bp, Artificial Sequence
  Description of Artificial Sequence: Synthetic coding sequence
atggacgtgatggagctgctggaggaggacctgacctgccccatctgctgcagcctgttcgacgaccccagagtgctgccctgcagccacaacttctgcaagaagtgcctggagggcatcctggagggcagcgtgagaaacagcctgtggagacccgcccccttcaagtgccccacctgcagaaaggagaccagcgccaccggcatcaacagcctgcaggtgaactacagcctgaagggcatcgtggagaagtacaacaagatcaagatcagccccaagatgcccgtgtgcaagggccacctgggccagcccctgaacatcttctgcctgaccgacatgcagctgatctgcggcatctgcgccaccagaggcgagcacaccaagcacgtgttctgcagcatcgaggacgcctacgcccaggagagagacgccttcgagagcctgttccagagcttcgagacctggagaagaggcgacgccctgagcagactggacaccctggagaccagcaagagaaagagcctgcagctgctgaccaaggacagcgacaaggtgaaggagttcttcgagaagctgcagcacaccctggaccagaagaagaacgagatcctgagcgacttcgagaccatgaagctggccgtgatgcaggcctacgaccccgagatcaacaagctgaacaccatcctgcaggagcagagaatggccttcaacatcgccgaggccttcaaggacgtgagcgagcccatcgtgttcctgcagcagatgcaggagttcagagagaagatcaaggtgatcaaggagacccccctgccccccagcaacctgcccgccagccccctgatgaagaacttcgacaccagccagtgggaggacatcaagctggtggacgtggacaagctgagcctgccccaggacaccggcaccttcatcagcaagatcccctggagcttctacaagctgttcctgctgatcctgctgctgggcctggtgatcgtgttcggccccaccatgttcctggagtggagcctgttcgacgacctggccacctggaagggctgcctgagcaacttcagcagctacctgaccaagaccgccgacttcatcgagcagagcgtgttctactgggagcaggtgaccgacggcttcttcatcttcaacgagagattcaagaacttcaccctggtggtgctgaacaacgtggccgagttcgtgtgcaagtacaagctgctgtag

SEQ ID NO: 103376 - DNA, 1233 bp, Artificial Sequence; identical to SEQ ID NO: 103375
  Description of Artificial Sequence: Synthetic coding sequence

SEQ ID NO: 103377 - DNA, 1224 bp, Artificial Sequence
  Description of Artificial Sequence: Synthetic coding sequence
atggagctgctggaggaggacctgacctgccccatctgctgcagcctgttcgacgaccccagagtgctgccctgcagccacaacttctgcaagaagtgcctggagggcatcctggagggcagcgtgagaaacagcctgtggagacccgcccccttcaagtgccccacctgcagaaaggagaccagcgccaccggcatcaacagcctgcaggtgaactacagcctgaagggcatcgtggagaagtacaacaagatcaagatcagccccaagatgcccgtgtgcaagggccacctgggccagcccctgaacatcttctgcctgaccgacatgcagctgatctgcggcatctgcgccaccagaggcgagcacaccaagcacgtgttctgcagcatcgaggacgcctacgcccaggagagagacgccttcgagagcctgttccagagcttcgagacctggagaagaggcgacgccctgagcagactggacaccctggagaccagcaagagaaagagcctgcagctgctgaccaaggacagcgacaaggtgaaggagttcttcgagaagctgcagcacaccctggaccagaagaagaacgagatcctgagcgacttcgagaccatgaagctggccgtgatgcaggcctacgaccccgagatcaacaagctgaacaccatcctgcaggagcagagaatggccttcaacatcgccgaggccttcaaggacgtgagcgagcccatcgtgttcctgcagcagatgcaggagttcagagagaagatcaaggtgatcaaggagacccccctgccccccagcaacctgcccgccagccccctgatgaagaacttcgacaccagccagtgggaggacatcaagctggtggacgtggacaagctgagcctgccccaggacaccggcaccttcatcagcaagatcccctggagcttctacaagctgttcctgctgatcctgctgctgggcctggtgatcgtgttcggccccaccatgttcctggagtggagcctgttcgacgacctggccacctggaagggctgcctgagcaacttcagcagctacctgaccaagaccgccgacttcatcgagcagagcgtgttctactgggagcaggtgaccgacggcttcttcatcttcaacgagagattcaagaacttcaccctggtggtgctgaacaacgtggccgagttcgtgtgcaagtacaagctgctgtag

SEQ ID NO: 103378 - DNA, 801 bp, Artificial Sequence
  Description of Artificial Sequence: Synthetic coding sequence
atggagctgctggaggaggacctgacctgccccatctgctgcagcctgttcgacgaccccagagtgctgccctgcagccacaacttctgcaagaagtgcctggagggcatcctggagggcagcgtgagaaacagcctgtggagacccgcccccttcaagtgccccacctgcagaaaggagaccagcgccaccggcatcaacagcctgcaggtgaactacagcctgaagggcatcgtggagaagtacaacaagatcaagatcagccccaagatgcccgtgtgcaagggccacctgggccagcccctgaacatcttctgcctgaccgacatgcagctgatctgcggcatctgcgccaccagaggcgagcacaccaagcacgtgttctgcagcatcgaggacgcctacgcccaggagagagacgccttcgagagcctgttccagagcttcgagacctggagaagaggcgacgccctgagcagactggacaccctggagaccagcaagagaaagagcctgcagctgctgaccaaggacagcgacaaggtgaaggagttcttcgagaagctgcagcacaccctggaccagaagaagaacgagatcctgagcgacttcgagaccatgaagctggccgtgatgcaggcctacgaccccgagatcaacaagctgaacaccatcctgcaggagcagagaatggccttcaacatcgccgaggccttcaaggacgtgagcgagcccatcgtgttcctgcagcagatgcaggagttcagagagaagatcaaggtgatcaaggagaccccctag

SEQ ID NO: 103379 - DNA, 1224 bp, Artificial Sequence; identical to SEQ ID NO: 103377
  Description of Artificial Sequence: Synthetic coding sequence

SEQ ID NO: 103380 - DNA, 390 bp, Artificial Sequence
  Description of Artificial Sequence: Synthetic coding sequence
atggagctgctggaggaggacctgacctgccccatctgctgcagcctgttcgacgaccccagagtgctgccctgcagccacaacttctgcaagaagtgcctggagggcatcctggagggcagcgtgagaaacagcctgtggagacccgcccccttcaagtgccccacctgcagaaaggagaccagcgccaccggcatcaacagcctgcaggtgaactacagcctgaagggcatcgtggagaagtacaacaagatcaagatcagccccaagatgcccgtgtgcaagggccacctgggccagcccctgaacatcttctgcctgaccgacatgcagctgatctgcggcatctgcgccaccagaggcgagcacaccaagcacgtgttctgctag

SEQ ID NO: 103381 - DNA, 1224 bp, Artificial Sequence; identical to SEQ ID NO: 103377
  Description of Artificial Sequence: Synthetic coding sequence

SEQ ID NO: 103382 - DNA, 669 bp, Artificial Sequence
  Description of Artificial Sequence: Synthetic coding sequence
atgaacgacctgagcaacagagtgtggagcatcagccaggagcccgaccccgtgcagagactgcaggcctacaccgccaccgagcaggagatgcagcagcagatgagcctgggcgagctgtgccaccccgtgcccctgagcttcgagcccgtgaagagcttcttcaagggcctggtggaggccgtggagagcaccctgcagacccccctggacatcagactgaaggagagcatcaactgccagctgagcgaccccagcagcaccaagcccggcaccctgctgaagaccagccccagccccgagagaagcctgctgctgaagagctgctgggccgcctggggcccctgcccctgctgcggcagcaccagaagcggcaagtgctggctggtgaccgccagcccccccgccgccaccaccggcagactgacctgcagaagaagagcccccgccggcggctgggccagacccaccccccccttcggcgccgccggccccagacccccccccgcctgggccgccaccgccagccccggcgccagcagcgccaccaccctgagcaccggccccagcaccaccgccagcgccgccgcctgcggccccgccaccaccagcaccggcagcgccagcagctggaccaccagacccgccagcagccccagcaccacctag

SEQ ID NO: 103383 - DNA, 1329 bp, Artificial Sequence
  Description of Artificial Sequence: Synthetic coding sequence
atggccggcgccgccaccggcagcagaacccccggcagaagcgagctggtggagggctgcggctggagatgccccgagcacggcgacagagtggccgagctgttctgcagaagatgcagaagatgcgtgtgcgccctgtgccccgtgctgggcgcccacagaggccaccccgtgggcctggccctggaggccgccgtgcacgtgcagaagctgagccaggagtgcctgaagcagctggccatcaagaagcagcagcacatcgacaacatcacccagatcgaggacgccaccgagaagctgaaggccaacgccgagagcagcaagacctggctgaagggcaagttcaccgagctgagactgctgctggacgaggaggaggccctggccaagaagttcatcgacaagaacacccagctgaccctgcaggtgtacagagagcaggccgacagctgcagagagcagctggacatcatgaacgacctgagcaacagagtgtggagcatcagccaggagcccgaccccgtgcagagactgcaggcctacaccgccaccgagcaggagatgcagcagcagatgagcctgggcgagctgtgccaccccgtgcccctgagcttcgagcccgtgaagagcttcttcaagggcctggtggaggccgtggagagcaccctgcagacccccctggacatcagactgaaggagagcatcaactgccagctgagcgaccccagcagcaccaagcccggcaccctgctgaagaccagccccagccccgagagaagcctgctgctgaagtacgccagaacccccaccctggaccccgacaccatgcacgccagactgagactgagcgccgacagactgaccgtgagatgcggcctgctgggcagcctgggccccgtgcccgtgctgagattcgacgccctgtggcaggtgctggccagagactgcttcgccaccggcagacactactgggaggtggacgtgcaggaggccggcgccggctggtgggtgggcgccgcctacgccagcctgagaagaagaggcgccagcgccgccgccagactgggctgcaacagacagagctggtgcctgaagagatacgacctggagtactgggccttccacgacggccagagaagcagactgagacccagagacgacctggacagactgggcgtgttcctggactacgaggccggcgtgctggccttctacgacgtgaccggcggcatgagccacctgcacaccttcagagccaccttccaggagcccctgtaccccgccctgagactgtgggagggcgccatcagcatccccagactgccctag

SEQ ID NO: 103384 - DNA, 1329 bp, Artificial Sequence; identical to SEQ ID NO: 103383
  Description of Artificial Sequence: Synthetic coding sequence

SEQ ID NO: 103385 - DNA, 1221 bp, Artificial Sequence
  Description of Artificial Sequence: Synthetic coding sequence
atggccggcgccgccaccggcagcagaacccccggcagaagcgagctggtggagggctgcggctggagatgccccgagcacggcgacagagtggccgagctgttctgcagaagatgcagaagatgcgtgtgcgccctgtgccccgtgctgggcgcccacagaggccaccccgtgggcctggccctggaggccgccgtgcacgtgcagaagctgagccaggagtgcctgaagcagctggccatcaagaagcagcagcacatcgacaacatcacccagatcgaggacgccaccgagaagctgaaggccaacgccgagagcagcaagacctggctgaagggcaagttcaccgagctgagactgctgctggacgaggaggaggccctggccaagaagttcatcgacaagaacacccagctgaccctgcaggtgtacagagagcaggccgacagctgcagagagcagctggacatcatgaacgacctgagcaacagagtgtggagcatcagccaggagcccgaccccgtgcagagactgcaggcctacaccgccaccgagcaggagatgcagcagcagatgagcctgggcgagctgtgccaccccgtgcccctgagcttcgagcccgtgaagagcttcttcaagggcctggtggaggccgtggagagcaccctgcagacccccctggacatcagactgaaggagagcatcaactgccagctgagcgaccccagcagcaccaagcccggcaccctgctgaagaccagccccagccccgagagaagcctgctgctgaagtacgccagaacccccaccctggaccccgacaccatgcacgccagactgagactgagcgccgacagactgaccgtgagatgcggcctgctgggcagcctgggccccgtgcccgtgctgagattcgacgccctgtggcaggtgctggccagagactgcttcgccaccggcagacactactgggaggtggacgtgcaggaggccggcgccggctggtgggtgggcgccgcctacgccagcctgagaagaagaggcgccagcgccgccgccagactgggctgcaacagacagagctggtgcctgaagagatacgacctggagtactgggccttccacgacggccagagaagcgcctgcggccccgccaccaccagcaccggcagcgccagcagctggaccaccagacccgccagcagccccagcaccacctag

SEQ ID NO: 103386 - DNA, 762 bp, Artificial Sequence
  Description of Artificial Sequence: Synthetic coding sequence
atggccggcgccgccaccggcagcagaacccccggcagaagcgagctggtggagggctgcggctggagatgccccgagcacggcgacagagtggccgagctgttctgcagaagatgcagaagatgcgtgtgcgccctgtgccccgtgctgggcgcccacagaggccaccccgtgggcctggccctggaggccgccgtgcacgtgcagaagctgagccaggagtgcctgaagcagctggccatcaagaagcagcagcacatcgacaacatcacccagatcgaggacgccaccgagaagctgaaggccaacgccgagagcagcaagacctggctgaagggcaagttcaccgagctgagactgctgctggacgaggaggaggccctggccaagaagttcatcgacaagaacacccagctgaccctgcaggtgtacagagagcaggccgacagctgcagagagcagctggacatcatgaacgacctgagcaacagagtgtggagcatcagccaggagcccgaccccgtgcagagactgcaggcctacaccgccaccgagcaggagatgcagcagcagatgagcctgggcgagctgtgccaccccgtgcccctgagcttcgagcccgtgaagagcttcttcaagggcctggtggaggccgtggagagcaccctgcagacccccctggacatcagactgagccccaccaaccacgcctacagcgccctgaaggtgagcagccccagactggtgagcaacagaccctag

SEQ ID NO: 103387 - DNA, 1329 bp, Artificial Sequence; identical to SEQ ID NO: 103383
  Description of Artificial Sequence: Synthetic coding sequence

SEQ ID NO: 103388 - DNA, 672 bp, Artificial Sequence
  Description of Artificial Sequence: Synthetic coding sequence
atgagcgccggcagcgacggcggcggcagacacttctgcggcggcatcaactgccagctgagcgaccccagcagcaccaagcccggcaccctgctgaagaccagccccagccccgagagaagcctgctgctgaagtacgccagaacccccaccctggaccccgacaccatgcacgccagactgagactgagcgccgacagactgaccgtgagatgcggcctgctgggcagcctgggccccgtgcccgtgctgagattcgacgccctgtggcaggtgctggccagagactgcttcgccaccggcagacactactgggaggtggacgtgcaggaggccggcgccggctggtgggtgggcgccgcctacgccagcctgagaagaagaggcgccagcgccgccgccagactgggctgcaacagacagagctggtgcctgaagagatacgacctggagtactgggccttccacgacggccagagaagcagactgagacccagagacgacctggacagactgggcgtgttcctggactacgaggccggcgtgctggccttctacgacgtgaccggcggcatgagccacctgcacaccttcagagccaccttccaggagcccctgtaccccgccctgagactgtgggagggcgccatcagcatccccagactgccctag

SEQ ID NO: 103389 - DNA, 2316 bp, Artificial Sequence
  Description of Artificial Sequence: Synthetic coding sequence
atgcacagaagcggcagatacggcacccagcagcagagagccggcagcaagaccgccggccccccctgccagtggagcagaatggccagcgagggcaccaacatccccagccccgtggtgagacagatcgacaagcagttcctgatctgcagcatctgcctggagagatacaagaaccccaaggtgctgccctgcctgcacaccttctgcgagagatgcctgcagaactacatccccgcccacagcctgaccctgagctgccccgtgtgcagacagaccagcatcctgcccgagaagggcgtggccgccctgcagaacaacttcttcatcaccaacctgatggacgtgctgcagagaacccccggcagcaacgccgaggagagcagcatcctggagaccgtgaccgccgtggccgccggcaagcccctgagctgccccaaccacgacggcaacgtgatggagttctactgccagagctgcgagaccgccatgtgcagagagtgcaccgagggcgagcacgccgagcaccccaccgtgcccctgaaggacgtggtggagcagcacaaggccagcctgcaggtgcagctggacgccgtgaacaagagactgcccgagatcgacagcgccctgcagttcatcagcgagatcatccaccagctgaccaaccagaaggccagcatcgtggacgacatccacagcaccttcgacgagctgcagaagaccctgaacgtgagaaagagcgtgctgctgatggagctggaggtgaactacggcctgaagcacaaggtgctgcagagccagctggacaccctgctgcagggccaggagagcatcaagagctgcagcaacttcaccgcccaggccctgaaccacggcaccgagaccgaggtgctgctggtgaagaagcagatgagcgagaagctgaacgagctggccgaccaggacttccccctgcaccccagagagaacgaccagctggacttcatcgtggagaccgagggcctgaagaagagcatccacaacctgggcaccatcctgaccaccaacgccgtggccagcgagaccgtggccaccggcgagggcctgagacagaccatcatcggccagcccatgagcgtgaccatcaccaccaaggacaaggacggcgagctgtgcaagaccggcaacgcctacctgaccgccgagctgagcacccccgacggcagcgtggccgacggcgagatcctggacaacaagaacggcacctacgagttcctgtacaccgtgcagaaggagggcgacttcaccctgagcctgagactgtacgaccagcacatcagaggcagccccttcaagctgaaggtgatcagaagcgccgacgtgagccccaccaccgagggcgtgaagagaagagtgaagagccccggcagcggccacgtgaagcagaaggccgtgaagagacccgccagcatgtacagcaccggcaagagaaaggagaaccccatcgaggacgacctgatcttcagagtgggcaccaagggcagaaacaagggcgagttcaccaacctgcagggcgtggccgccagcaccaacggcaagatcctgatcgccgacagcaacaaccagtgcgtgcagatcttcagcaacgacggccagttcaagagcagattcggcatcagaggcagaagccccggccagctgcagagacccaccggcgtggccgtgcaccccagcggcgacatcatcatcgccgactacgacaacaagtgggtgagcatcttcagcagcgacggcaagttcaagaccaagatcggcagcggcaagctgatgggccccaagggcgtgagcgtggacagaaacggccacatcatcgtggtggacaacaaggcctgctgcgtgttcatcttccagcccaacggcaagatcgtgaccagattcggcagcagaggcaacggcgacagacagttcgccggcccccacttcgccgccgtgaacagcaacaacgagatcatcatcaccgacttccacaaccacagcgtgaaggtgttcaaccaggagggcgagttcatgctgaagttcggcagcaacggcgagggcaacggccagttcaacgcccccaccggcgtggccgtggacagcaacggcaacatcatcgtggccgactggggcaacagcagaatccaggtgttcgacggcagcggcagcttcctgagctacatcaacaccagcgccgaccccctgtacggcccccagggcctggccctgaccagcgacggccacgtggtggtggccgacagcggcaaccactgcttcaaggtgtacagatacctgcagtag

SEQ ID NO: 103390 - DNA, 2235 bp, Artificial Sequence
  Description of Artificial Sequence: Synthetic coding sequence
atggccagcgagggcaccaacatccccagccccgtggtgagacagatcgacaagcagttcctgatctgcagcatctgcctggagagatacaagaaccccaaggtgctgccctgcctgcacaccttctgcgagagatgcctgcagaactacatccccgcccacagcctgaccctgagctgccccgtgtgcagacagaccagcatcctgcccgagaagggcgtggccgccctgcagaacaacttcttcatcaccaacctgatggacgtgctgcagagaacccccggcagcaacgccgaggagagcagcatcctggagaccgtgaccgccgtggccgccggcaagcccctgagctgccccaaccacgacggcaacgtgatggagttctactgccagagctgcgagaccgccatgtgcagagagtgcaccgagggcgagcacgccgagcaccccaccgtgcccctgaaggacgtggtggagcagcacaaggccagcctgcaggtgcagctggacgccgtgaacaagagactgcccgagatcgacagcgccctgcagttcatcagcgagatcatccaccagctgaccaaccagaaggccagcatcgtggacgacatccacagcaccttcgacgagctgcagaagaccctgaacgtgagaaagagcgtgctgctgatggagctggaggtgaactacggcctgaagcacaaggtgctgcagagccagctggacaccctgctgcagggccaggagagcatcaagagctgcagcaacttcaccgcccaggccctgaaccacggcaccgagaccgaggtgctgctggtgaagaagcagatgagcgagaagctgaacgagctggccgaccaggacttccccctgcaccccagagagaacgaccagctggacttcatcgtggagaccgagggcctgaagaagagcatccacaacctgggcaccatcctgaccaccaacgccgtggccagcgagaccgtggccaccggcgagggcctgagacagaccatcatcggccagcccatgagcgtgaccatcaccaccaaggacaaggacggcgagctgtgcaagaccggcaacgcctacctgaccgccgagctgagcacccccgacggcagcgtggccgacggcgagatcctggacaacaagaacggcacctacgagttcctgtacaccgtgcagaaggagggcgacttcaccctgagcctgagactgtacgaccagcacatcagaggcagccccttcaagctgaaggtgatcagaagcgccgacgtgagccccaccaccgagggcgtgaagagaagagtgaagagccccggcagcggccacgtgaagcagaaggccgtgaagagacccgccagcatgtacagcaccggcaagagaaaggagaaccccatcgaggacgacctgatcttcagagtgggcaccaagggcagaaacaagggcgagttcaccaacctgcagggcgtggccgccagcaccaacggcaagatcctgatcgccgacagcaacaaccagtgcgtgcagatcttcagcaacgacggccagttcaagagcagattcggcatcagaggcagaagccccggccagctgcagagacccaccggcgtggccgtgcaccccagcggcgacatcatcatcgccgactacgacaacaagtgggtgagcatcttcagcagcgacggcaagttcaagaccaagatcggcagcggcaagctgatgggccccaagggcgtgagcgtggacagaaacggccacatcatcgtggtggacaacaaggcctgctgcgtgttcatcttccagcccaacggcaagatcgtgaccagattcggcagcagaggcaacggcgacagacagttcgccggcccccacttcgccgccgtgaacagcaacaacgagatcatcatcaccgacttccacaaccacagcgtgaaggtgttcaaccaggagggcgagttcatgctgaagttcggcagcaacggcgagggcaacggccagttcaacgcccccaccggcgtggccgtggacagcaacggcaacatcatcgtggccgactggggcaacagcagaatccaggtgttcgacggcagcggcagcttcctgagctacatcaacaccagcgccgaccccctgtacggcccccagggcctggccctgaccagcgacggccacgtggtggtggccgacagcggcaaccactgcttcaaggtgtacagatacctgcagtag

SEQ ID NO: 103391 - DNA, 1428 bp, Artificial Sequence
  Description of Artificial Sequence: Synthetic coding sequence
atggccagcgccgccagactgaccatgatgtgggaggaggtgacctgccccatctgcctggaccccttcgtggagcccgtgagcatcgagtgcggccacagcttctgccaggagtgcatcagccaggtgggcaagggcggcggcagcgtgtgccccgtgtgcagacagagattcctgctgaagaacctgagacccaacagacagctggccaacatggtgaacaacctgaaggagatcagccaggaggccagagagggcacccagggcgagagatgcgccgtgcacggcgagagactgcacctgttctgcgagaaggacggcaaggccctgtgctgggtgtgcgcccagagcagaaagcacagagaccacgccatggtgcccctggaggaggccgcccaggagtaccaggagaagctgcaggtggccctgggcgagctgagaagaaagcaggagctggccgagaagctggaggtggagatcgccatcaagagagccgactggaagaagaccgtggagacccagaagagcagaatccacgccgagttcgtgcagcagaagaacttcctggtggaggaggagcagagacagctgcaggagctggagaaggacgagagagagcagctgagaatcctgggcgagaaggaggccaagctggcccagcagagccaggccctgcaggagctgatcagcgagctggacagaagatgccacagcagcgccctggagctgctgcaggaggtgatcatcgtgctggagagaagcgagagctggaacctgaaggacctggacatcaccagccccgagctgagaagcgtgtgccacgtgcccggcctgaagaagatgctgagaacctgcgccgtgcacatcaccctggaccccgacaccgccaacccctggctgatcctgagcgaggacagaagacaggtgagactgggcgacacccagcagagcatccccggcaacgaggagagattcgacagctaccccatggtgctgggcgcccagcacttccacagcggcaagcactactgggaggtggacgtgaccggcaaggaggcctgggacctgggcgtgtgcagagacagcgtgagaagaaagggccacttcctgctgagcagcaagagcggcttctggaccatctggctgtggaacaagcagaagtacgaggccggcacctacccccagacccccctgcacctgcaggtgcccccctgccaggtgggcatcttcctggactacgaggccggcatggtgagcttctacaacatcaccgaccacggcagcctgatctacagcttcagcgagtgcgccttcaccggccccctgagacccttcttcagccccggcttcaacgacggcggcaagaacaccgcccccctgaccctgtgccccctgaacatcggcagccagggcagcaccgactactag

SEQ ID NO: 103392 - DNA, 1428 bp, Artificial Sequence
  Description of Artificial Sequence: Synthetic coding sequence
atggccagcgccgccagactgaccatgatgtgggaggaggtgacctgccccatctgcctggaccccttcgtggagcccgtgagcatcgagtgcggccacagcttctgccaggagtgcatcagccaggtgggcaagggcggcggcagcgtgtgccccgtgtgcagacagagattcctgctgaagaacctgagacccaacagacagctggccaacatggtgaacaacctgaaggagatcagccaggaggccagagagggcacccagggcgagagatgcgccgtgcacggcgagagactgcacctgttctgcgagaaggacggcaaggccctgtgctgggtgtgcgcccagagcagaaagcacagagaccacgccatggtgcccctggaggaggccgcccaggagtaccaggagaagctgcaggtggccctgggcgagctgagaagaaagcaggagctggccgagaagctggaggtggagatcgccatcaagagagccgactggaagaagaccgtggagacccagaagagcagaatccacgccgagttcgtgcagcagaagaacttcctggtggaggaggagcagagacagctgcaggagctggagaaggacgagagagagcagctgagaatcctgggcgagaaggaggccaagctggcccagcagagccaggccctgcaggagctgatcagcgagctggacagaagatgccacagcagcgccctggagctgctgcaggaggtgatcgtgctgggccccagaagcgagagctggaacctgaaggacctggacatcaccagccccgagctgagaagcgtgtgccacgtgcccggcctgaagaagatgctgagaacctgcgccgtgcacatcaccctggaccccgacaccgccaacccctggctgatcctgagcgaggacagaagacaggtgagactgggcgacacccagcagagcatccccggcaacgaggagagattcgacagctaccccatggtgctgggcgcccagcacttccacagcggcaagcactactgggaggtggacgtgaccggcaaggaggcctgggacctgggcgtgtgcagagacagcgtgagaagaaagggccacttcctgctgagcagcaagagcggcttctggaccatctggctgtggaacaagcagaagtacgaggccggcacctacccccagacccccctgcacctgcaggtgcccccctgccaggtgggcatcttcctggactacgaggccggcatggtgagcttctacaacatcaccgaccacggcagcctgatctacagcttcagcgagtgcgccttcaccggccccctgagacccttcttcagccccggcttcaacgacggcggcaagaacaccgcccccctgaccctgtgccccctgaacatcggcagccagggcagcaccgactactag

SEQ ID NO: 103393 - DNA, 1497 bp, Artificial Sequence
  Description of Artificial Sequence: Synthetic coding sequence
atggacttcagcgtgaaggtggacatcgagaaggaggtgacctgccccatctgcctggagctgctgaccgagcccctgagcctggactgcggccacagcttctgccaggcctgcatcaccgccaagatcaaggagagcgtgatcatcagcagaggcgagagcagctgccccgtgtgccagaccagattccagcccggcaacctgagacccaacagacacctggccaacatcgtggagagagtgaaggaggtgaagatgagcccccaggagggccagaagagagacgtgtgcgagcaccacggcaagaagctgcagatcttctgcaaggaggacggcaaggtgatctgctgggtgtgcgagctgagccaggagcaccagggccaccagaccttcagaatcaacgaggtggtgaaggagtgccaggagaagctgcaggtggccctgcagagactgatcaaggaggaccaggaggccgagaagctggaggacgacatcagacaggagagaaccgcctggaagaactacatccagatcgagagacagaagatcctgaagggcttcaacgagatgagagtgatcctggacaacgaggagcagagagagctgcagaagctggaggagggcgaggtgaacgtgctggacaacctggccgccgccaccgaccagctggtgcagcagagacaggacgccagcaccctgatcagcgacctgcagagaagactgagaggcagcagcgtggagatgctgcaggacgtgatcgacgtgatgaagagaagcgagagctggaccctgaagaagcccaagagcgtgagcaagaagctgaagagcgtgttcagagtgcccgacctgagcggcatgctgcaggtgctgaaggagctgaccgacgtgcagtactactgggtggacgtgatgctgaaccccggcagcgccaccagcaacgtggccatcagcgtggaccagagacaggtgaagaccgtgagaacctgcaccttcaagaacagcaacccctgcgacttcagcgccttcggcgtgttcggctgccagtacttcagcagcggcaagtactactgggaggtggacgtgagcggcaagatcgcctggatcctgggcgtgcacagcaagatcagcagcctgaacaagagaaagagcagcggcttcgccttcgaccccagcgtgaactacagcaaggtgtacagcagatacagaccccagtacggctactgggtgatcggcctgcagaacacctgcgagtacaacgccttcgaggacagcagcagcagcgaccccaaggtgctgaccctgttcatggccgtgcccccctgcagaatcggcgtgttcctggactacgaggccggcatcgtgagcttcttcaacgtgaccaaccacggcgccctgatctacaagttcagcggctgcagattcagcagacccgcctacccctacttcaacccctggaactgcctggtgcccatgaccgtgtgcccccccagcagctag

SEQ ID NO: 103394 - DNA, 684 bp, Artificial Sequence
  Description of Artificial Sequence: Synthetic coding sequence
atggacttcagcgtgaaggtggacatcgagaaggaggtgacctgccccatctgcctggagctgctgaccgagcccctgagcctggactgcggccacagcttctgccaggcctgcatcaccgccaagatcaaggagagcgtgatcatcagcagaggcgagagcagctgccccgtgtgccagaccagattccagcccggcaacctgagacccaacagacacctggccaacatcgtggagagagtgaaggaggtgaagatgagcccccaggagggccagaagagagacgtgtgcgagcaccacggcaagaagctgcagatcttctgcaaggaggacggcaaggtgatctgctgggtgtgcgagctgagccaggagcaccagggccaccagaccttcagaatcaacgaggtggtgaaggagtgccaggagaagctgcaggtggccctgcagagactgatcaaggaggaccaggaggccgagaagctggaggacgacatcagacaggagagaaccgcctggaagaactacatccagatcgagagacagaagatcctgaagggcttcaacgagatgagagtgatcctggacaacgaggagcagagagagctgcagaagctggaggagggcgaggtgaacgtgctggacaacctggccgccgccaccgaccagctggtgcagcagagatag

SEQ ID NO: 103395 - DNA, 612 bp, Artificial Sequence
  Description of Artificial Sequence: Synthetic coding sequence
atggacttcagcgtgaaggtggacatcgagaaggaggtgacctgccccatctgcctggagctgctgaccgagcccctgagcctggactgcggccacagcttctgccaggcctgcatcaccgccaagatcaaggagagcgtgatcatcagcagaggcgagagcagctgccccgtgtgccagaccagattccagcccggcaacctgagacccaacagacacctggccaacatcgtggagagagtgaaggaggtgaagatgagcccccaggagggccagaagagagacgtgtgcgagcaccacggcaagaagctgcagatcttctgcaaggaggacggcaaggtgatctgctgggtgtgcgagctgagccaggagcaccagggccaccagaccttcagaatcaacgaggtggtgaaggagtgccaggagaagctgcaggtggccctgcagagactgatcaaggaggaccaggaggccgagaagctggaggacgacatcagacaggagagaaccgcctggaagaactacatccagatcgagagacagaagatcctgaagggcttcaacgagatgagagtgatcctggacaacgaggagcagagagagctgcagtag

SEQ ID NO: 103396 - DNA, 1263 bp, Artificial Sequence
  Description of Artificial Sequence: Synthetic coding sequence
atggacttcagcgtgaaggtggacatcgagaaggaggtgacctgccccatctgcctggagctgctgaccgagcccctgagcctggactgcggccacagcttctgccaggcctgcatcaccgccaagatcaaggagagcgtgatcatcagcagaggcgagagcagctgccccgtgtgccagaccagattccagcccggcaacctgagacccaacagacacctggccaacatcgtggagagagtgaaggaggtgaagatgagcccccaggagggccagaagagagacgtgtgcgagcaccacggcaagaagctgcagatcttctgcaaggaggacggcaaggtgatcctggacaacgaggagcagagagagctgcagaagctggaggagggcgaggtgaacgtgctggacaacctggccgccgccaccgaccagctggtgcagcagagacaggacgccagcaccctgatcagcgacctgcagagaagactgagaggcagcagcgtggagatgctgcaggacgtgatcgacgtgatgaagagaagcgagagctggaccctgaagaagcccaagagcgtgagcaagaagctgaagagcgtgttcagagtgcccgacctgagcggcatgctgcaggtgctgaaggagctgaccgacgtgcagtactactgggtggacgtgatgctgaaccccggcagcgccaccagcaacgtggccatcagcgtggaccagagacaggtgaagaccgtgagaacctgcaccttcaagaacagcaacccctgcgacttcagcgccttcggcgtgttcggctgccagtacttcagcagcggcaagtactactgggaggtggacgtgagcggcaagatcgcctggatcctgggcgtgcacagcaagatcagcagcctgaacaagagaaagagcagcggcttcgccttcgaccccagcgtgaactacagcaaggtgtacagcagatacagaccccagtacggctactgggtgatcggcctgcagaacacctgcgagtacaacgccttcgaggacagcagcagcagcgaccccaaggtgctgaccctgttcatggccgtgcccccctgcagaatcggcgtgttcctggactacgaggccggcatcgtgagcttcttcaacgtgaccaaccacggcgccctgatctacaagttcagcggctgcagattcagcagacccgcctacccctacttcaacccctggaactgcctggtgcccatgaccgtgtgcccccccagcagctag

SEQ ID NO: 103397 - DNA, 930 bp, Artificial Sequence
  Description of Artificial Sequence: Synthetic coding sequence
atgagagtgatcctggacaacgaggagcagagagagctgcagaagctggaggagggcgaggtgaacgtgctggacaacctggccgccgccaccgaccagctggtgcagcagagacaggacgccagcaccctgatcagcgacctgcagagaagactgagaggcagcagcgtggagatgctgcaggacgtgatcgacgtgatgaagagaagcgagagctggaccctgaagaagcccaagagcgtgagcaagaagctgaagagcgtgttcagagtgcccgacctgagcggcatgctgcaggtgctgaaggagctgaccgacgtgcagtactactgggtggacgtgatgctgaaccccggcagcgccaccagcaacgtggccatcagcgtggaccagagacaggtgaagaccgtgagaacctgcaccttcaagaacagcaacccctgcgacttcagcgccttcggcgtgttcggctgccagtacttcagcagcggcaagtactactgggaggtggacgtgagcggcaagatcgcctggatcctgggcgtgcacagcaagatcagcagcctgaacaagagaaagagcagcggcttcgccttcgaccccagcgtgaactacagcaaggtgtacagcagatacagaccccagtacggctactgggtgatcggcctgcagaacacctgcgagtacaacgccttcgaggacagcagcagcagcgaccccaaggtgctgaccctgttcatggccgtgcccccctgcagaatcggcgtgttcctggactacgaggccggcatcgtgagcttcttcaacgtgaccaaccacggcgccctgatctacaagttcagcggctgcagattcagcagacccgcctacccctacttcaacccctggaactgcctggtgcccatgaccgtgtgcccccccagcagctag

SEQ ID NO: 103398 - DNA, 1893 bp, Artificial Sequence
  Description of Artificial Sequence: Synthetic coding sequence
atggccgagctgtgccccctggccgaggagctgagctgcagcatctgcctggagcccttcaaggagcccgtgaccaccccctgcggccacaacttctgcggcagctgcctgaacgagacctgggccgtgcagggcagcccctacctgtgcccccagtgcagagccgtgtaccaggccagaccccagctgcacaagaacaccgtgctgtgcaacgtggtggagcagttcctgcaggccgacctggccagagagccccccgccgacgtgtggaccccccccgccagagccagcgcccccagccccaacgcccaggtggcctgcgaccactgcctgaaggaggccgccgtgaagacctgcctggtgtgcatggccagcttctgccaggagcacctgcagccccacttcgacagccccgccttccaggaccaccccctgcagccccccgtgagagacctgctgagaagaaagtgcagccagcacaacagactgagagagttcttctgccccgagcacagcgagtgcatctgccacatctgcctggtggagcacaagacctgcagccccgccagcctgagccaggccagcgccgacctggaggccaccctgagacacaagctgaccgtgatgtacagccagatcaacggcgccagcagagccctggacgacgtgagaaacagacagcaggacgtgagaatgaccgccaacagaaaggtggagcagctgcagcaggagtacaccgagatgaaggccctgctggacgccagcgagaccaccagcaccagaaagatcaaggaggaggagaagagagtgaacagcaagttcgacaccatctaccagatcctgctgaagaagaagagcgagatccagaccctgaaggaggagatcgagcagagcctgaccaagagagacgagttcgagttcctggagaaggccagcaagctgagaggcatcagcaccaagcccgtgtacatccccgaggtggagctgaaccacaagctgatcaagggcatccaccagagcaccatcgacctgaagaacgagctgaagcagtgcatcggcagactgcaggagcccacccccagcagcggcgaccccggcgagcacgaccccgccagcacccacaagagcaccagacccgtgaagaaggtgagcaaggaggagaagaagagcaagaagcccccccccgtgcccgccctgcccagcaagctgcccaccttcggcgcccccgagcagctggtggacctgaagcaggccggcctggaggccgccgccaaggccaccagcagccaccccaacagcaccagcctgaaggccaaggtgctggagaccttcctggccaagagcagacccgagctgctggagtactacatcaaggtgatcctggactacaacaccgcccacaacaaggtggccctgagcgagtgctacaccgtggccagcgtggccgagatgccccagaactacagaccccacccccagagattcacctactgcagccaggtgctgggcctgcactgctacaagaagggcatccactactgggaggtggagctgcagaagaacaacttctgcggcgtgggcatctgctacggcagcatgaacagacagggccccgagagcagactgggcagaaacagcgccagctggtgcgtggagtggttcaacaccaagatcagcgcctggcacaacaacgtggagaagaccctgcccagcaccaaggccaccagagtgggcgtgctgctgaactgcgaccacggcttcgtgatcttcttcgccgtggccgacaaggtgcacctgatgtacaagttcagagtggacttcaccgaggccctgtaccccgccttctgggtgttcagcgccggcgccaccctgagcatctgcagccccaagtag

SEQ ID NO: 103399 - DNA, 1893 bp, Artificial Sequence; identical to SEQ ID NO: 103398
  Description of Artificial Sequence: Synthetic coding sequence

SEQ ID NO: 103400 - DNA, 1077 bp, Artificial Sequence
  Description of Artificial Sequence: Synthetic coding sequence
atggccagcggcagcgtggccgagtgcctgcagcaggagaccacctgccccgtgtgcctgcagtacttcgccgagcccatgatgctggactgcggccacaacatctgctgcgcctgcctggccagatgctggggcaccgccgagaccaacgtgagctgcccccagtgcagagagaccttcccccagagacacatgagacccaacagacacctggccaacgtgacccagctggtgaagcagctgagaaccgagagacccagcggccccggcggcgagatgggcgtgtgcgagaagcacagagagcccctgaagctgtactgcgaggaggaccagatgcccatctgcgtggtgtgcgacagaagcagagagcacagaggccacagcgtgctgcccctggaggaggccgtggagggcttcaaggagcagatccagaaccagctggaccacctgaagagagtgaaggacctgaagaagagaagaagagcccagggcgagcaggccagagccgagctgctgagcctgacccagatggagagagagaagatcgtgtgggagttcgagcagctgtaccacagcctgaaggagcacgagtacagactgctggccagactggaggagctggacctggccatctacaacagcatcaacggcgccatcacccagttcagctgcaacatcagccacctgagcagcctgatcgcccagctggaggagaagcagcagcagcccaccagagagctgctgcaggacatcggcgacaccctgagcagagccgagagaatcagaatccccgagccctggatcaccccccccgacctgcaggagaagatccacatcttcgcccagaagtgcctgttcctgaccgagagcctgaagcagttcaccgagaagatgcagagcgacatggagaagatccaggagctgagagaggcccagctgtacagcgtggacgtgaccctggaccccgacaccgcctaccccagcctgatcctgagcgacaacctgagacaggtgagatacagctacctgcagcaggacctgcccgacaaccccgagagaagccccagcaccacctag

SEQ ID NO: 103401 - DNA, 1542 bp, Artificial Sequence
  Description of Artificial Sequence: Synthetic coding sequence
atggccagcggcagcgtggccgagtgcctgcagcaggagaccacctgccccgtgtgcctgcagtacttcgccgagcccatgatgctggactgcggccacaacatctgctgcgcctgcctggccagatgctggggcaccgccgagaccaacgtgagctgcccccagtgcagagagaccttcccccagagacacatgagacccaacagacacctggccaacgtgacccagctggtgaagcagctgagaaccgagagacccagcggccccggcggcgagatgggcgtgtgcgagaagcacagagagcccctgaagctgtactgcgaggaggaccagatgcccatctgcgtggtgtgcgacagaagcagagagcacagaggccacagcgtgctgcccctggaggaggccgtggagggcttcaaggagcagatccagaaccagctggaccacctgaagagagtgaaggacctgaagaagagaagaagagcccagggcgagcaggccagagccgagctgctgagcctgacccagatggagagagagaagatcgtgtgggagttcgagcagctgtaccacagcctgaaggagcacgagtacagactgctggccagactggaggagctggacctggccatctacaacagcatcaacggcgccatcacccagttcagctgcaacatcagccacctgagcagcctgatcgcccagctggaggagaagcagcagcagcccaccagagagctgctgcaggacatcggcgacaccctgagcagagccgagagaatcagaatccccgagccctggatcaccccccccgacctgcaggagaagatccacatcttcgcccagaagtgcctgttcctgaccgagagcctgaagcagttcaccgagaagatgcagagcgacatggagaagatccaggagctgagagaggcccagctgtacagcgtggacgtgaccctggaccccgacaccgcctaccccagcctgatcctgagcgacaacctgagacaggtgagatacagctacctgcagcaggacctgcccgacaaccccgagagattcaacctgttcccctgcgtgctgggcagcccctgcttcatcgccggcagacactactgggaggtggaggtgggcgacaaggccaagtggaccatcggcgtgtgcgaggacagcgtgtgcagaaagggcggcgtgaccagcgccccccagaacggcttctgggccgtgagcctgtggtacggcaaggagtactgggccctgaccagccccatgaccgccctgcccctgagaacccccctgcagagagtgggcatcttcctggactacgacgccggcgaggtgagcttctacaacgtgaccgagagatgccacaccttcaccttcagccacgccaccttctgcggccccgtgagaccctacttcagcctgagctacagcggcggcaagagcgccgcccccctgatcatctgccccatgagcggcatcgacggcttcagcggccacgtgggcaaccacggccacagcatggagaccagcccctag

SEQ ID NO: 103402 - DNA, 1542 bp, Artificial Sequence; identical to SEQ ID NO: 103401
  Description of Artificial Sequence: Synthetic coding sequence

SEQ ID NO: 103403 - DNA, 1077 bp, Artificial Sequence; identical to SEQ ID NO: 103400
  Description of Artificial Sequence: Synthetic coding sequence

SEQ ID NO: 103404 - DNA, 747 bp, Artificial Sequence
  Description of Artificial Sequence: Synthetic coding sequence
tgactgaagcagttcaccgagaagatgcagagcgacatggagaagatccaggagagcgccgacagcctggagggcggcatcctggacctgggcagcgtgctgagccacatcctgcccgtgagcgagctgagagaggcccagctgtacagcgtggacgtgaccctggaccccgacaccgcctaccccagcctgatcctgagcgacaacctgagacaggtgagatacagctacctgcagcaggacctgcccgacaaccccgagagattcaacctgttcccctgcgtgctgggcagcccctgcttcatcgccggcagacactactgggaggtggaggtgggcgacaaggccaagtggaccatcggcgtgtgcgaggacagcgtgtgcagaaagggcggcgtgaccagcgccccccagaacggcttctgggccgtgagcctgtggtacggcaaggagtactgggccctgaccagccccatgaccgccctgcccctgagaacccccctgcagagagtgggcatcttcctggactacgacgccggcgaggtgagcttctacaacgtgaccgagagatgccacaccttcaccttcagccacgccaccttctgcggccccgtgagaccctacttcagcctgagctacagcggcggcaagagcgccgcccccctgatcatctgccccatgagcggcatcgacggcttcagcggccacgtgggcaaccacggccacagcatggagaccagcccctag

SEQ ID NO: 103405 - DNA, 1077 bp, Artificial Sequence; identical to SEQ ID NO: 103400
  Description of Artificial Sequence: Synthetic coding sequence

SEQ ID NO: 103406 - DNA, 747 bp, Artificial Sequence; identical to SEQ ID NO: 103404
  Description of Artificial Sequence: Synthetic coding sequence

SEQ ID NO: 103407 - DNA, 1077 bp, Artificial Sequence; identical to SEQ ID NO: 103400
  Description of Artificial Sequence: Synthetic coding sequence

SEQ ID NO: 103408 - DNA, 747 bp, Artificial Sequence; identical to SEQ ID NO: 103404
  Description of Artificial Sequence: Synthetic coding sequence

SEQ ID NO: 103409 - DNA, 750 bp, Artificial Sequence
  Description of Artificial Sequence: Synthetic coding sequence
atggccagcggcagcgtggccgagtgcctgcagcaggagaccacctgccccgtgtgcctgcagtacttcgccgagcccatgatgctggactgcggccacaacatctgctgcgcctgcctggccagatgctggggcaccgccgagaccaacgtgagctgcccccagtgcagagagaccttcccccagagacacatgagacccaacagacacctggccaacgtgacccagctggtgaagcagctgagaaccgagagacccagcggccccggcggcgagatgggcgtgtgcgagaagcacagagagcccctgaagctgtactgcgaggaggaccagatgcccatctgcgtggtgtgcgacagaagcagagagcacagaggccacagcgtgctgcccctggaggaggccgtggagggcttcaaggagcagatccagaaccagctggaccacctgaagagagtgaaggacctgaagaagagaagaagagcccagggcgagcaggccagagccgagctgctgagcctgacccagatggagagagagaagatcgtgtgggagttcgagcagctgtaccacagcctgaaggagcacgagtacagactgctggccagactggaggagctggacctggccatctacaacagcatcaacggcgccatcacccagttcagctgcaacatcagccacctgagcagcctgatcgcccagctggaggagaagcagcagcagcccaccagagagctgctgcagtag

SEQ ID NO: 103410 - DNA, 1542 bp, Artificial Sequence; identical to SEQ ID NO: 103401
  Description of Artificial Sequence: Synthetic coding sequence

SEQ ID NO: 103411 - DNA, 1542 bp, Artificial Sequence; identical to SEQ ID NO: 103401
  Description of Artificial Sequence: Synthetic coding sequence

SEQ ID NO: 103412 - DNA, 750 bp, Artificial Sequence; identical to SEQ ID NO: 103409
  Description of Artificial Sequence: Synthetic coding sequence

SEQ ID NO: 103413 - DNA, 1542 bp, Artificial Sequence; identical to SEQ ID NO: 103401
  Description of Artificial Sequence: Synthetic coding sequence

SEQ ID NO: 103414 - DNA, 744 bp, Artificial Sequence
  Description of Artificial Sequence: Synthetic coding sequence
ctgaagcagttcaccgagaagatgcagagcgacatggagaagatccaggagagcgccgacagcctggagggcggcatcctggacctgggcagcgtgctgagccacatcctgcccgtgagcgagctgagagaggcccagctgtacagcgtggacgtgaccctggaccccgacaccgcctaccccagcctgatcctgagcgacaacctgagacaggtgagatacagctacctgcagcaggacctgcccgacaaccccgagagattcaacctgttcccctgcgtgctgggcagcccctgcttcatcgccggcagacactactgggaggtggaggtgggcgacaaggccaagtggaccatcggcgtgtgcgaggacagcgtgtgcagaaagggcggcgtgaccagcgccccccagaacggcttctgggccgtgagcctgtggtacggcaaggagtactgggccctgaccagccccatgaccgccctgcccctgagaacccccctgcagagagtgggcatcttcctggactacgacgccggcgaggtgagcttctacaacgtgaccgagagatgccacaccttcaccttcagccacgccaccttctgcggccccgtgagaccctacttcagcctgagctacagcggcggcaagagcgccgcccccctgatcatctgccccatgagcggcatcgacggcttcagcggccacgtgggcaaccacggccacagcatggagaccagcccctag

SEQ ID NO: 103415 - DNA, 750 bp, Artificial Sequence; identical to SEQ ID NO: 103409
  Description of Artificial Sequence: Synthetic coding sequence

SEQ ID NO: 103416 - DNA, 159 bp, Artificial Sequence
  Description of Artificial Sequence: Synthetic coding sequence
tgactgagagaggcccagctgtacagcgtggacgtgaccctggaccccgacaccgcctaccccagcctgatcctgagcgacaacctgagacaggtgagatacagctacctgcagcaggacctgcccgacaaccccgagagaagccccagcaccacctag

SEQ ID NO: 103417 - DNA, 696 bp, Artificial Sequence
  Description of Artificial Sequence: Synthetic coding sequence
tgaagcgccgacagcctggagggcggcatcctggacctgggcagcgtgctgagccacatcctgcccgtgagcgagctgagagaggcccagctgtacagcgtggacgtgaccctggaccccgacaccgcctaccccagcctgatcctgagcgacaacctgagacaggtgagatacagctacctgcagcaggacctgcccgacaaccccgagagattcaacctgttcccctgcgtgctgggcagcccctgcttcatcgccggcagacactactgggaggtggaggtgggcgacaaggccaagtggaccatcggcgtgtgcgaggacagcgtgtgcagaaagggcggcgtgaccagcgccccccagaacggcttctgggccgtgagcctgtggtacggcaaggagtactgggccctgaccagccccatgaccgccctgcccctgagaacccccctgcagagagtgggcatcttcctggactacgacgccggcgaggtgagcttctacaacgtgaccgagagatgccacaccttcaccttcagccacgccaccttctgcggccccgtgagaccctacttcagcctgagctacagcggcggcaagagcgccgcccccctgatcatctgccccatgagcggcatcgacggcttcagcggccacgtgggcaaccacggccacagcatggagaccagcccctag

SEQ ID NO: 103418 - DNA, 624 bp, Artificial Sequence
  Description of Artificial Sequence: Synthetic coding sequence
tgactgagagaggcccagctgtacagcgtggacgtgaccctggaccccgacaccgcctaccccagcctgatcctgagcgacaacctgagacaggtgagatacagctacctgcagcaggacctgcccgacaaccccgagagattcaacctgttcccctgcgtgctgggcagcccctgcttcatcgccggcagacactactgggaggtggaggtgggcgacaaggccaagtggaccatcggcgtgtgcgaggacagcgtgtgcagaaagggcggcgtgaccagcgccccccagaacggcttctgggccgtgagcctgtggtacggcaaggagtactgggccctgaccagccccatgaccgccctgcccctgagaacccccctgcagagagtgggcatcttcctggactacgacgccggcgaggtgagcttctacaacgtgaccgagagatgccacaccttcaccttcagccacgccaccttctgcggccccgtgagaccctacttcagcctgagctacagcggcggcaagagcgccgcccccctgatcatctgccccatgagcggcatcgacggcttcagcggccacgtgggcaaccacggccacagcatggagaccagcccctag

SEQ ID NO: 103419 - DNA, 1077 bp, Artificial Sequence; identical to SEQ ID NO: 103400
  Description of Artificial Sequence: Synthetic coding sequence

SEQ ID NO: 103420 - DNA, 747 bp, Artificial Sequence; identical to SEQ ID NO: 103404
  Description of Artificial Sequence: Synthetic coding sequence

SEQ ID NO: 103421 - DNA, 750 bp, Artificial Sequence; identical to SEQ ID NO: 103409
  Description of Artificial Sequence: Synthetic coding sequence

SEQ ID NO: 103422 - DNA, 2202 bp, Artificial Sequence
  Description of Artificial Sequence: Synthetic coding sequence
atggccaagagagaggacagccccggccccgaggtgcagcccatggacaagcagttcctggtgtgcagcatctgcctggacagataccagtgccccaaggtgctgccctgcctgcacaccttctgcgagagatgcctgcagaactacatccccgcccagagcctgaccctgagctgccccgtgtgcagacagaccagcatcctgcccgagcagggcgtgagcgccctgcagaacaacttcttcatcagcagcctgatggaggccatgcagcaggcccccgacggcgcccacgaccccgaggacccccaccccctgagcgtggtggccggcagacccctgagctgccccaaccacgagggcaagaccatggagttctactgcgaggcctgcgagaccgccatgtgcggcgagtgcagagccggcgagcacagagagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggagaccatctgcggcgccaagcagaaggtgctgcagagccagctggacaccctgagacagggccaggagcacatcggcagcagctgcagcttcgccgagcaggccctgagactgggcagcgcccccgaggtgctgctggtgagaaagcacatgagagagagactggccgccctggccgcccaggccttccccgagagaccccacgagaacgcccagctggagctggtgctggaggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgtggccgactggggcaacagcagaatccaggtgttcgacagcagcggcagcttcctgagctacatcaacaccagcgccgagcccctgtacggcccccagggcctggccctgaccagcgacggccacgtggtggtggccgacgccggcaaccactgcttcaaggcctacagatacctgcagtag

SEQ ID NO: 103423 - DNA, 2235 bp, Artificial Sequence
  Description of Artificial Sequence: Synthetic coding sequence
atggccaagagagaggacagccccggccccgaggtgcagcccatggacaagcagttcctggtgtgcagcatctgcctggacagataccagtgccccaaggtgctgccctgcctgcacaccttctgcgagagatgcctgcagaactacatccccgcccagagcctgaccctgagctgccccgtgtgcagacagaccagcatcctgcccgagcagggcgtgagcgccctgcagaacaacttcttcatcagcagcctgatggaggccatgcagcaggcccccgacggcgcccacgaccccgaggacccccaccccctgagcgtggtggccggcagacccctgagctgccccaaccacgagggcaagaccatggagttctactgcgaggcctgcgagaccgccatgtgcggcgagtgcagagccggcgagcacagagagcacggcaccgtgctgctgagagacgtggtggagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggagaccatctgcggcgccaagcagaaggtgctgcagagccagctggacaccctgagacagggccaggagcacatcggcagcagctgcagcttcgccgagcaggccctgagactgggcagcgcccccgaggtgctgctggtgagaaagcacatgagagagagactggccgccctggccgcccaggccttccccgagagaccccacgagaacgcccagctggagctggtgctggaggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgtggccgactggggcaacagcagaatccaggtgttcgacagcagcggcagcttcctgagctacatcaacaccagcgccgagcccctgtacggcccccagggcctggccctgaccagcgacggccacgtggtggtggccgacgccggcaaccactgcttcaaggcctacagatacctgcagtag

SEQ ID NO: 103424 - DNA, 2235 bp, Artificial Sequence; identical to SEQ ID NO: 103423
  Description of Artificial Sequence: Synthetic coding sequence

SEQ ID NO: 103425 - DNA, 2235 bp, Artificial Sequence; identical to SEQ ID NO: 103423
  Description of Artificial Sequence: Synthetic coding sequence

SEQ ID NO: 103426 - DNA, 2229 bp, Artificial Sequence
  Description of Artificial Sequence: Synthetic coding sequence
atggccaagagagaggacagccccggccccgaggtgcagcccatggacaagcagttcctggtgtgcagcatctgcctggacagataccagtgccccaaggtgctgccctgcctgcacaccttctgcgagagatgcctgcagaactacatccccgcccagagcctgaccctgagctgccccgtgtgcagacagaccagcatcctgcccgagcagggcgtgagcgccctgcagaacaacttcttcatcagcagcctgatggaggccatgcagcaggcccccgacggcgcccacgaccccgaggacccccaccccctgagcgtggtggccggcagacccctgagctgccccaaccacgagggcaagaccatggagttctactgcgaggcctgcgagaccgccatgtgcggcgagtgcagagccggcgagcacagagagcacggcaccgtgctgctgagagacgtggtggagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggagaccatctgcggcgccaagcagaaggtgctgcagagccagctggacaccctgagacagggccaggagcacatcggcagcagctgcagcttcgccgagcaggccctgagactgggcagcgcccccgaggtgctgctggtgagaaagcacatgagagagagactggccgccctggccgcccaggccttccccgagagaccccacgagaacgcccagctggagctggtgctggaggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgacgtgtgcagagccagcccctaccccagctacacccccccccacccctgccagagcgccccccacccccccgcctggggccagaacagcctgccccaggacagaagccccagcagctgcctgcccaccaccctgtacaccctgaccgagaccgccatcccccaccccccctactag

SEQ ID NO: 103427 - DNA, 1878 bp, Artificial Sequence
  Description of Artificial Sequence: Synthetic coding sequence
atgaagaccatggagttctactgcgaggcctgcgagaccgccatgtgcggcgagtgcagagccggcgagcacagagagcacggcaccgtgctgctgagagacgtggtggagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggagaccatctgcggcgccaagcagaaggtgctgcagagccagctggacaccctgagacagggccaggagcacatcggcagcagctgcagcttcgccgagcaggccctgagactgggcagcgcccccgaggtgctgctggtgagaaagcacatgagagagagactggccgccctggccgcccaggccttccccgagagaccccacgagaacgcccagctggagctggtgctggaggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgtggccgactggggcaacagcagaatccaggtgttcgacagcagcggcagcttcctgagctacatcaacaccagcgccgagcccctgtacggcccccagggcctggccctgaccagcgacggccacgtggtggtggccgacgccggcaaccactgcttcaaggcctacagatacctgcagtag

SEQ ID NO: 103428 - DNA, 2001 bp, Artificial Sequence
  Description of Artificial Sequence: Synthetic coding sequence
atggccaagagagaggacagccccggccccgaggtgcagcccatggacaagcagttcctggtgtgcagcatctgcctggacagataccagtgccccaaggtgctgccctgcctgcacaccttctgcgagagatgcctgcagaactacatccccgcccagagcctgaccctgagctgccccgtgtgcagacagaccagcatcctgcccgagcagggcgtgagcgccctgcagaacaacttcttcatcagcagcctgatggaggccatgcagcaggcccccgacggcgcccacgaccccgaggacccccaccccctgagcgtggtggccggcagacccctgagctgccccaaccacgagggcaagaccatggagttctactgcgaggcctgcgagaccgccatgtgcggcgagtgcagagccggcgagcacagagagcacggcaccgtgctgctgagagacgtggtggagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgtggccgactggggcaacagcagaatccaggtgttcgacagcagcggcagcttcctgagctacatcaacaccagcgccgagcccctgtacggcccccagggcctggccctgaccagcgacggccacgtggtggtggccgacgccggcaaccactgcttcaaggcctacagatacctgcagtag

SEQ ID NO: 103429 - DNA, 2226 bp, Artificial Sequence
  Description of Artificial Sequence: Synthetic coding sequence
atggccaagagagaggacagccccggccccgaggtgcagcccatggacaagcagttcctggtgtgcagcatctgcctggacagataccagtgccccaaggtgctgccctgcctgcacaccttctgcgagagatgcctgcagaactacatccccgcccagagcctgaccctgagctgccccgtgtgcagacagaccagcatcctgcccgagcagggcgtgagcgccctgcagaacaacttcttcatcagcagcctgatggaggccatgcagcaggcccccgacggcgcccacgaccccgaggacccccaccccctgagcgtggtggccggcagacccctgagctgccccaaccacgagggcaagaccatggagttctactgcgaggcctgcgagaccgccatgtgcggcgagtgcagagccggcgagcacagagagcacggcaccgtgctgctgagagacgtggtggagcagcacaaggccgccctgcagagacagctggaggccgtgagaggcagactgccccagctgagcgccgccatcgccctggtgggcggcatcagccagcagctgcaggagagaaaggccgaggccctggcccagatcagcgccgccttcgaggacctggagcaggccctgcagcagagaaagcaggccctggtgagcgacctggagaccatctgcggcgccaagcagaaggtgctgcagagccagctggacaccctgagacagggccaggagcacatcggcagcagctgcagcttcgccgagcaggccctgagactgggcagcgcccccgaggtgctgctggtgagaaagcacatgagagagagactggccgccctggccgcccaggccttccccgagagaccccacgagaacgcccagctggagctggtgctggaggtggacggcctgagaagaagcgtgctgaacctgggcgccctgctgaccaccagcgccaccgcccacgagaccgtggccaccggcgagggcctgagacaggccctggtgggccagcccgccagcctgaccgtgaccaccaaggacaaggacggcagactggtgagaaccggcagcgccgagctgagagccgagatcaccggccccgacggcaccagactgcccgtgcccgtggtggaccacaagaacggcacctacgagctggtgtacaccgccagaaccgagggcgagctgctgctgagcgtgctgctgtacggccagcccgtgagaggcagccccttcagagtgagagccctgagacccggcgacctgccccccagccccgacgacgtgaagagaagagtgaagagccccggcggccccggcagccacgtgagacagaaggccgtgagaagacccagcagcatgtacagcaccggcggcaagagaaaggacaaccccatcgaggacgagctggtgttcagagtgggcagcagaggcagagagaagggcgagttcaccaacctgcagggcgtgagcgccgccagcagcggcagaatcgtggtggccgacagcaacaaccagtgcatccaggtgttcagcaacgagggccagttcaagttcagattcggcgtgagaggcagaagccccggccagctgcagagacccaccggcgtggccgtggacaccaacggcgacatcatcgtggccgactacgacaacagatgggtgagcatcttcagccccgagggcaagttcaagaccaagatcggcgccggcagactgatgggccccaagggcgtggccgtggacagaaacggccacatcatcgtggtggacaacaagagctgctgcgtgttcaccttccagcccaacggcaagctggtgggcagattcggcggcagaggcgccaccgacagacacttcgccggcccccacttcgtggccgtgaacaacaagaacgagatcgtggtgaccgacttccacaaccacagcgtgaaggtgtacagcgccgacggcgagttcctgttcaagttcggcagccacggcgagggcaacggccagttcaacgcccccaccggcgtggccgtggacagcaacggcaacatcatcgtgtgcagagccagcccctaccccagctacacccccccccacccctgccagagcgccccccacccccccgcctggggccagaacagcctgccccaggacagaagccccagcagctgcctgcccaccaccctgtacaccctgaccgagaccgccatcccccaccccccctactag

SEQ ID NO: 103430 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgctgcgagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggaggacatcaaggtggtgctgtgcagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcgaggtgcccagcagctag

SEQ ID NO: 103431 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggagcccgcccagccccacctgcccagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcgaggtgcccagcagctag

SEQ ID NO: 103432 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggaggacatcaaggtggtgctgtgcagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcgaggtgcccagcagctag

SEQ ID NO: 103433 - DNA, 747 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggagtag

SEQ ID NO: 103434 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggaggacatcaaggtggtgctgtgcagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcaaggtgcccagcagctag

SEQ ID NO: 103435 - DNA, 1278 bp, Artificial Sequence; identical to SEQ ID NO: 103432
  Description of Artificial Sequence: Synthetic coding sequence

SEQ ID NO: 103436 - DNA, 1278 bp, Artificial Sequence; identical to SEQ ID NO: 103432
  Description of Artificial Sequence: Synthetic coding sequence

SEQ ID NO: 103437 - DNA, 1278 bp, Artificial Sequence; identical to SEQ ID NO: 103432
  Description of Artificial Sequence: Synthetic coding sequence

SEQ ID NO: 103438 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctgatcgacagcctgaagaccaagcagaacatgccccccagacagctgctggaggacatcaaggtggtgctgtgcagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcaaggtgcccagcagctag

SEQ ID NO: 103439 - DNA, 1278 bp, Artificial Sequence; identical to SEQ ID NO: 103432
  Description of Artificial Sequence: Synthetic coding sequence

SEQ ID NO: 103440 - DNA, 1278 bp, Artificial Sequence; identical to SEQ ID NO: 103431
  Description of Artificial Sequence: Synthetic coding sequence

SEQ ID NO: 103441 - DNA, 1278 bp, Artificial Sequence; identical to SEQ ID NO: 103434
  Description of Artificial Sequence: Synthetic coding sequence

SEQ ID NO: 103442 - DNA, 1278 bp, Artificial Sequence; identical to SEQ ID NO: 103431
  Description of Artificial Sequence: Synthetic coding sequence

SEQ ID NO: 103443 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctgatcgacagcctgaagaccaagcagaacatgccccccagacagctgctggagcccgcccagccccacctgcccagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcaaggtgcccagcagctag

SEQ ID NO: 103444 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgctgcgagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggagcccgcccagccccacctgcccagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcgaggtgcccagcagctag

SEQ ID NO: 103445 - DNA, 1278 bp, Artificial Sequence; identical to SEQ ID NO: 103432
  Description of Artificial Sequence: Synthetic coding sequence

SEQ ID NO: 103446 - DNA, 1278 bp, Artificial Sequence; identical to SEQ ID NO: 103431
  Description of Artificial Sequence: Synthetic coding sequence

SEQ ID NO: 103447 - DNA, 1278 bp, Artificial Sequence; identical to SEQ ID NO: 103430
  Description of Artificial Sequence: Synthetic coding sequence

SEQ ID NO: 103448 - DNA, 1278 bp, Artificial Sequence; identical to SEQ ID NO: 103438
  Description of Artificial Sequence: Synthetic coding sequence

SEQ ID NO: 103449 - DNA, 1278 bp, Artificial Sequence
  Description of Artificial Sequence: Synthetic coding sequence
atggccagcggccagttcgtgaacaagctgcaggaggaggtgatctgccccatctgcctggacatcctgcagaagcccgtgaccatcgactgcggccacaacttctgcctgaagtgcatcacccagatcggcgagaccagctgcggcttcttcaagtgccccctgtgcaagaccagcgtgagaaagaacgccatcagattcaacagcctgctgagaaacctggtggagaagatccaggccctgcaggccagcgaggtgcagagcaagagaaaggaggccacctgccccagacaccaggagatgttccactacttctgcgaggacgacggcaagttcctgtgcttcgtgtgcagagagagcaaggaccacaagagccacaacgtgagcctgatcgaggaggccgcccagaactaccagggccagatccaggagcagatccaggtgctgcagcagaaggagaaggagaccgtgcaggtgaaggcccagggcgtgcacagagtggacgtgttcaccgaccaggtggagcacgagaagcagagaatcctgaccgagttcgagctgctgcaccaggtgctggaggaggagaagaacttcctgctgagcagaatctactggctgggccacgagggcaccgaggccggcaagcactacgtggccagcaccgagccccagctgaacgacctgaagaagctggtggacagcctgaagaccaagcagaacatgccccccagacagctgctggagcccgcccagccccacctgcccagaagcgaggagttccagttcctgaaccccacccccgtgcccctggagctggagaagaagctgagcgaggccaagagcagacacgacagcatcaccggcagcctgaagaagttcaaggaccagctgcaggccgacagaaagaaggacgagaacagattcttcaagagcatgaacaagaacgacatgaagagctggggcctgctgcagaagaacaaccacaagatgaacaagaccagcgagcccggcagcagcagcgccggcggcagaaccaccagcggcccccccaaccaccacagcagcgcccccagccacagcctgttcagagccagcagcgccggcaaggtgaccttccccgtgtgcctgctggccagctacgacgagatcagcggccagggcgccagcagccaggacaccaagaccttcgacgtggccctgagcgaggagctgcacgccgccctgagcgagtggctgaccgccatcagagcctggttctgcaaggtgcccagcagctag

SEQ ID NO: 103450 - DNA, 1278 bp, Artificial Sequence; identical to SEQ ID NO: 103432
  Description of Artificial Sequence: Synthetic coding sequence

SEQ ID NO: 103451 - DNA, 1278 bp, Artificial Sequence; identical to SEQ ID NO: 103432
  Description of Artificial Sequence: Synthetic coding sequence

SEQ ID NO: 103452 - DNA, 1962 bp, Artificial Sequence
  Description of Artificial Sequence: Synthetic coding sequence
atggccgccgccgccgccagccacctgaacctggacgccctgagagaggtgctggagtgccccatctgcatggagagcttcaccgaggagcagctgagacccaagctgctgcactgcggccacaccatctgcagacagtgcctggagaagctgctggccagcagcatcaacggcgtgagatgccccttctgcagcaagatcaccagaatcaccagcctgacccagctgaccgacaacctgaccgtgctgaagatcatcgacaccgccggcctgagcgaggccgtgggcctgctgatgtgcagaagctgcggcagaagactgcccagacagttctgcagaagctgcggcctggtgctgtgcgagccctgcagagaggccgaccaccagccccccggccactgcaccctgcccgtgaaggaggccgccgaggagagaagaagagacttcggcgagaagctgaccagactgagagagctgatgggcgagctgcagagaagaaaggccgccctggagggcgtgagcaaggacctgcaggccagatacaaggccgtgctgcaggagtacggccacgaggagagaagagtgcaggacgagctggccagaagcagaaagttcttcaccggcagcctggccgaggtggagaagagcaacagccaggtggtggaggagcagagctacctgctgaacatcgccgaggtgcaggccgtgagcagatgcgactacttcctggccaagatcaagcaggccgacgtggccctgctggaggagaccgccgacgaggaggagcccgagctgaccgccagcctgcccagagagctgaccctgcaggacgtggagctgctgaaggtgggccacgtgggccccctgcagatcggccaggccgtgaagaagcccagaaccgtgaacgtggaggacagctgggccatggaggccaccgccagcgccgccagcaccagcgtgaccttcagagagatggacatgagccccgaggaggtggtggccagccccagagccagccccgccaagcagagaggccccgaggccgccagcaacatccagcagtgcctgttcctgaagaagatgggcgccaagggcagcacccccggcatgttcaacctgcccgtgagcctgtacgtgaccagccagggcgaggtgctggtggccgacagaggcaactacagaatccaggtgttcaccagaaagggcttcctgaaggagatcagaagaagccccagcggcatcgacagcttcgtgctgagcttcctgggcgccgacctgcccaacctgacccccctgagcgtggccatgaactgccagggcctgatcggcgtgaccgacagctacgacaacagcctgaaggtgtacaccctggacggccactgcgtggcctgccacagaagccagctgagcaagccctggggcatcaccgccctgcccagcggccagttcgtggtgaccgacgtggagggcggcaagctgtggtgcttcaccgtggacagaggcagcggcgtggtgaagtacagctgcctgtgcagcgccgtgagacccaagttcgtgacctgcgacgccgagggcaccgtgtacttcacccagggcctgggcctgaacctggagaacagacagaacgagcaccacctggagggcggcttcagcatcggcagcgtgggccccgacggccagctgggcagacagatcagccacttcttcagcgagaacgaggacttcagatgcatcgccggcatgtgcgtggacgccagaggcgacctgatcgtggccgacagcagcagaaaggagatcctgcacttccccaagggcggcggctacagcgtgctgatcagagagggcctgacctgccccgtgggcatcgccctgacccccaagggccagctgctggtgctggactgctgggaccactgcatcaagatctacagctaccacctgagaagatacagcaccccctag

SEQ ID NO: 103453 - DNA, 522 bp, Artificial Sequence
  Description of Artificial Sequence: Synthetic coding sequence
atggccgccgccgccgccagccacctgaacctggacgccctgagagaggtgctggagtgccccatctgcatggagagcttcaccgaggagcagctgagacccaagctgctgcactgcggccacaccatctgcagacagtgcctggagaagctgctggccagcagcatcaacggcgtgagatgccccttctgcagcaagatcaccagaatcaccagcctgacccagctgaccgacaacctgaccgtgctgaagatcatcgacaccgccggcctgagcgaggccgtgggcctgctgatgtgcagaagctgcggcagaagactgcccagacagttctgcagaagctgcggcctggtgctgtgcgagccctgcagagaggccgaccaccagccccccggccactgcaccctgcccgtgaaggaggccgccgaggagagaagaagagacttcggcgagaagctgaccagactgagagagctgatgggcgagctgcagagaagaaaggccgccctggagggcgtgtag

SEQ ID NO: 103454 - DNA, 1962 bp, Artificial Sequence; identical to SEQ ID NO: 103452
  Description of Artificial Sequence: Synthetic coding sequence

SEQ ID NO: 103455 - DNA, 3384 bp, Artificial Sequence
  Description of Artificial Sequence: Synthetic coding sequence
atggccgagaacaagggcggcggcgaggccgagagcggcggcggcggcagcggcagcgcccccgtgaccgccggcgccgccggccccgccgcccaggaggccgagccccccctgaccgccgtgctggtggaggaggaggaggaggagggcggcagagccggcgccgagggcggcgccgccggccccgacgacggcggcgtggccgccgccagcagcggcagcgcccaggccgccagcagccccgccgccagcgtgggcaccggcgtggccggcggcgccgtgagcacccccgcccccgcccccgccagcgcccccgcccccggccccagcgccggccccccccccggcccccccgccagcctgctggacacctgcgccgtgtgccagcagagcctgcagagcagaagagaggccgagcccaagctgctgccctgcctgcacagcttctgcctgagatgcctgcccgagcccgagagacagctgagcgtgcccatccccggcggcagcaacggcgacatccagcaggtgggcgtgatcagatgccccgtgtgcagacaggagtgcagacagatcgacctggtggacaactacttcgtgaaggacaccagcgaggcccccagcagcagcgacgagaagagcgagcaggtgtgcaccagctgcgaggacaacgccagcgccgtgggcttctgcgtggagtgcggcgagtggctgtgcaagacctgcatcgaggcccaccagagagtgaagttcaccaaggaccacctgatcagaaagaaggaggacgtgagcgagagcgtgggcgccagcggccagagacccgtgttctgccccgtgcacaagcaggagcagctgaagctgttctgcgagacctgcgacagactgacctgcagagactgccagctgctggagcacaaggagcacagataccagttcctggaggaggccttccagaaccagaagggcgccatcgagaacctgctggccaagctgctggagaagaagaactacgtgcacttcgccgccacccaggtgcagaacagaatcaaggaggtgaacgagaccaacaagagagtggagcaggagatcaaggtggccatcttcaccctgatcaacgagatcaacaagaagggcaagagcctgctgcagcagctggagaacgtgaccaaggagagacagatgaagctgctgcagcagcagaacgacatcaccggcctgagcagacaggtgaagcacgtgatgaacttcaccaactgggccatcgccagcggcagcagcaccgccctgctgtacagcaagagactgatcaccttccagctgagacacatcctgaaggccagatgcgaccccgtgcccgccgccaacggcgccatcagattccactgcgaccccaccttctgggccaagaacgtggtgaacctgggcaacctggtgatcgagagcaagcccgcccccggctacacccccaacgtggtggtgggccaggtgccccccggcaccaaccacatcagcaagacccccggccagatcaacctggcccagctgagactgcagcacatgcagcagcaggtgtacgcccagaagcaccagcagctgcagcagatgagaatgcagcagccccccgcccccgtgcccaccaccaccaccaccacccagcagcaccccagacaggccgccccccagatgctgcagcagcagccccccagactgatcagcgtgcagaccatgcagagaggcaacatgaactgcggcgccttccaggcccaccagatgagactggcccagaacgccgccagaatccccggcatccccagacacagcggcccccagtacagcatgatgcagccccacctgcagagacagcacagcaaccccggccacgccggccccttccccgtggtgagcgtgcacaacaccaccatcaaccccaccagccccaccaccgccaccatggccaacgccaacagaggccccaccagccccagcgtgaccgccatcgagctgatccccagcgtgaccaaccccgagaacctgcccagcctgcccgacatcccccccatccagctggaggacgccggcagcagcagcctggacaacctgctgagcagatacatcagcggcagccacctgcccccccagcccaccagcaccatgaaccccagccccggccccagcgccctgagccccggcagcagcggcctgagcaacagccacacccccgtgagaccccccagcaccagcagcaccggcagcagaggcagctgcggcagcagcggcagaaccgccgagaagaccagcctgagcttcaagagcgaccaggtgaaggtgaagcaggagcccggcaccgaggacgagatctgcagcttcagcggcggcgtgaagcaggagaagaccgaggacggcagaagaagcgcctgcatgctgagcagccccgagagcagcctgaccccccccctgagcaccaacctgcacctggagagcgagctggacgccctggccagcctggagaaccacgtgaagatcgagcccgccgacatgaacgagagctgcaagcagagcggcctgagcagcctggtgaacggcaagagccccatcagaagcctgatgcacagaagcgccagaatcggcggcgacggcaacaacaaggacgacgaccccaacgaggactggtgcgccgtgtgccagaacggcggcgacctgctgtgctgcgagaagtgccccaaggtgttccacctgacctgccacgtgcccaccctgctgagcttccccagcggcgactggatctgcaccttctgcagagacatcggcaagcccgaggtggagtacgactgcgacaacctgcagcacagcaagaagggcaagaccgcccagggcctgagccccgtggaccagagaaagtgcgagagactgctgctgtacctgtactgccacgagctgagcatcgagttccaggagcccgtgcccgccagcatccccaactactacaagatcatcaagaagcccatggacctgagcaccgtgaagaagaagctgcagaagaagcacagccagcactaccagatccccgacgacttcgtggccgacgtgagactgatcttcaagaactgcgagagattcaacgagatgatgaaggtggtgcaggtgtacgccgacacccaggagatcaacctgaaggccgacagcgaggtggcccaggccggcaaggccgtggccctgtacttcgaggacaagctgaccgagatctacagcgacagaaccttcgcccccctgcccgagttcgagcaggaggaggacgacggcgaggtgaccgaggacagcgacgaggacttcatccagcccagaagaaagagactgaagagcgacgagagacccgtgcacatcaagtag

SEQ ID NO: 103456 - DNA, 3333 bp, Artificial Sequence
  Description of Artificial Sequence: Synthetic coding sequence
atggccgagaacaagggcggcggcgaggccgagagcggcggcggcggcagcggcagcgcccccgtgaccgccggcgccgccggccccgccgcccaggaggccgagccccccctgaccgccgtgctggtggaggaggaggaggaggagggcggcagagccggcgccgagggcggcgccgccggccccgacgacggcggcgtggccgccgccagcagcggcagcgcccaggccgccagcagccccgccgccagcgtgggcaccggcgtggccggcggcgccgtgagcacccccgcccccgcccccgccagcgcccccgcccccggccccagcgccggccccccccccggcccccccgccagcctgctggacacctgcgccgtgtgccagcagagcctgcagagcagaagagaggccgagcccaagctgctgccctgcctgcacagcttctgcctgagatgcctgcccgagcccgagagacagctgagcgtgcccatccccggcggcagcaacggcgacatccagcaggtgggcgtgatcagatgccccgtgtgcagacaggagtgcagacagatcgacctggtggacaactacttcgtgaaggacaccagcgaggcccccagcagcagcgacgagaagagcgagcaggtgtgcaccagctgcgaggacaacgccagcgccgtgggcttctgcgtggagtgcggcgagtggctgtgcaagacctgcatcgaggcccaccagagagtgaagttcaccaaggaccacctgatcagaaagaaggaggacgtgagcgagagcgtgggcgccagcggccagagacccgtgttctgccccgtgcacaagcaggagcagctgaagctgttctgcgagacctgcgacagactgacctgcagagactgccagctgctggagcacaaggagcacagataccagttcctggaggaggccttccagaaccagaagggcgccatcgagaacctgctggccaagctgctggagaagaagaactacgtgcacttcgccgccacccaggtgcagaacagaatcaaggaggtgaacgagaccaacaagagagtggagcaggagatcaaggtggccatcttcaccctgatcaacgagatcaacaagaagggcaagagcctgctgcagcagctggagaacgtgaccaaggagagacagatgaagctgctgcagcagcagaacgacatcaccggcctgagcagacaggtgaagcacgtgatgaacttcaccaactgggccatcgccagcggcagcagcaccgccctgctgtacagcaagagactgatcaccttccagctgagacacatcctgaaggccagatgcgaccccgtgcccgccgccaacggcgccatcagattccactgcgaccccaccttctgggccaagaacgtggtgaacctgggcaacctggtgatcgagagcaagcccgcccccggctacacccccaacgtggtggtgggccaggtgccccccggcaccaaccacatcagcaagacccccggccagatcaacctggcccagctgagactgcagcacatgcagcagcaggtgtacgcccagaagcaccagcagctgcagcagatgagaatgcagcagccccccgcccccgtgcccaccaccaccaccaccacccagcagcaccccagacaggccgccccccagatgctgcagcagcagccccccagactgatcagcgtgcagaccatgcagagaggcaacatgaactgcggcgccttccaggcccaccagatgagactggcccagaacgccgccagaatccccggcatccccagacacagcggcccccagtacagcatgatgcagccccacctgcagagacagcacagcaaccccggccacgccggccccttccccgtggtgagcgtgcacaacaccaccatcaaccccaccagccccaccaccgccaccatggccaacgccaacagaggccccaccagccccagcgtgaccgccatcgagctgatccccagcgtgaccaaccccgagaacctgcccagcctgcccgacatcccccccatccagctggaggacgccggcagcagcagcctggacaacctgctgagcagatacatcagcggcagccacctgcccccccagcccaccagcaccatgaaccccagccccggccccagcgccctgagccccggcagcagcggcctgagcaacagccacacccccgtgagaccccccagcaccagcagcaccggcagcagaggcagctgcggcagcagcggcagaaccgccgagaagaccagcctgagcttcaagagcgaccaggtgaaggtgaagcaggagcccggcaccgaggacgagatctgcagcttcagcggcggcgtgaagcaggagaagaccgaggacggcagaagaagcgcctgcatgctgagcagccccgagagcagcctgaccccccccctgagcaccaacctgcacctggagagcgagctggacgccctggccagcctggagaaccacgtgaagatcgagcccgccgacatgaacgagagctgcaagcagagcggcctgagcagcctggtgaacggcaagagccccatcagaagcctgatgcacagaagcgccagaatcggcggcgacggcaacaacaaggacgacgaccccaacgaggactggtgcgccgtgtgccagaacggcggcgacctgctgtgctgcgagaagtgccccaaggtgttccacctgacctgccacgtgcccaccctgctgagcttccccagcggcgactggatctgcaccttctgcagagacatcggcaagcccgaggtggagtacgactgcgacaacctgcagcacagcaagaagggcaagaccgcccagggcctgagccccgtggaccagagaaagtgcgagagactgctgctgtacctgtactgccacgagctgagcatcgagttccaggagcccgtgcccgccagcatccccaactactacaagatcatcaagaagcccatggacctgagcaccgtgaagaagaagctgcagaagaagcacagccagcactaccagatccccgacgacttcgtggccgacgtgagactgatcttcaagaactgcgagagattcaacgaggccgacagcgaggtggcccaggccggcaaggccgtggccctgtacttcgaggacaagctgaccgagatctacagcgacagaaccttcgcccccctgcccgagttcgagcaggaggaggacgacggcgaggtgaccgaggacagcgacgaggacttcatccagcccagaagaaagagactgaagagcgacgagagacccgtgcacatcaagtag

SEQ ID NO: 103457 - DNA, 2667 bp, Artificial Sequence
  Description of Artificial Sequence: Synthetic coding sequence
tgaagcgtgggcgccagcggccagagacccgtgttctgccccgtgcacaagcaggagcagctgaagctgttctgcgagacctgcgacagactgacctgcagagactgccagctgctggagcacaaggagcacagataccagttcctggaggaggccttccagaaccagaagggcgccatcgagaacctgctggccaagctgctggagaagaagaactacgtgcacttcgccgccacccaggtgcagaacagaatcaaggaggtgaacgagaccaacaagagagtggagcaggagatcaaggtggccatcttcaccctgatcaacgagatcaacaagaagggcaagagcctgctgcagcagctggagaacgtgaccaaggagagacagatgaagctgctgcagcagcagaacgacatcaccggcctgagcagacaggtgaagcacgtgatgaacttcaccaactgggccatcgccagcggcagcagcaccgccctgctgtacagcaagagactgatcaccttccagctgagacacatcctgaaggccagatgcgaccccgtgcccgccgccaacggcgccatcagattccactgcgaccccaccttctgggccaagaacgtggtgaacctgggcaacctggtgatcgagagcaagcccgcccccggctacacccccaacgtggtggtgggccaggtgccccccggcaccaaccacatcagcaagacccccggccagatcaacctggcccagctgagactgcagcacatgcagcagcaggtgtacgcccagaagcaccagcagctgcagcagatgagaatgcagcagccccccgcccccgtgcccaccaccaccaccaccacccagcagcaccccagacaggccgccccccagatgctgcagcagcagccccccagactgatcagcgtgcagaccatgcagagaggcaacatgaactgcggcgccttccaggcccaccagatgagactggcccagaacgccgccagaatccccggcatccccagacacagcggcccccagtacagcatgatgcagccccacctgcagagacagcacagcaaccccggccacgccggccccttccccgtggtgagcgtgcacaacaccaccatcaaccccaccagccccaccaccgccaccatggccaacgccaacagaggccccaccagccccagcgtgaccgccatcgagctgatccccagcgtgaccaaccccgagaacctgcccagcctgcccgacatcccccccatccaggccaacgtggtgcccatgatgcacagctggtacgagttcggcgccagagagaagacccaggaccagaacgtgctggaggacgccggcagcagcagcctggacaacctgctgagcagatacatcagcggcagccacctgcccccccagcccaccagcaccatgaaccccagccccggccccagcgccctgagccccggcagcagcggcctgagcaacagccacacccccgtgagaccccccagcaccagcagcaccggcagcagaggcagctgcggcagcagcggcagaaccgccgagaagaccagcctgagcttcaagagcgaccaggtgaaggtgaagcaggagcccggcaccgaggacgagatctgcagcttcagcggcggcgtgaagcaggagaagaccgaggacggcagaagaagcgcctgcatgctgagcagccccgagagcagcctgaccccccccctgagcaccaacctgcacctggagagcgagctggacgccctggccagcctggagaaccacgtgaagatcgagcccgccgacatgaacgagagctgcaagcagagcggcctgagcagcctggtgaacggcaagagccccatcagaagcctgatgcacagaagcgccagaatcggcggcgacggcaacaacaaggacgacgaccccaacgaggactggtgcgccgtgtgccagaacggcggcgacctgctgtgctgcgagaagtgccccaaggtgttccacctgacctgccacgtgcccaccctgctgagcttccccagcggcgactggatctgcaccttctgcagagacatcggcaagcccgaggtggagtacgactgcgacaacctgcagcacagcaagaagggcaagaccgcccagggcctgagccccgtggaccagagaaagtgcgagagactgctgctgtacctgtactgccacgagctgagcatcgagttccaggagcccgtgcccgccagcatccccaactactacaagatcatcaagaagcccatggacctgagcaccgtgaagaagaagctgcagaagaagcacagccagcactaccagatccccgacgacttcgtggccgacgtgagactgatcttcaagaactgcgagagattcaacgagatgatgaaggtggtgcaggtgtacgccgacacccaggagatcaacctgaaggccgacagcgaggtggcccaggccggcaaggccgtggccctgtacttcgaggacaagctgaccgagatctacagcgacagaaccttcgcccccctgcccgagttcgagcaggaggaggacgacggcgaggtgaccgaggacagcgacgaggacttcatccagcccagaagaaagagactgaagagcgacgagagacccgtgcacatcaagtag

SEQ ID NO: 103458 - DNA, 2280 bp, Artificial Sequence
  Description of Artificial Sequence: Synthetic coding sequence
atgaagctgctgcagcagcagaacgacatcaccggcctgagcagacaggtgaagcacgtgatgaacttcaccaactgggccatcgccagcggcagcagcaccgccctgctgtacagcaagagactgatcaccttccagctgagacacatcctgaaggccagatgcgaccccgtgcccgccgccaacggcgccatcagattccactgcgaccccaccttctgggccaagaacgtggtgaacctgggcaacctggtgatcgagagcaagcccgcccccggctacacccccaacgtggtggtgggccaggtgccccccggcaccaaccacatcagcaagacccccggccagatcaacctggcccagctgagactgcagcacatgcagcagcaggtgtacgcccagaagcaccagcagctgcagcagatgagaatgcagcagccccccgcccccgtgcccaccaccaccaccaccacccagcagcaccccagacaggccgccccccagatgctgcagcagcagccccccagactgatcagcgtgcagaccatgcagagaggcaacatgaactgcggcgccttccaggcccaccagatgagactggcccagaacgccgccagaatccccggcatccccagacacagcggcccccagtacagcatgatgcagccccacctgcagagacagcacagcaaccccggccacgccggccccttccccgtggtgagcgtgcacaacaccaccatcaaccccaccagccccaccaccgccaccatggccaacgccaacagaggccccaccagccccagcgtgaccgccatcgagctgatccccagcgtgaccaaccccgagaacctgcccagcctgcccgacatcccccccatccaggccaacgtggtgcccatgatgcacagctggtacgagttcggcgccagagagaagacccaggaccagaacgtgctggaggacgccggcagcagcagcctggacaacctgctgagcagatacatcagcggcagccacctgcccccccagcccaccagcaccatgaaccccagccccggccccagcgccctgagccccggcagcagcggcctgagcaacagccacacccccgtgagaccccccagcaccagcagcaccggcagcagaggcagctgcggcagcagcggcagaaccgccgagaagaccagcctgagcttcaagagcgaccaggtgaaggtgaagcaggagcccggcaccgaggacgagatctgcagcttcagcggcggcgtgaagcaggagaagaccgaggacggcagaagaagcgcctgcatgctgagcagccccgagagcagcctgaccccccccctgagcaccaacctgcacctggagagcgagctggacgccctggccagcctggagaaccacgtgaagatcgagcccgccgacatgaacgagagctgcaagcagagcggcctgagcagcctggtgaacggcaagagccccatcagaagcctgatgcacagaagcgccagaatcggcggcgacggcaacaacaaggacgacgaccccaacgaggactggtgcgccgtgtgccagaacggcggcgacctgctgtgctgcgagaagtgccccaaggtgttccacctgacctgccacgtgcccaccctgctgagcttccccagcggcgactggatctgcaccttctgcagagacatcggcaagcccgaggtggagtacgactgcgacaacctgcagcacagcaagaagggcaagaccgcccagggcctgagccccgtggaccagagaaagtgcgagagactgctgctgtacctgtactgccacgagctgagcatcgagttccaggagcccgtgcccgccagcatccccaactactacaagatcatcaagaagcccatggacctgagcaccgtgaagaagaagctgcagaagaagcacagccagcactaccagatccccgacgacttcgtggccgacgtgagactgatcttcaagaactgcgagagattcaacgagatgatgaaggtggtgcaggtgtacgccgacacccaggagatcaacctgaaggccgacagcgaggtggcccaggccggcaaggccgtggccctgtacttcgaggacaagctgaccgagatctacagcgacagaaccttcgcccccctgcccgagttcgagcaggaggaggacgacggcgaggtgaccgaggacagcgacgaggacttcatccagcccagaagaaagagactgaagagcgacgagagacccgtgcacatcaagtag

SEQ ID NO: 103459 - DNA, 2529 bp, Artificial Sequence
  Description of Artificial Sequence: Synthetic coding sequence
atgtgcggcagcgagagaatcctgcaggccggcaacatcctggagatcagagtgggccaggccggcgccagaagagtggccaccatgaccagccccgtgctggtggacatcagagaggaggtgacctgccccatctgcctggagctgctgaccgagcccctgagcatcgactgcggccacagcttctgccaggcctgcatcacccccaacggcagagagagcgtgatcggccaggagggcgagagaagctgccccgtgtgccagaccagctaccagcccggcaacctgagacccaacagacacctggccaacatcgtgagaagactgagagaggtggtgctgggccccggcaagcagctgaaggccgtgctgtgcgccgaccacggcgagaagctgcagctgttctgccaggaggacggcaaggtgatctgctggctgtgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggccatccagggcagcctgaccagaagagagagaagagccagcggcgtgagaaccagaagaagccagggcagcagcgccatggccagcaagatcctgctgaacgtgcaggaggaggtgacctgccccatctgcctggagctgctgaccgagcccctgagcctggactgcggccacagcctgtgcagagcctgcatcaccgtgagcaacaaggaggccgtgaccagcatgggcggcaagagcagctgccccgtgtgcggcatcagctacagcttcgagcacctgcaggccaaccagcacctggccaacatcgtggagagactgaaggaggtgaagctgagccccgacaacggcaagaagagagacctgtgcgaccaccacggcgagaagctgctgctgttctgcaaggaggacagaaaggtgatctgctggctgtgcgagagaagccaggagcacagaggccaccacaccgtgctgaccgaggaggtgttcaaggagtgccaggagaagctgcaggccgtgctgaagagactgaagaaggaggaggaggaggccgagaagctggaggccgacatcagagaggagaagaccagctggaagtaccaggtgcagaccgagagacagagaatccagaccgagttcgaccagctgagaagcatcctgaacaacgaggagcagagagagctgcagagactggaggaggaggagaagaagaccctggacaagttcgccgaggccgaggacgagctggtgcagcagaagcagctggtgagagagctgatcagcgacgtggagtgcagaagccagtggagcaccatggagctgctgcaggacatgagcggcatcatgaagtggagcgagatctggagactgaagaagcccaagatggtgagcaagaagctgaagaccgtgttccacgcccccgacctgagcagaatgctgcagatgttcagagagctgaccgccgtgagatgctactgggtggacgtgaccctgaacagcgtgaacctgaacctgaacctggtgctgagcgaggaccagagacaggtgatcagcgtgcccatctggcccttccagtgctacaactacggcgtgctgggcagccagtacttcagcagcggcaagcactactgggaggtggacgtgagcaagaagaccgcctggatcctgggcgtgtactgcagaacctacagcagacacatgaagtacgtggtgagaagatgcgccaacagacagaacctgtacaccaagtacagacccctgttcggctactgggtgatcggcctgcagaacaagtgcaagtacggcgtgttcgaggagagcctgagcagcgaccccgaggtgctgaccctgagcatggccgtgcccccctgcagagtgggcgtgttcctggactacgaggccggcatcgtgagcttcttcaacgtgaccagccacggcagcctgatctacaagttcagcaagtgctgcttcagccagcccgtgtacccctacttcaacccctggaactgccccgcccccatgaccctgtgcccccccagcagctag

SEQ ID NO: 103460 - DNA, 1467 bp, Artificial Sequence
  Description of Artificial Sequence: Synthetic coding sequence
atggccagcaagatcctgctgaacgtgcaggaggaggtgacctgccccatctgcctggagctgctgaccgagcccctgagcctggactgcggccacagcctgtgcagagcctgcatcaccgtgagcaacaaggaggccgtgaccagcatgggcggcaagagcagctgccccgtgtgcggcatcagctacagcttcgagcacctgcaggccaaccagcacctggccaacatcgtggagagactgaaggaggtgaagctgagccccgacaacggcaagaagagagacctgtgcgaccaccacggcgagaagctgctgctgttctgcaaggaggacagaaaggtgatctgctggctgtgcgagagaagccaggagcacagaggccaccacaccgtgctgaccgaggaggtgttcaaggagtgccaggagaagctgcaggccgtgctgaagagactgaagaaggaggaggaggaggccgagaagctggaggccgacatcagagaggagaagaccagctggaagtaccaggtgcagaccgagagacagagaatccagaccgagttcgaccagctgagaagcatcctgaacaacgaggagcagagagagctgcagagactggaggaggaggagaagaagaccctggacaagttcgccgaggccgaggacgagctggtgcagcagaagcagctggtgagagagctgatcagcgacgtggagtgcagaagccagtggagcaccatggagctgctgcaggacatgagcggcatcatgaagtggagcgagatctggagactgaagaagcccaagatggtgagcaagaagctgaagaccgtgttccacgcccccgacctgagcagaatgctgcagatgttcagagagctgaccgccgtgagatgctactgggtggacgtgaccctgaacagcgtgaacctgaacctgaacctggtgctgagcgaggaccagagacaggtgatcagcgtgcccatctggcccttccagtgctacaactacggcgtgctgggcagccagtacttcagcagcggcaagcactactgggaggtggacgtgagcaagaagaccgcctggatcctgggcgtgtactgcagaacctacagcagacacatgaagtacgtggtgagaagatgcgccaacagacagaacctgtacaccaagtacagacccctgttcggctactgggtgatcggcctgcagaacaagtgcaagtacggcgtgttcgaggagagcctgagcagcgaccccgaggtgctgaccctgagcatggccgtgcccccctgcagagtgggcgtgttcctggactacgaggccggcatcgtgagcttcttcaacgtgaccagccacggcagcctgatctacaagttcagcaagtgctgcttcagccagcccgtgtacccctacttcaacccctggaactgccccgcccccatgaccctgtgcccccccagcagctag

SEQ ID NO: 103461 - DNA, 1467 bp, Artificial Sequence; identical to SEQ ID NO: 103460
  Description of Artificial Sequence: Synthetic coding sequence

SEQ ID NO: 103462 - DNA, 1467 bp, Artificial Sequence; identical to SEQ ID NO: 103460
  Description of Artificial Sequence: Synthetic coding sequence

SEQ ID NO: 103463 - DNA, 2187 bp, Artificial Sequence
  Description of Artificial Sequence: Synthetic coding sequence
atgagcgagagcggcgagatgagcgagttcggctacatcatggagctgatcgccaagggcaaggtgaccatcaagaacatcgagagagagctgatctgccccgcctgcaaggagctgttcacccaccccctgatcctgccctgccagcacagcatctgccacaagtgcgtgaaggagctgctgctgaccctggacgacagcttcaacgacgtgggcagcgacaacagcaaccagagcagccccagactgagactgcccagccccagcatggacaagatcgacagaatcaacagacccggctggaagagaaacagcctgacccccagaaccaccgtgttcccctgccccggctgcgagcacgacgtggacctgggcgagagaggcatcaacggcctgttcagaaacttcaccctggagaccatcgtggagagatacagacaggccgccagagccgccaccgccatcatgtgcgacctgtgcaagccccccccccaggagagcaccaagagctgcatggactgcagcgccagctactgcaacgagtgcttcaagatccaccacccctggggcaccatcaaggcccagcacgagtacgtgggccccaccaccaacttcagacccaagatcctgatgtgccccgagcacgagaccgagagaatcaacatgtactgcgagctgtgcagaagacccgtgtgccacctgtgcaagctgggcggcaaccacgccaaccacagagtgaccaccatgagcagcgcctacaagaccctgaaggagaagctgagcaaggacatcgactacctgatcggcaaggagagccaggtgaagagccagatcagcgagctgaacctgctgatgaaggagaccgagtgcaacggcgagagagccaaggaggaggccatcacccacttcgagaagctgttcgaggtgctggaggagagaaagagcagcgtgctgaaggccatcgacagcagcaagaagctgagactggacaagttccagacccagatggaggagtaccagggcctgctggagaacaacggcctggtgggctacgcccaggaggtgctgaaggagaccgaccagagctgcttcgtgcagaccgccaagcagctgcacctgagaatccagaaggccaccgagagcctgaagagcttcagacccgccgcccagaccagcttcgaggactacgtggtgaacaccagcaagcagaccgagctgctgggcgagctgagcttcttcagcagcggcatcgacgtgcccgagatcaacgaggagcagagcaaggtgtacaacaacgccctgatcaactggcaccaccccgagaaggacaaggccgacagctacgtgctggagtacagaaagatcaacagagacgacgagatgagctggaacgagatcgaggtgtgcggcaccagcaagatcatccaggacctggagaacagcagcacctacgccttcagagtgagagcctacaagggcagcatctgcagcccctgcagcagagagctgatcctgcacaccccccccgcccccgtgttcagcttcctgttcgacgagaagtgcggctacaacaacgagcacctgctgctgaacctgaagagagacagagtggagagcagagccggcttcaacctgctgctggccgccgagagaatccaggtgggctactacaccagcctggactacatcatcggcgacaccggcatcaccaagggcaagcacttctgggccttcagagtggagccctacagctacctggtgaaggtgggcgtggccagcagcgacaagctgcaggagtggctgagaagccccagagacgccgtgagccccagatacgagcaggacagcggccacgacagcggcagcgaggacgcctgcttcgacagcagccagcccttcaccctggtgaccatcggcatgcagaagttcttcatccccaagagccccaccagcagcaacgagcccgagaacagagtgctgcccatgcccaccagcatcggcatcttcctggactgcgacaagggcaaggtggacttctacgacatggaccagatgaagtgcctgtacgagagacaggtggactgcagccacaccctgtaccccgccttcgccctgatgggcagcggcggcatccagctggaggagcccatcaccgccaagtacctggagtaccaggaggacatgtag

SEQ ID NO: 103464 - DNA, 186 bp, Artificial Sequence
  Description of Artificial Sequence: Synthetic coding sequence
atgagcgagagcggcgagatgagcgagttcggctacatcatggagctgatcgccaagggcaaggccagcgccatgggcctgcagcagacccacgagcacagcagactgaccagcaagggcggcgaggccagatgccccttcgagatcagcgaggtgggcaagcagagcctgcccagaagaacctag

SEQ ID NO: 103465 - DNA, 183 bp, Artificial Sequence
  Description of Artificial Sequence: Synthetic coding sequence
atgagcgagagcggcgagatgagcgagttcggctacatcatggagctgatcgccaagggcaagatgcccgactggagaagaggctacagatgcagacagggctgcggcaagaccaccgagctggccaccgccaccgacttcagccagaccggcaacaagagcggcaagcacttcaagacctag

SEQ ID NO: 103466 - DNA, 2895 bp, Artificial Sequence
  Description of Artificial Sequence: Synthetic coding sequence
atggacgagcagagcgtggagagcatcgccgaggtgttcagatgcttcatctgcatggagaagctgagagacgccagactgtgcccccactgcagcaagctgtgctgcttcagctgcatcagaagatggctgaccgagcagagagcccagtgcccccactgcagagcccccctgcagctgagagagctggtgaactgcagatgggccgaggaggtgacccagcagctggacaccctgcagctgtgcagcctgaccaagcacgaggagaacgagaaggacaagtgcgagaaccaccacgagaagctgagcgtgttctgctggacctgcaagaagtgcatctgccaccagtgcgccctgtggggcggcatgcacggcggccacaccttcaagcccctggccgagatctacgagcagcacgtgaccaaggtgaacgaggaggtggccaagctgagaagaagactgatggagctgatcagcctggtgcaggaggtggagagaaacgtggaggccgtgagaaacgccaaggacgagagagtgagagagatcagaaacgccgtggagatgatgatcgccagactggacacccagctgaagaacaagctgatcaccctgatgggccagaagaccagcctgacccaggagaccgagctgctggagagcctgctgcaggaggtggagcaccagctgagaagctgcagcaagagcgagctgatcagcaagagcagcgagatcctgatgatgttccagcaggtgcacagaaagcccatggccagcttcgtgaccacccccgtgccccccgacttcaccagcgagctggtgcccagctacgacagcgccaccttcgtgctggagaacttcagcaccctgagacagagagccgaccccgtgtacagcccccccctgcaggtgagcggcctgtgctggagactgaaggtgtaccccgacggcaacggcgtggtgagaggctactacctgagcgtgttcctggagctgagcgccggcctgcccgagaccagcaagtacgagtacagagtggagatggtgcaccagagctgcaacgaccccaccaagaacatcatcagagagttcgccagcgacttcgaggtgggcgagtgctggggctacaacagattcttcagactggacctgctggccaacgagggctacctgaacccccagaacgacaccgtgatcctgagattccaggtgagaagccccaccttcttccagaagagcagagaccagcactggtacatcacccagctggaggccgcccagaccagctacatccagcagatcaacaacctgaaggagagactgaccatcgagctgagcagaacccagaagagcagagacctgagcccccccgacaaccacctgagcccccagaacgacgacgccctggagaccagagccaagaagagcgcctgcagcgacatgctgctggagggcggccccaccaccgccagcgtgagagaggccaaggaggacgaggaggacgaggagaagatccagaacgaggactaccaccacgagctgagcgacggcgacctggacctggacctggtgtacgaggacgaggtgaaccagctggacggcagcagcagcagcgccagcagcaccgccaccagcaacaccgaggagaacgacatcgacgaggagaccatgagcggcgagaacgacgtggagtacaacaacatggagctggaggagggcgagctgatggaggacgccgccgccgccggccccgccggcagcagccacggctacgtgggcagcagcagcagaatcagcagaagaacccacctgtgcagcgccgccaccagcagcctgctggacatcgaccccctgatcctgatccacctgctggacctgaaggacagaagcagcatcgagaacctgtggggcctgcagcccagaccccccgccagcctgctgcagcccaccgccagctacagcagaaaggacaaggaccagagaaagcagcaggccatgtggagagtgcccagcgacctgaagatgctgaagagactgaagacccagatggccgaggtgagatgcatgaagaccgacgtgaagaacaccctgagcgagatcaagagcagcagcgccgccagcggcgacatgcagaccagcctgttcagcgccgaccaggccgccctggccgcctgcggcaccgagaacagcggcagactgcaggacctgggcatggagctgctggccaagagcagcgtggccaactgctacatcagaaacagcaccaacaagaagagcaacagccccaagcccgccagaagcagcgtggccggcagcctgagcctgagaagagccgtggaccccggcgagaacagcagaagcaagggcgactgccagaccctgagcgagggcagccccggcagcagccagagcggcagcagacacagcagccccagagccctgatccacggcagcatcggcgacatcctgcccaagaccgaggacagacagtgcaaggccctggacagcgacgccgtggtggtggccgtgttcagcggcctgcccgccgtggagaagagaagaaagatggtgaccctgggcgccaacgccaagggcggccacctggagggcctgcagatgaccgacctggagaacaacagcgagaccggcgagctgcagcccgtgctgcccgagggcgccagcgccgcccccgaggagggcatgagcagcgacagcgacatcgagtgcgacaccgagaacgaggagcaggaggagcacaccagcgtgggcggcttccacgacagcttcatggtgatgacccagccccccgacgaggacacccacagcagcttccccgacggcgagcagatcggccccgaggacctgagcttcaacaccgacgagaacagcggcagatag

SEQ ID NO: 103467 - DNA, 2412 bp, Artificial Sequence
  Description of Artificial Sequence: Synthetic coding sequence
atgcacggcggccacaccttcaagcccctggccgagatctacgagcagcacgtgaccaaggtgaacgaggaggtggccaagctgagaagaagactgatggagctgatcagcctggtgcaggaggtggagagaaacgtggaggccgtgagaaacgccaaggacgagagagtgagagagatcagaaacgccgtggagatgatgatcgccagactggacacccagctgaagaacaagctgatcaccctgatgggccagaagaccagcctgacccaggagaccgagctgctggagagcctgctgcaggaggtggagcaccagctgagaagctgcagcaagagcgagctgatcagcaagagcagcgagatcctgatgatgttccagcaggtgcacagaaagcccatggccagcttcgtgaccacccccgtgccccccgacttcaccagcgagctggtgcccagctacgacagcgccaccttcgtgctggagaacttcagcaccctgagacagagagccgaccccgtgtacagcccccccctgcaggtgagcggcctgtgctggagactgaaggtgtaccccgacggcaacggcgtggtgagaggctactacctgagcgtgttcctggagctgagcgccggcctgcccgagaccagcaagtacgagtacagagtggagatggtgcaccagagctgcaacgaccccaccaagaacatcatcagagagttcgccagcgacttcgaggtgggcgagtgctggggctacaacagattcttcagactggacctgctggccaacgagggctacctgaacccccagaacgacaccgtgatcctgagattccaggtgagaagccccaccttcttccagaagagcagagaccagcactggtacatcacccagctggaggccgcccagaccagctacatccagcagatcaacaacctgaaggagagactgaccatcgagctgagcagaacccagaagagcagagacctgagcccccccgacaaccacctgagcccccagaacgacgacgccctggagaccagagccaagaagagcgcctgcagcgacatgctgctggagggcggccccaccaccgccagcgtgagagaggccaaggaggacgaggaggacgaggagaagatccagaacgaggactaccaccacgagctgagcgacggcgacctggacctggacctggtgtacgaggacgaggtgaaccagctggacggcagcagcagcagcgccagcagcaccgccaccagcaacaccgaggagaacgacatcgacgaggagaccatgagcggcgagaacgacgtggagtacaacaacatggagctggaggagggcgagctgatggaggacgccgccgccgccggccccgccggcagcagccacggctacgtgggcagcagcagcagaatcagcagaagaacccacctgtgcagcgccgccaccagcagcctgctggacatcgaccccctgatcctgatccacctgctggacctgaaggacagaagcagcatcgagaacctgtggggcctgcagcccagaccccccgccagcctgctgcagcccaccgccagctacagcagaaaggacaaggaccagagaaagcagcaggccatgtggagagtgcccagcgacctgaagatgctgaagagactgaagacccagatggccgaggtgagatgcatgaagaccgacgtgaagaacaccctgagcgagatcaagagcagcagcgccgccagcggcgacatgcagaccagcctgttcagcgccgaccaggccgccctggccgcctgcggcaccgagaacagcggcagactgcaggacctgggcatggagctgctggccaagagcagcgtggccaactgctacatcagaaacagcaccaacaagaagagcaacagccccaagcccgccagaagcagcgtggccggcagcctgagcctgagaagagccgtggaccccggcgagaacagcagaagcaagggcgactgccagaccctgagcgagggcagccccggcagcagccagagcggcagcagacacagcagccccagagccctgatccacggcagcatcggcgacatcctgcccaagaccgaggacagacagtgcaaggccctggacagcgacgccgtggtggtggccgtgttcagcggcctgcccgccgtggagaagagaagaaagatggtgaccctgggcgccaacgccaagggcggccacctggagggcctgcagatgaccgacctggagaacaacagcgagaccggcgagctgcagcccgtgctgcccgagggcgccagcgccgcccccgaggaggacacccacagcagcttccccgacggcgagcagatcggccccgaggacctgagcttcaacaccgacgagaacagcggcagatag

SEQ ID NO: 103468 - DNA, 2793 bp, Artificial Sequence
  Description of Artificial Sequence: Synthetic coding sequence
atggacgagcagagcgtggagagatggctgaccgagcagagagcccagtgcccccactgcagagcccccctgcagctgagagagctggtgaactgcagatgggccgaggaggtgacccagcagctggacaccctgcagctgtgcagcctgaccaagcacgaggagaacgagaaggacaagtgcgagaaccaccacgagaagctgagcgtgttctgctggacctgcaagaagtgcatctgccaccagtgcgccctgtggggcggcatgcacggcggccacaccttcaagcccctggccgagatctacgagcagcacgtgaccaaggtgaacgaggaggtggccaagctgagaagaagactgatggagctgatcagcctggtgcaggaggtggagagaaacgtggaggccgtgagaaacgccaaggacgagagagtgagagagatcagaaacgccgtggagatgatgatcgccagactggacacccagctgaagaacaagctgatcaccctgatgggccagaagaccagcctgacccaggagaccgagctgctggagagcctgctgcaggaggtggagcaccagctgagaagctgcagcaagagcgagctgatcagcaagagcagcgagatcctgatgatgttccagcaggtgcacagaaagcccatggccagcttcgtgaccacccccgtgccccccgacttcaccagcgagctggtgcccagctacgacagcgccaccttcgtgctggagaacttcagcaccctgagacagagagccgaccccgtgtacagcccccccctgcaggtgagcggcctgtgctggagactgaaggtgtaccccgacggcaacggcgtggtgagaggctactacctgagcgtgttcctggagctgagcgccggcctgcccgagaccagcaagtacgagtacagagtggagatggtgcaccagagctgcaacgaccccaccaagaacatcatcagagagttcgccagcgacttcgaggtgggcgagtgctggggctacaacagattcttcagactggacctgctggccaacgagggctacctgaacccccagaacgacaccgtgatcctgagattccaggtgagaagccccaccttcttccagaagagcagagaccagcactggtacatcacccagctggaggccgcccagaccagctacatccagcagatcaacaacctgaaggagagactgaccatcgagctgagcagaacccagaagagcagagacctgagcccccccgacaaccacctgagcccccagaacgacgacgccctggagaccagagccaagaagagcgcctgcagcgacatgctgctggagggcggccccaccaccgccagcgtgagagaggccaaggaggacgaggaggacgaggagaagatccagaacgaggactaccaccacgagctgagcgacggcgacctggacctggacctggtgtacgaggacgaggtgaaccagctggacggcagcagcagcagcgccagcagcaccgccaccagcaacaccgaggagaacgacatcgacgaggagaccatgagcggcgagaacgacgtggagtacaacaacatggagctggaggagggcgagctgatggaggacgccgccgccgccggccccgccggcagcagccacggctacgtgggcagcagcagcagaatcagcagaagaacccacctgtgcagcgccgccaccagcagcctgctggacatcgaccccctgatcctgatccacctgctggacctgaaggacagaagcagcatcgagaacctgtggggcctgcagcccagaccccccgccagcctgctgcagcccaccgccagctacagcagaaaggacaaggaccagagaaagcagcaggccatgtggagagtgcccagcgacctgaagatgctgaagagactgaagacccagatggccgaggtgagatgcatgaagaccgacgtgaagaacaccctgagcgagatcaagagcagcagcgccgccagcggcgacatgcagaccagcctgttcagcgccgaccaggccgccctggccgcctgcggcaccgagaacagcggcagactgcaggacctgggcatggagctgctggccaagagcagcgtggccaactgctacatcagaaacagcaccaacaagaagagcaacagccccaagcccgccagaagcagcgtggccggcagcctgagcctgagaagagccgtggaccccggcgagaacagcagaagcaagggcgactgccagaccctgagcgagggcagccccggcagcagccagagcggcagcagacacagcagccccagagccctgatccacggcagcatcggcgacatcctgcccaagaccgaggacagacagtgcaaggccctggacagcgacgccgtggtggtggccgtgttcagcggcctgcccgccgtggagaagagaagaaagatggtgaccctgggcgccaacgccaagggcggccacctggagggcctgcagatgaccgacctggagaacaacagcgagaccggcgagctgcagcccgtgctgcccgagggcgccagcgccgcccccgaggagggcatgagcagcgacagcgacatcgagtgcgacaccgagaacgaggagcaggaggagcacaccagcgtgggcggcttccacgacagcttcatggtgatgacccagccccccgacgaggacacccacagcagcttccccgacggcgagcagatcggccccgaggacctgagcttcaacaccgacgagaacagcggcagatag

SEQ ID NO: 103469 - DNA, 2895 bp, Artificial Sequence; identical to SEQ ID NO: 103466
  Description of Artificial Sequence: Synthetic coding sequence

SEQ ID NO: 103470 - DNA, 1557 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaaggacgtgaagagcaccctggagaagaacatccccagaaagttcggcggcagcctgagcaccatctgccccagagaccacaaggccctgctgggcctggtgaaggagatcaacagatgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggtgggcgacaagacccactgggccgtgggcgtgtgcagagacagcgtgagcagaaagggcgagctgacccccctgcccgagaccggctactggagagtgagactgtggaacggcgacaagtacgccgccaccaccacccccttcacccccctgcacatcaaggtgaagcccaagagagtgggcatcttcctggactacgaggccggcaccctgagcttctacaacgtgaccgacagaagccacatctacaccttcaccgacaccttcaccgagaagctgtggcccctgttctaccccggcatcagagccggcagaaagaacgccgcccccctgaccatcagaccccccaccgactgggagtag

SEQ ID NO: 103471 - DNA, 1467 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaaggacgtgaagagcaccctggagaagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggtgggcgacaagacccactgggccgtgggcgtgtgcagagacagcgtgagcagaaagggcgagctgacccccctgcccgagaccggctactggagagtgagactgtggaacggcgacaagtacgccgccaccaccacccccttcacccccctgcacatcaaggtgaagcccaagagagtgggcatcttcctggactacgaggccggcaccctgagcttctacaacgtgaccgacagaagccacatctacaccttcaccgacaccttcaccgagaagctgtggcccctgttctaccccggcatcagagccggcagaaagaacgccgcccccctgaccatcagaccccccaccgactgggagtag

SEQ ID NO: 103472 - DNA, 1467 bp, Artificial Sequence; identical to SEQ ID NO: 103471
  Description of Artificial Sequence: Synthetic coding sequence

SEQ ID NO: 103473 - DNA, 1557 bp, Artificial Sequence; identical to SEQ ID NO: 103470
  Description of Artificial Sequence: Synthetic coding sequence

SEQ ID NO: 103474 - DNA, 1467 bp, Artificial Sequence; identical to SEQ ID NO: 103471
  Description of Artificial Sequence: Synthetic coding sequence

SEQ ID NO: 103475 - DNA, 1557 bp, Artificial Sequence; identical to SEQ ID NO: 103470
  Description of Artificial Sequence: Synthetic coding sequence

SEQ ID NO: 103476 - DNA, 1467 bp, Artificial Sequence; identical to SEQ ID NO: 103471
  Description of Artificial Sequence: Synthetic coding sequence

SEQ ID NO: 103477 - DNA, 1467 bp, Artificial Sequence; identical to SEQ ID NO: 103471
  Description of Artificial Sequence: Synthetic coding sequence

SEQ ID NO: 103478 - DNA, 1467 bp, Artificial Sequence; identical to SEQ ID NO: 103471
  Description of Artificial Sequence: Synthetic coding sequence

SEQ ID NO: 103479 - DNA, 435 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggactag

SEQ ID NO: 103480 - DNA, 684 bp, Artificial Sequence
  Description of Artificial Sequence: Synthetic coding sequence
tgaaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaaggacgtgaagagcaccctggagaagtgcgagaaggtgaagaccatggaggtgaccagcaccaccccctgcaccagcctgcacagcgagatcaacgacaacgtgagaggcagatag

SEQ ID NO: 103481 - DNA, 225 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatag

SEQ ID NO: 103482 - DNA, 1254 bp, Artificial Sequence
  Description of Artificial Sequence: Synthetic coding sequence
atggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagaggagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 103483 - DNA, 1557 bp, Artificial Sequence; identical to SEQ ID NO: 103470
  Description of Artificial Sequence: Synthetic coding sequence

SEQ ID NO: 103484 - DNA, 1467 bp, Artificial Sequence; identical to SEQ ID NO: 103471
  Description of Artificial Sequence: Synthetic coding sequence

SEQ ID NO: 103485 - DNA, 435 bp, Artificial Sequence; identical to SEQ ID NO: 103479
  Description of Artificial Sequence: Synthetic coding sequence

SEQ ID NO: 103486 - DNA, 225 bp, Artificial Sequence; identical to SEQ ID NO: 103481
  Description of Artificial Sequence: Synthetic coding sequence

SEQ ID NO: 103487 - DNA, 147 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctag

SEQ ID NO: 103488 - DNA, 1467 bp, Artificial Sequence; identical to SEQ ID NO: 103471
  Description of Artificial Sequence: Synthetic coding sequence

SEQ ID NO: 103489 - DNA, 684 bp, Artificial Sequence; identical to SEQ ID NO: 103480
  Description of Artificial Sequence: Synthetic coding sequence

SEQ ID NO: 103490 - DNA, 147 bp, Artificial Sequence; identical to SEQ ID NO: 103487
  Description of Artificial Sequence: Synthetic coding sequence

SEQ ID NO: 103491 - DNA, 147 bp, Artificial Sequence; identical to SEQ ID NO: 103487
  Description of Artificial Sequence: Synthetic coding sequence

SEQ ID NO: 103492 - DNA, 180 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggactag

SEQ ID NO: 103493 - DNA, 180 bp, Artificial Sequence; identical to SEQ ID NO: 103492
  Description of Artificial Sequence: Synthetic coding sequence

SEQ ID NO: 103494 - DNA, 435 bp, Artificial Sequence; identical to SEQ ID NO: 103479
  Description of Artificial Sequence: Synthetic coding sequence

SEQ ID NO: 103495 - DNA, 1557 bp, Artificial Sequence; identical to SEQ ID NO: 103470
  Description of Artificial Sequence: Synthetic coding sequence

SEQ ID NO: 103496 - DNA, 684 bp, Artificial Sequence; identical to SEQ ID NO: 103480
  Description of Artificial Sequence: Synthetic coding sequence

SEQ ID NO: 103497 - DNA, 684 bp, Artificial Sequence; identical to SEQ ID NO: 103480
  Description of Artificial Sequence: Synthetic coding sequence

SEQ ID NO: 103498 - DNA, 147 bp, Artificial Sequence; identical to SEQ ID NO: 103487
  Description of Artificial Sequence: Synthetic coding sequence

SEQ ID NO: 103499 - DNA, 1557 bp, Artificial Sequence; identical to SEQ ID NO: 103470
  Description of Artificial Sequence: Synthetic coding sequence

SEQ ID NO: 103500 - DNA, 225 bp, Artificial Sequence; identical to SEQ ID NO: 103481
  Description of Artificial Sequence: Synthetic coding sequence

SEQ ID NO: 103501 - DNA, 180 bp, Artificial Sequence; identical to SEQ ID NO: 103492
  Description of Artificial Sequence: Synthetic coding sequence

SEQ ID NO: 103502 - DNA, 147 bp, Artificial Sequence; identical to SEQ ID NO: 103487
  Description of Artificial Sequence: Synthetic coding sequence

SEQ ID NO: 103503 - DNA, 786 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaaggtgtag

SEQ ID NO: 103504 - DNA, 180 bp, Artificial Sequence; identical to SEQ ID NO: 103492
  Description of Artificial Sequence: Synthetic coding sequence

SEQ ID NO: 103505 - DNA, 435 bp, Artificial Sequence; identical to SEQ ID NO: 103479
  Description of Artificial Sequence: Synthetic coding sequence

SEQ ID NO: 103506 - DNA, 1467 bp, Artificial Sequence; identical to SEQ ID NO: 103471
  Description of Artificial Sequence: Synthetic coding sequence

SEQ ID NO: 103507 - DNA, 1467 bp, Artificial Sequence; identical to SEQ ID NO: 103471
  Description of Artificial Sequence: Synthetic coding sequence

SEQ ID NO: 103508 - DNA, 786 bp, Artificial Sequence; identical to SEQ ID NO: 103503
  Description of Artificial Sequence: Synthetic coding sequence

SEQ ID NO: 103509 - DNA, 1467 bp, Artificial Sequence; identical to SEQ ID NO: 103471
  Description of Artificial Sequence: Synthetic coding sequence

SEQ ID NO: 103510 - DNA, 180 bp, Artificial Sequence; identical to SEQ ID NO: 103492
  Description of Artificial Sequence: Synthetic coding sequence

SEQ ID NO: 103511 - DNA, 180 bp, Artificial Sequence; identical to SEQ ID NO: 103492
  Description of Artificial Sequence: Synthetic coding sequence

SEQ ID NO: 103512 - DNA, 684 bp, Artificial Sequence; identical to SEQ ID NO: 103480
  Description of Artificial Sequence: Synthetic coding sequence

SEQ ID NO: 103513 - DNA, 1467 bp, Artificial Sequence; identical to SEQ ID NO: 103471
  Description of Artificial Sequence: Synthetic coding sequence

SEQ ID NO: 103514 - DNA, 225 bp, Artificial Sequence; identical to SEQ ID NO: 103481
  Description of Artificial Sequence: Synthetic coding sequence

SEQ ID NO: 103515 - DNA, 684 bp, Artificial Sequence; identical to SEQ ID NO: 103480
  Description of Artificial Sequence: Synthetic coding sequence

SEQ ID NO: 103516 - DNA, 1467 bp, Artificial Sequence; identical to SEQ ID NO: 103471
  Description of Artificial Sequence: Synthetic coding sequence

SEQ ID NO: 103517 - DNA, 1467 bp, Artificial Sequence; identical to SEQ ID NO: 103471
  Description of Artificial Sequence: Synthetic coding sequence

SEQ ID NO: 103518 - DNA, 786 bp, Artificial Sequence; identical to SEQ ID NO: 103503
  Description of Artificial Sequence: Synthetic coding sequence

SEQ ID NO: 103519 - DNA, 225 bp, Artificial Sequence; identical to SEQ ID NO: 103481
  Description of Artificial Sequence: Synthetic coding sequence

SEQ ID NO: 103520 - DNA, 180 bp, Artificial Sequence; identical to SEQ ID NO: 103492
  Description of Artificial Sequence: Synthetic coding sequence

SEQ ID NO: 103521 - DNA, 786 bp, Artificial Sequence; identical to SEQ ID NO: 103503
  Description of Artificial Sequence: Synthetic coding sequence

SEQ ID NO: 103522 - DNA, 1467 bp, Artificial Sequence; identical to SEQ ID NO: 103471
  Description of Artificial Sequence: Synthetic coding sequence

SEQ ID NO: 103523 - DNA, 1557 bp, Artificial Sequence; identical to SEQ ID NO: 103470
  Description of Artificial Sequence: Synthetic coding sequence

SEQ ID NO: 103524 - DNA, 1467 bp, Artificial Sequence; identical to SEQ ID NO: 103471
  Description of Artificial Sequence: Synthetic coding sequence

SEQ ID NO: 103525 - DNA, 786 bp, Artificial Sequence; identical to SEQ ID NO: 103503
  Description of Artificial Sequence: Synthetic coding sequence

SEQ ID NO: 103526 - DNA, 225 bp, Artificial Sequence; identical to SEQ ID NO: 103481
  Description of Artificial Sequence: Synthetic coding sequence

SEQ ID NO: 103527 - DNA, 1236 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagaggagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggtgggcgacaagacccactgggccgtgggcgtgtgcagagacagcgtgagcagaaagggcggctgcggctacggcatgggcaccaacatgcagccccccccccacctgctgcccctgtgcaccagcagatag

SEQ ID NO: 103528 - DNA, 1467 bp, Artificial Sequence; identical to SEQ ID NO: 103471
  Description of Artificial Sequence: Synthetic coding sequence

SEQ ID NO: 103529 - DNA, 786 bp, Artificial Sequence; identical to SEQ ID NO: 103503
  Description of Artificial Sequence: Synthetic coding sequence

SEQ ID NO: 103530 - DNA, 147 bp, Artificial Sequence; identical to SEQ ID NO: 103487
  Description of Artificial Sequence: Synthetic coding sequence

SEQ ID NO: 103531 - DNA, 786 bp, Artificial Sequence; identical to SEQ ID NO: 103503
  Description of Artificial Sequence: Synthetic coding sequence

SEQ ID NO: 103532 - DNA, 1467 bp, Artificial Sequence; identical to SEQ ID NO: 103471
  Description of Artificial Sequence: Synthetic coding sequence

SEQ ID NO: 103533 - DNA, 225 bp, Artificial Sequence; identical to SEQ ID NO: 103481
  Description of Artificial Sequence: Synthetic coding sequence

SEQ ID NO: 103534 - DNA, 1467 bp, Artificial Sequence; identical to SEQ ID NO: 103471
  Description of Artificial Sequence: Synthetic coding sequence

SEQ ID NO: 103535 - DNA, 1557 bp, Artificial Sequence; identical to SEQ ID NO: 103470
  Description of Artificial Sequence: Synthetic coding sequence

SEQ ID NO: 103536 - DNA, 1467 bp, Artificial Sequence; identical to SEQ ID NO: 103471
  Description of Artificial Sequence: Synthetic coding sequence

SEQ ID NO: 103537 - DNA, 435 bp, Artificial Sequence; identical to SEQ ID NO: 103479
  Description of Artificial Sequence: Synthetic coding sequence

SEQ ID NO: 103538 - DNA, 435 bp, Artificial Sequence; identical to SEQ ID NO: 103479
  Description of Artificial Sequence: Synthetic coding sequence

SEQ ID NO: 103539 - DNA, 684 bp, Artificial Sequence; identical to SEQ ID NO: 103480
  Description of Artificial Sequence: Synthetic coding sequence

SEQ ID NO: 103540 - DNA, 147 bp, Artificial Sequence; identical to SEQ ID NO: 103487
  Description of Artificial Sequence: Synthetic coding sequence

SEQ ID NO: 103541 - DNA, 435 bp, Artificial Sequence; identical to SEQ ID NO: 103479
  Description of Artificial Sequence: Synthetic coding sequence

SEQ ID NO: 103542 - DNA, 1467 bp, Artificial Sequence; identical to SEQ ID NO: 103471
  Description of Artificial Sequence: Synthetic coding sequence

SEQ ID NO: 103543 - DNA, 1467 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagaggagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggtgggcgacaagacccactgggccgtgggcgtgtgcagagacagcgtgagcagaaagggcgagctgacccccctgcccgagaccggctactggagagtgagactgtggaacggcgacaagtacgccgccaccaccacccccttcacccccctgcacatcaaggtgaagcccaagagagtgggcatcttcctggactacgaggccggcaccctgagcttctacaacgtgaccgacagaagccacatctacaccttcaccgacaccttcaccgagaagctgtggcccctgttctaccccggcatcagagccggcagaaagaacgccgcccccctgaccatcagaccccccaccgactgggagtag

SEQ ID NO: 103544 - DNA, 1557 bp, Artificial Sequence
  Description of Artificial Sequence: Synthetic coding sequence
atggccgagaccagcctgctggaggccggcgccagcgccgccagcaccgccgccgccctggagaacctgcaggtggaggccagctgcagcgtgtgcctggagtacctgaaggagcccgtgatcatcgagtgcggccacaacttctgcaaggcctgcatcaccagatggtgggaggacctggagagagacttcccctgccccgtgtgcagaaagaccagcagatacagaagcctgagacccaacagacagctgggcagcatggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagagaagaacatccccagaaagttcggcggcagcctgagcaccatctgccccagagaccacaaggccctgctgggcctggtgaaggagatcaacagatgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggtgggcgacaagacccactgggccgtgggcgtgtgcagagacagcgtgagcagaaagggcgagctgacccccctgcccgagaccggctactggagagtgagactgtggaacggcgacaagtacgccgccaccaccacccccttcacccccctgcacatcaaggtgaagcccaagagagtgggcatcttcctggactacgaggccggcaccctgagcttctacaacgtgaccgacagaagccacatctacaccttcaccgacaccttcaccgagaagctgtggcccctgttctaccccggcatcagagccggcagaaagaacgccgcccccctgaccatcagaccccccaccgactgggagtag

SEQ ID NO: 103545 - DNA, 1236 bp, Artificial Sequence; identical to SEQ ID NO: 103527
  Description of Artificial Sequence: Synthetic coding sequence

SEQ ID NO: 103546 - DNA, 1557 bp, Artificial Sequence; identical to SEQ ID NO: 103544
  Description of Artificial Sequence: Synthetic coding sequence

SEQ ID NO: 103547 - DNA, 1467 bp, Artificial Sequence; identical to SEQ ID NO: 103543
  Description of Artificial Sequence: Synthetic coding sequence

SEQ ID NO: 103548 - DNA, 1557 bp, Artificial Sequence; identical to SEQ ID NO: 103470
  Description of Artificial Sequence: Synthetic coding sequence

SEQ ID NO: 103549 - DNA, 1467 bp, Artificial Sequence; identical to SEQ ID NO: 103543
  Description of Artificial Sequence: Synthetic coding sequence

SEQ ID NO: 103550 - DNA, 1467 bp, Artificial Sequence; identical to SEQ ID NO: 103543
  Description of Artificial Sequence: Synthetic coding sequence

SEQ ID NO: 103551 - DNA, 1467 bp, Artificial Sequence; identical to SEQ ID NO: 103543
  Description of Artificial Sequence: Synthetic coding sequence

SEQ ID NO: 103552 - DNA, 1557 bp, Artificial Sequence; identical to SEQ ID NO: 103470
  Description of Artificial Sequence: Synthetic coding sequence

SEQ ID NO: 103553 - DNA, 1236 bp, Artificial Sequence; identical to SEQ ID NO: 103527
  Description of Artificial Sequence: Synthetic coding sequence

SEQ ID NO: 103554 - DNA, 1557 bp, Artificial Sequence; identical to SEQ ID NO: 103544
  Description of Artificial Sequence: Synthetic coding sequence

SEQ ID NO: 103555 - DNA, 1236 bp, Artificial Sequence; identical to SEQ ID NO: 103527
  Description of Artificial Sequence: Synthetic coding sequence

SEQ ID NO: 103556 - DNA, 1236 bp, Artificial Sequence; identical to SEQ ID NO: 103527
  Description of Artificial Sequence: Synthetic coding sequence

SEQ ID NO: 103557 - DNA, 1557 bp, Artificial Sequence; identical to SEQ ID NO: 103470
  Description of Artificial Sequence: Synthetic coding sequence

SEQ ID NO: 103558 - DNA, 1557 bp, Artificial Sequence; identical to SEQ ID NO: 103544
  Description of Artificial Sequence: Synthetic coding sequence

SEQ ID NO: 103559 - DNA, 1557 bp, Artificial Sequence; identical to SEQ ID NO: 103544
  Description of Artificial Sequence: Synthetic coding sequence

SEQ ID NO: 103560 - DNA, 1557 bp, Artificial Sequence; identical to SEQ ID NO: 103470
  Description of Artificial Sequence: Synthetic coding sequence

SEQ ID NO: 103561 - DNA, 1557 bp, Artificial Sequence; identical to SEQ ID NO: 103544
  Description of Artificial Sequence: Synthetic coding sequence

SEQ ID NO: 103562 - DNA, 1254 bp, Artificial Sequence
  Description of Artificial Sequence: Synthetic coding sequence
atggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagaggagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccacagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagacccagggcagcagcaaccagtag

SEQ ID NO: 103563 - DNA, 1254 bp, Artificial Sequence; identical to SEQ ID NO: 103562
  Description of Artificial Sequence: Synthetic coding sequence

SEQ ID NO: 103564 - DNA, 1236 bp, Artificial Sequence; identical to SEQ ID NO: 103527
  Description of Artificial Sequence: Synthetic coding sequence

SEQ ID NO: 103565 - DNA, 1254 bp, Artificial Sequence; identical to SEQ ID NO: 103562
  Description of Artificial Sequence: Synthetic coding sequence

SEQ ID NO: 103566 - DNA, 1557 bp, Artificial Sequence; identical to SEQ ID NO: 103544
  Description of Artificial Sequence: Synthetic coding sequence

SEQ ID NO: 103567 - DNA, 1254 bp, Artificial Sequence
  Description of Artificial Sequence: Synthetic coding sequence
atggtggagatcgccaagcagctgcaggccgtgaagagaaagatcagagacgagagcctgtgcccccagcaccacgaggccctgagcctgttctgctacgaggaccaggaggccgtgtgcctgatctgcgccatcagccacacccacagagcccacaccgtggtgcccctggacgacgccacccaggagtacaaggagaagctgcagaagtgcctggagcccctggagcagaagctgcaggagatcaccagatgcaagagcagcgaggagaagaagcccggcgagctgaagagactggtggagagcagaagacagcagatcctgagagagttcgaggagctgcacagaagactggacgaggagcagcaggtgctgctgagcagactggaggaggaggagcaggacatcctgcagagactgagagagaacgccgcccacctgggcgacaagagaagagacctggcccacctggccgccgaggtggagggcaagtgcctgcagagcggcttcgagatgctgaagcccgtgctgagcgccagagaggagtgcgagaaggtgaagaccatggaggtgaccagcgtgagcatcgagctggagaagaacttcagcaacttccccagacagtacttcgccctgagaaagatcctgaagcagctgatcgccgacgtgaccctggaccccgagaccgcccaccccaacctggtgctgagcgaggacagaaagagcgtgaagttcgtggagaccagactgagagacctgcccgacacccccagaagattcaccttctacccctgcgtgctggccaccgagggcttcaccagcggcagacactactgggaggtggaggccgcccactgcgtgctggcccaggaccccgagaaccaggccctggccagattctactgctacaccgagagaaccatcgccaagagactggtgctgagaagagaccccagcgtgaagagaaccctgtgcagaggctgcagcagcctgctggtgcccggcctgacctgcacccagagacagagaagatgcagaggccagagatggaccgtgcagacctgcctgacctgccagagaagccagagattcctgaacgaccccggccacctgctgtggggcgacagacccgaggcccagctgggcagccaggccgacagcaagcccctgcagcccctgcccaacaccgcccacagcatcagcgacagactgcccgaggagaagatgcagaccaagggcagcagcaaccagtag

SEQ ID NO: 103568 - DNA, 1236 bp, Artificial Sequence; identical to SEQ ID NO: 103527
  Description of Artificial Sequence: Synthetic coding sequence

SEQ ID NO: 103569 - DNA, 1254 bp, Artificial Sequence; identical to SEQ ID NO: 103482
  Description of Artificial Sequence: Synthetic coding sequence

SEQ ID NO: 103570 - DNA, 1557 bp, Artificial Sequence; identical to SEQ ID NO: 103470
  Description of Artificial Sequence: Synthetic coding sequence

SEQ ID NO: 103571 - DNA, 1557 bp, Artificial Sequence; identical to SEQ ID NO: 103470
  Description of Artificial Sequence: Synthetic coding sequence

SEQ ID NO: 103572 - DNA, 1467 bp, Artificial Sequence; identical to SEQ ID NO: 103543
  Description of Artificial Sequence: Synthetic coding sequence

SEQ ID NO: 103573 - DNA, 1467 bp, Artificial Sequence; identical to SEQ ID NO: 103543
  Description of Artificial Sequence: Synthetic coding sequence

SEQ ID NO: 103574 - DNA, 1254 bp, Artificial Sequence; identical to SEQ ID NO: 103482
  Description of Artificial Sequence: Synthetic coding sequence

SEQ ID NO: 103575 - DNA, 1893 bp, Artificial Sequence
  Description of Artificial Sequence: Synthetic coding sequence
atggccgccgtggccatgacccccaaccccgtgcagaccctgcaggaggaggccgtgtgcgccatctgcctggactacttcaccgaccccgtgagcatcggctgcggccacaacttctgcagagtgtgcgtgacccagctgtggggcggcgaggacgaggaggacagagacgagctggacagagaggaggaggaggaggacggcgaggaggaggaggtggaggccgtgggcgccggcgccggctgggacacccccatgagagacgaggactacgagggcgacatggaggaggaggtggaggaggaggaggagggcgtgttctggaccagcggcatgagcagaagcagctgggacaacatggactacgtgtgggaggaggaggacgaggaggaggacctggactactacctgggcgacatggaggaggaggacctgagaggcgaggacgaggaggacgaggaggaggtgctggaggaggtggaggaggaggacctggaccccgtgacccccctgccccccccccccgcccccagaagatgcttcacctgcccccagtgcagaaagagcttccccagaagaagcttcagacccaacctgcagctggccaacatggtgcaggtgatcagacagatgcaccccacccccggcagaggcagcagagtgaccgaccagggcatctgccccaagcaccaggaggccctgaagctgttctgcgaggtggacgaggaggccatctgcgtggtgtgcagagagagcagaagccacaagcagcacagcgtggtgcccctggaggaggtggtgcaggagtacaaggccaagctgcagggccacgtggagcccctgagaaagcacctggaggccgtgcagaagatgaaggccaaggaggagagaagagtgaccgagctgaagagccagatgaagagcgagctggccgccgtggccagcgagttcggcagactgaccagattcctggccgaggagcaggccggcctggagagaagactgagagagatgcacgaggcccagctgggcagagccggcgccgccgccagcagactggccgagcaggccgcccagctgagcagactgctggccgaggcccaggagagaagccagcagggcggcctgagactgctgcaggacatcaaggagaccttcaacagatgcgaggaggtgcagctgcagccccccgaggtgtggagccccgacccctgccagccccacagccacgacttcctgaccgacgccatcgtgagaaagatgagcagaatgttctgccaggccgccagagtggacctgaccctggaccccgacaccgcccaccccgccctgatgctgagccccgacagaagaggcgtgagactggccgagagaagacaggaggtggccgaccaccccaagagattcagcgccgactgctgcgtgctgggcgcccagggcttcagaagcggcagacactactgggaggtggaggtgggcggcagaagaggctgggccgtgggcgccgccagagagagcacccaccacaaggagaaggtgggccccggcggcagcagcgtgggcagcggcgacgccagcagcagcagacaccaccacagaagaagaagactgcacctgccccagcagcccctgctgcagagagaggtgtggtgcgtgggcaccaacggcaagagataccaggcccagagcagcaccgagcagaccctgctgagccccagcgagaagcccagaagattcggcgtgtacctggactacgaggccggcagactgggcttctacaacgccgagaccctggcccacgtgcacaccttcagcgccgccttcctgggcgagagagtgttccccttcttcagagtgctgagcaagggcaccagaatcaagctgtgcccctag

SEQ ID NO: 103576 - DNA, 1557 bp, Artificial Sequence
  Description of Artificial Sequence: Synthetic coding sequence
atggccgccgtggccatgacccccaaccccgtgcagaccctgcaggaggaggccgtgtgcgccatctgcctggactacttcaccgaccccgtgagcatcggctgcggccacaacttctgcagagtgtgcgtgacccagctgtggggcggcgaggacgaggaggacagagacgagctggacagagaggaggaggaggaggacggcgaggaggaggaggtggaggccgtgggcgccggcgccggctgggacacccccatgagagacgaggactacgagggcgacatggaggaggaggtggaggaggaggaggagggcgtgttctggaccagcggcatgagcagaagcagctgggacaacatggactacgtgtgggaggaggaggacgaggaggaggacctggactactacctgggcgacatggaggaggaggacctgagaggcgaggacgaggaggacgaggaggaggtgctggaggaggtggaggaggaggacctggaccccgtgacccccctgccccccccccccgcccccagaagatgcttcacctgcccccagtgcagaaagagcttccccagaagaagcttcagacccaacctgcagctggccaacatggtgcaggtgatcagacagatgcaccccacccccggcagaggcagcagagtgaccgaccagggcatctgccccaagcaccaggaggccctgaagctgttctgcgaggtggacgaggaggccatctgcgtggtgtgcagagagagcagaagccacaagcagcacagcgtggtgcccctggaggaggtggtgcaggagtacaaggccaagctgcagggccacgtggagcccctgagaaagcacctggaggccgtgcagaagatgaaggccaaggaggagagaagagtgaccgagctgaagagccagatgaagagcgagctggccgccgtggccagcgagttcggcagactgaccagattcctggccgaggagcaggccggcctggagagaagactgagagagatgcacgaggcccagctgggcagagccggcgccgccgccagcagactggccgagcaggccgcccagctgagcagactgctggccgaggcccaggagagaagccagcagggcggcctgagactgctgcaggacatcaaggagaccttcaacagatgcgaggaggtgcagctgcagccccccgaggtgtggagccccgacccctgccagccccacagccacgacttcctgaccgacgccatcgtgagaaagatgagcagaatgttctgccaggccgccagagtggacctgaccctggaccccgacaccgcccaccccgccctgatgctgagccccgacagaagaggcgtgagactggccgagagaagacaggaggtggccgaccaccccaagagattcagcgccgactgctgcgtgctgggcgcccagggcttcagaagcggcagacactactgggaggagcccaaggagcccagctggccccccgcccagcccagcctgacctactacgtgtgccccaccgacagacccgagttcagcttcacctag

SEQ ID NO: 103577 - DNA, 453 bp, Artificial Sequence
  Description of Artificial Sequence: Synthetic coding sequence
ctgcaggaggaggccgtgtgcgccatctgcctggactacttcaccgaccccgtgagcatcggctgcggccacaacttctgcagagtgtgcgtgacccagctgtggggcagaagaggcggcggcagcggcggctaccccgtgacccccctgccccccccccccgcccccagaagatgcttcacctgcccccagtgcagaaagagcttccccagaagaagcttcagacccaacctgcagctggccaacatggtgcaggtgatcagacagatgcaccccacccccggcagaggcagcagagtgaccgaccagggcatctgccccaagcaccaggaggccctgaagctgttctgcgaggtggacgaggaggccatctgcgtggtgtgcagagagagcagaagccacaagcagcacagcgtggtgcccctggaggaggtggtgcaggagtacaagtag

SEQ ID NO: 103578 - DNA, 948 bp, Artificial Sequence
  Description of Artificial Sequence: Synthetic coding sequence
atgaaggccaaggaggagagaagagtgaccgagctgaagagccagatgaagagcgagctggccgccgtggccagcgagttcggcagactgaccagattcctggccgaggagcaggccggcctggagagaagactgagagagatgcacgaggcccagctgggcagagccggcgccgccgccagcagactggccgagcaggccgcccagctgagcagactgctggccgaggcccaggagagaagccagcagggcggcctgagactgctgcagcaggacatcaaggagaccttcaacagatacgccatcgtgagaaagatgagcagaatgttctgccaggccgccagagtggacctgaccctggaccccgacaccgcccaccccgccctgatgctgagccccgacagaagaggcgtgagactggccgagagaagacaggaggtggccgaccaccccaagagattcagcgccgactgctgcgtgctgggcgcccagggcttcagaagcggcagacactactgggaggtggaggtgggcggcagaagaggctgggccgtgggcgccgccagagagagcacccaccacaaggagaaggtgggccccggcggcagcagcgtgggcagcggcgacgccagcagcagcagacaccaccacagaagaagaagactgcacctgccccagcagcccctgctgcagagagaggtgtggtgcgtgggcaccaacggcaagagataccaggcccagagcagcaccgagcagaccctgctgagccccagcgagaagcccagaagattcggcgtgtacctggactacgaggccggcagactgggcttctacaacgccgagaccctggcccacgtgcacaccttcagcgccgccttcctgggcgagagagtgttccccttcttcagagtgctgagcaagggcaccagaatcaagctgtgcccctag

SEQ ID NO: 103579 - DNA, 1035 bp, Artificial Sequence
  Description of Artificial Sequence: Synthetic coding sequence
atggccagcggcgtgggcgccgccttcgaggagctgccccacgacggcacctgcgacgagtgcgagcccgacgaggcccccggcgccgaggaggtgtgcagagagtgcggcttctgctactgcagaagacacgccgaggcccacagacagaagttcctgagccaccacctggccgagtacgtgcacggcagccaggcctggaccccccccgccgacggcgagggcgccggcaaggaggaggccgaggtgaaggtggagcaggagagagagatcgagagcgaggccggcgaggagagcgagagcgaggaggagagcgagagcgaggaggagagcgagaccgaggaggagagcgaggacgagagcgacgaggagagcgaggaggacagcgaggaggagatggaggacgagcaggagagcgaggccgaggaggacaaccaggaggagggcgagagcgaggccgagggcgagaccgaggccgagagcgagttcgaccccgagatcgagatggaggccgagagagtggccaagagaaagtgccccgaccacggcctggacctgagcacctactgccaggaggacagacagctgatctgcgtgctgtgccccgtgatcggcgcccaccagggccaccagctgagcaccctggacgaggccttcgaggagctgagaagcaaggacagcggcggcctgaaggccgccatgatcgagctggtggagagactgaagttcaagagcagcgaccccaaggtgaccagagaccagatgaagatgttcatccagcaggagttcaagaaggtgcagaaggtgatcgccgacgaggagcagaaggccctgcacctggtggacatccaggaggccatggccaccgcccacgtgaccgagatcctggccgacatccagagccacatggacagactgatgacccagatggcccaggccaaggagcagctggacaccagcaacgagagcgccgagcccaaggccgagggcgacgaggagggccccagcggcgccagcgaggaggaggacacctag

SEQ ID NO: 103580 - DNA, 1743 bp, Artificial Sequence
  Description of Artificial Sequence: Synthetic coding sequence
atgagcgagaacagaaagcccctgctgggcttcgtgagcaagctgaccagcggcaccgccctgggcaacagcggcaagacccactgccccctgtgcctgggcctgttcaaggcccccagactgctgccctgcctgcacaccgtgtgcaccacctgcctggagcagctggagcccttcagcgtggtggacatcagaggcggcgacagcgacaccagcagcgagggcagcatcttccaggagctgaagcccagaagcctgcagagccagatcggcatcctgtgccccgtgtgcgacgcccaggtggacctgcccatgggcggcgtgaaggccctgaccatcgaccacctggccgtgaacgacgtgatgctggagagcctgagaggcgagggccagggcctggtgtgcgacctgtgcaacgacagagaggtggagaagagatgccagacctgcaaggccaacctgtgccacttctgctgccaggcccacagaagacagaagaagaccacctaccacaccatggtggacctgaaggacctgaagggctacagcagaatcggcaagcccatcctgtgccccgtgcaccccgccgaggagctgagactgttctgcgagttctgcgacagacccgtgtgccaggactgcgtggtgggcgagcacagagagcacccctgcgacttcaccagcaacgtgatccacaagcacggcgacagcgtgtgggagctgctgaagggcacccagccccacgtggaggccctggaggaggccctggcccagatccacatcatcaacagcgccctgcagaagagagtggaggccgtggccgccgacgtgagaaccttcagcgagggctacatcaaggccatcgaggagcacagagacaagctgctgaagcagctggaggacatcagagcccagaaggagaacagcctgcagctgcagaaggcccagctggagcagctgctggccgacatgagaaccggcgtggagttcaccgagcacctgctgaccagcggcagcgacctggagatcctgatcaccaagagagtggtggtggagagactgagaaagctgaacaaggtgcagtacagcaccagacccggcgtgaacgacaagatcagattctgcccccaggagaaggccggccagtgcagaggctacgagatctacggcaccatcaacaccaaggaggtggaccccgccaagtgcgtgctgcagggcgaggacctgcacagagccagagagaagcagaccgccagcttcaccctgctgtgcaaggacgccgccggcgagatcatgggcagaggcggcgacaacgtgcaggtggccgtggtgcccaaggacaagaaggacagccccgtgagaaccatggtgcaggacaacaaggacggcacctactacatcagctacacccccaaggagcccggcgtgtacaccgtgtgggtgtgcatcaaggagcagcacgtgcagggcagccccttcaccgtgatggtgagaagaaagcacagaccccacagcggcgtgttccactgctgcaccttctgcagcagcggcggccagaagaccgccagatgcgcctgcggcggcaccatgcccggcggctacctgggctgcggccacggccacaagggccaccccggccacccccactggagctgctgcggcaagttcaacgagaagagcgagtgcacctggaccggcggccagagcgcccccagaagcctgctgagaaccgtggccctgtag

SEQ ID NO: 103581 - DNA, 1572 bp, Artificial Sequence
  Description of Artificial Sequence: Synthetic coding sequence
atgctgagcggcgtgaccctggagggcggcggcgccagaagcggcgagggcagaagaagcagaaccgagctgaagcccagaagcctgcagagccagatcggcatcctgtgccccgtgtgcgacgcccaggtggacctgcccatgggcggcgtgaaggccctgaccatcgaccacctggccgtgaacgacgtgatgctggagagcctgagaggcgagggccagggcctggtgtgcgacctgtgcaacgacagagaggtggagaagagatgccagacctgcaaggccaacctgtgccacttctgctgccaggcccacagaagacagaagaagaccacctaccacaccatggtggacctgaaggacctgaagggctacagcagaatcggcaagcccatcctgtgccccgtgcaccccgccgaggagctgagactgttctgcgagttctgcgacagacccgtgtgccaggactgcgtggtgggcgagcacagagagcacccctgcgacttcaccagcaacgtgatccacaagcacggcgacagcgtgtgggagctgctgaagggcacccagccccacgtggaggccctggaggaggccctggcccagatccacatcatcaacagcgccctgcagaagagagtggaggccgtggccgccgacgtgagaaccttcagcgagggctacatcaaggccatcgaggagcacagagacaagctgctgaagcagctggaggacatcagagcccagaaggagaacagcctgcagctgcagaaggcccagctggagcagctgctggccgacatgagaaccggcgtggagttcaccgagcacctgctgaccagcggcagcgacctggagatcctgatcaccaagagagtggtggtggagagactgagaaagctgaacaaggtgcagtacagcaccagacccggcgtgaacgacaagatcagattctgcccccaggagaaggccggccagtgcagaggctacgagatctacggcaccatcaacaccaaggaggtggaccccgccaagtgcgtgctgcagggcgaggacctgcacagagccagagagaagcagaccgccagcttcaccctgctgtgcaaggacgccgccggcgagatcatgggcagaggcggcgacaacgtgcaggtggccgtggtgcccaaggacaagaaggacagccccgtgagaaccatggtgcaggacaacaaggacggcacctactacatcagctacacccccaaggagcccggcgtgtacaccgtgtgggtgtgcatcaaggagcagcacgtgcagggcagccccttcaccgtgatggtgagaagaaagcacagaccccacagcggcgtgttccactgctgcaccttctgcagcagcggcggccagaagaccgccagatgcgcctgcggcggcaccatgcccggcggctacctgggctgcggccacggccacaagggccaccccggccacccccactggagctgctgcggcaagttcaacgagaagagcgagtgcacctggaccggcggccagagcgcccccagaagcctgctgagaaccgtggccctgtag

SEQ ID NO: 103582 - DNA, 1689 bp, Artificial Sequence
  Description of Artificial Sequence: Synthetic coding sequence
atgagcgagaacagaaagcccctgctgggcttcgtgagcaagctgaccagcggcaccgccctgggcaacagcggcaagacccactgccccctgtgcctgggcctgttcaaggcccccagactgctgccctgcctgcacaccgtgtgcaccacctgcctggagcagctggagcccttcagcgtggtggacatcagaggcggcgacagcgacaccagcagcgagggcagcatcttccaggagctgaagcccagaagcctgcagagccagatcggcatcctgtgccccgtgtgcgacgcccaggtggacctgcccatgggcggcgtgaaggccctgaccatcgaccacctggccgtgaacgacgtgatgctggagagcctgagaggcgagggccagggcctggtgtgcgacctgtgcaacgacagagaggtggagaagagatgccagacctgcaaggccaacctgtgccacttctgctgccaggcccacagaagacagaagaagaccacctaccacaccatggtggacctgaaggacctgaagggctacagcagaatcggcaagcccatcctgtgccccgtgcaccccgccgaggagctgagactgttctgcgagttctgcgacagacccgtgtgccaggactgcgtggtgggcgagcacagagagcacccctgcgacttcaccagcaacgtgatccacaagcacggcgacagcgtgtgggagctgctgaagggcacccagccccacgtggaggccctggaggaggccctggcccagatccacatcatcaacagcgccctgcagaagagagtggaggccgtggccgccgacgtgagaaccttcagcgagggctacatcaaggccatcgaggagcacagagacaagctgctgaagcagctggaggacatcagagcccagaaggagaacagcctgcagctgcagaaggcccagctggagcagctgctggccgacatgagaaccggcgtggagttcaccgagcacctgctgaccagcggcagcgacctggagatcctgatcaccaagagagtggtggtggagagactgagaaagctgaacaaggtgcagtacagcaccagacccggcgtgaacgacaagatcagattctgcccccaggagaaggccggccagtgcagaggctacgagatctacgacctgcacagagccagagagaagcagaccgccagcttcaccctgctgtgcaaggacgccgccggcgagatcatgggcagaggcggcgacaacgtgcaggtggccgtggtgcccaaggacaagaaggacagccccgtgagaaccatggtgcaggacaacaaggacggcacctactacatcagctacacccccaaggagcccggcgtgtacaccgtgtgggtgtgcatcaaggagcagcacgtgcagggcagccccttcaccgtgatggtgagaagaaagcacagaccccacagcggcgtgttccactgctgcaccttctgcagcagcggcggccagaagaccgccagatgcgcctgcggcggcaccatgcccggcggctacctgggctgcggccacggccacaagggccaccccggccacccccactggagctgctgcggcaagttcaacgagaagagcgagtgcacctggaccggcggccagagcgcccccagaagcctgctgagaaccgtggccctgtag

SEQ ID NO: 103583 - DNA, 1917 bp, Artificial Sequence
  Description of Artificial Sequence: Synthetic coding sequence
atggacggcagcggccccttcagctgccccatctgcctggagcccctgagagagcccgtgaccctgccctgcggccacaacttctgcctggcctgcctgggcgccctgtggccccacagaggcgccagcggcgccggcggccccggcggcgccgccagatgccccctgtgccaggagcccttccccgacggcctgcagctgagaaagaaccacaccctgagcgagctgctgcagctgagacagggcagcggccccggcagcggccccggccccgcccccgccctggcccccgagcccagcgcccccagcgccctgcccagcgtgcccgagcccagcgccccctgcgcccccgagccctggcccgccggcgaggagcccgtgagatgcgacgcctgccccgagggcgccgccctgcccgccgccctgagctgcctgagctgcctggccagcttctgccccgcccacctgggcccccacgagagaagccccgccctgagaggccacagactggtgccccccctgagaagactggaggagagcctgtgccccagacacctgagacccctggagagatactgcagagccgagagagtgtgcctgtgcgaggcctgcgccgcccaggagcacagaggccacgagctggtgcccctggagcaggagagagccctgcaggaggccgagcagagcaaggtgctgagcgccgtggaggacagaatggacgagctgggcgccggcatcgcccagagcagaagaaccgtggccctgatcaagagcgccgccgtggccgagagagagagagtgagcagactgttcgccgacgccgccgccgccctgcagggcttccagacccaggtgctgggcttcatcgaggagggcgaggccgccatgctgggcagaagccagggcgacctgagaagacaggaggagcagagaagcagactgagcagagccagacagaacctgagccaggtgcccgaggccgacagcgtgagcttcctgcaggagctgctggccctgagactggccctggaggacggctgcggccccggccccggcccccccagagagctgagcttcaccaagagcagccaggccgtgagagccgtgagagacatgctggccgtggcctgcgtgaaccagtgggagcagctgagaggccccggcggcaacgaggacggcccccagaagctggacagcgaggccgacgccgagccccaggacctggagagcaccaacctgctggagagcgaggcccccagagactacttcctgaagttcgcctacatcgtggacctggacagcgacaccgccgacaagttcctgcagctgttcggcaccaagggcgtgaagagagtgctgtgccccatcaactaccccctgagccccaccagattcacccactgcgagcaggtgctgggcgagggcgccctggacagaggcacctactactgggaggtggagatcatcgagggctgggtgagcatgggcgtgatggccgaggacttcagcccccaggagccctacgacagaggcagactgggcagaaacgcccacagctgctgcctgcagtggaacggcagaagcttcagcgtgtggttccacggcctggaggcccccctgccccaccccttcagccccaccgtgggcgtgtgcctggagtacgccgacagagccctggccttctacgccgtgagagacggcaagatgagcctgctgagaagactgaaggccagcagacccagaagaggcggcatccccgccagccccatcgaccccttccagagcagactggacagccacttcgccggcctgttcacccacagactgaagcccgccttcttcctggagagcgtggacgcccacctgcagatcggccccctgaagaagagctgcatcagcgtgctgaagagaagatag

SEQ ID NO: 103584 - DNA, 1482 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcagaaggtgagcggcaagatcctgagaaccgagaacgtgaccctgaagaagcccgagaccttccccaagaaccagagaagagtgttcagagcccccgacctgaagggcatgctggaggtgttcagagagctgaccgacgtgagaagatactgggtggacgtgaccgtggcccccaacaacatcagctgcgccgtgatcagcgaggacaagagacaggtgagcagccccaagccccagatcatctacggcgccagaggcaccagataccagaccttcgtgaacttcaactactgcaccggcatcctgggcagccagagcatcaccagcggcaagcactactgggaggtggacgtgagcaagaagaccgcctggatcctgggcgtgtgcgccggcttccagcccgacgccatgtgcaacatcgagaagaacgagaactaccagcccaagtacggctactgggtgatcggcctggaggagggcgtgaagtgcagcgccttccaggacagcagcttccacacccccagcgtgcccttcatcgtgcccctgagcgtgatcatctgccccgacagagtgggcgtgttcctggactacgaggcctgcaccgtgagcttcttcaacatcaccaaccacggcttcctgatctacaagttcagccactgcagcttcagccagcccgtgttcccctacctgaaccccagaaagtgcggcgtgcccatgaccctgtgcagccccagcagctag

SEQ ID NO: 103585 - DNA, 981 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcagggcgtggacggcgtgatcaagagaaccgagaacgtgaccctgaagaagcccgagaccttccccaagaaccagagaagagtgttcagagcccccgacctgaagggcatgctggaggtgttcagagagctgaccgacgtgagaagatactggggctggagcgccatggccagaagcagattcaccgccaccagcaccagccagatccaggccatcctgctgccccagccccccaagtag

SEQ ID NO: 103586 - DNA, 1482 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcagggcgtggacggcgtgatcaagagaaccgagaacgtgaccctgaagaagcccgagaccttccccaagaaccagagaagagtgttcagagcccccgacctgaagggcatgctggaggtgttcagagagctgaccgacgtgagaagatactgggtggacgtgaccgtggcccccaacaacatcagctgcgccgtgatcagcgaggacaagagacaggtgagcagccccaagccccagatcatctacggcgccagaggcaccagataccagaccttcgtgaacttcaactactgcaccggcatcctgggcagccagagcatcaccagcggcaagcactactgggaggtggacgtgagcaagaagaccgcctggatcctgggcgtgtgcgccggcttccagcccgacgccatgtgcaacatcgagaagaacgagaactaccagcccaagtacggctactgggtgatcggcctggaggagggcgtgaagtgcagcgccttccaggacagcagcttccacacccccagcgtgcccttcatcgtgcccctgagcgtgatcatctgccccgacagagtgggcgtgttcctggactacgaggcctgcaccgtgagcttcttcaacatcaccaaccacggcttcctgatctacaagttcagccactgcagcttcagccagcccgtgttcccctacctgaaccccagaaagtgcggcgtgcccatgaccctgtgcagccccagcagctag

SEQ ID NO: 103587 - DNA, 1044 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcagggcgtggacggcgtgatcaagagaaccgagaacgtgaccctgaagaagcccgagaccttccccaagaaccagagaagagtgttcagagcccccgacctgaagggcatgctggaggtgttcagagagctgaccgacgtgagaagatactggggcaaggagaagagccactaccacaagcccccctgcggcctgagcctgctgctgagcctgagcttcagaatcctgtgcagcctgctgggcagctgcttcaagatctacgacagccccagcaagacccacatcacctaccccagcctgtag

SEQ ID NO: 103588 - DNA, 984 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcaggccggcgtgcagtgcctgatcctgagaaccgagaacgtgaccctgaagaagcccgagaccttccccaagaaccagagaagagtgttcagagcccccgacctgaagggcatgctggaggtgttcagagagctgaccgacgtgagaagatactggggctggagcgccatggccagaagcagattcaccgccaccagcaccagccagatccaggccatcctgctgccccagccccccaagtag

SEQ ID NO: 103589 - DNA, 981 bp, Artificial Sequence; identical to SEQ ID NO: 103585
  Description of Artificial Sequence: Synthetic coding sequence

SEQ ID NO: 103590 - DNA, 630 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggactag

SEQ ID NO: 103591 - DNA, 219 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacactag

SEQ ID NO: 103592 - DNA, 816 bp, Artificial Sequence
  Description of Artificial Sequence: Synthetic coding sequence
atggccagcggcatcctggtgaacgtgaaggaggaggtgacctgccccatctgcctggagctgctgacccagcccctgagcctggactgcggccacagcttctgccaggcctgcctgaccgccaaccacaagaagagcatgctggacaagggcgagagcagctgccccgtgtgcagaatcagctaccagcccgagaacatcagacccaacagacacgtggccaacatcgtggagaagctgagagaggtgaagctgagccccgagggccagaaggtggaccactgcgccagacacggcgagaagctgctgctgttctgccaggaggacggcaaggtgatctgctggctgtgcgagagaagccaggagcacagaggccaccacaccttcctgaccgaggaggtggccagagagtaccaggtgaagctgcaggccgccctggagatgctgagacagaagcagcaggaggccgaggagctggaggccgacatcagagaggagaaggccagctggaagacccagatccagtacgacaagaccaacgtgctggccgacttcgagcagctgagagacatcctggactgggaggagagcaacgagctgcagaacctggagaaggaggaggaggacatcctgaagagcctgaccaacagcgagaccgagatggtgcagcagacccagagcctgagagagctgatcagcgacctggagcacagactgcagggcagcgtgatggagctgctgcaggacggcgagagagacctggaggaggccagaaacttcagcaagaagagcaaggagagcgtgagcagcagctag

SEQ ID NO: 103593 - DNA, 1464 bp, Artificial Sequence
  Description of Artificial Sequence: Synthetic coding sequence
atggcctggcaggtgagcctgctggagctggaggactggctgcagtgccccatctgcctggaggtgttcaaggagcccctgatgctgcagtgcggccacagctactgcaagggctgcctggtgagcctgagctgccacctggacgccgagctgagatgccccgtgtgcagacaggccgtggacggcagcagcagcctgcccaacgtgagcctggccagagtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtacagcagaatgaaggaggagctggccgccctgatcagcgagctgaagcaggagcagaagaaggtggacgagctgatcgccaagctggtgaacaacagaaccagaatcgtgaacgagagcgacgtgttcagctgggtgatcagaagagagttccaggagctgcaccacctggtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacaagttcatcagaaagttccacagcatggccagcagagccgagatgccccaggccagacccctggagggcgccttcagccccatcagcttcaagcccggcctgcaccaggccgacatcaagctgaccgtgtggaagagactgttcagaaaggtgctgcccgcccccgagcccctgaagctggaccccgccaccgcccaccccctgctggagctgagcaagggcaacaccgtggtgcagtgcggcctgctggcccagagaagagccagccagcccgagagattcgactacagcacctgcgtgctggccagcagaggcttcagctgcggcagacactactgggaggtggtggtgggcagcaagagcgactggagactgggcgtgatcaagggcaccgccagcagaaagggcaagctgaacagaagccccgagcacggcgtgtggctgatcggcctgaaggagggcagagtgtacgaggccttcgcctgccccagagtgcccctgcccgtggccggccacccccacagaatcggcctgtacctgcactacgagcagggcgagctgaccttcttcgacgccgacagacccgacgacctgagacccctgtacaccttccaggccgacttccagggcaagctgtaccccatcctggacacctgctggcacgagagaggcagcaacagcctgcccatggtgctgcccccccccagcggccccggccccctgagccccgagcagcccaccaagctgtag

SEQ ID NO: 103594 - DNA, 1464 bp, Artificial Sequence; identical to SEQ ID NO: 103593
  Description of Artificial Sequence: Synthetic coding sequence

SEQ ID NO: 103595 - DNA, 1467 bp, Artificial Sequence
  Description of Artificial Sequence: Synthetic coding sequence
atgaccagccccgtgctggtggacatcagagaggaggtgacctgccccatctgcctggagctgctgaccgagcccctgagcatcgactgcggccacagcttctgccaggcctgcatcacccccaacggcagagagagcgtgatcggccaggagggcgagagaagctgccccgtgtgccagaccagctaccagcccggcaacctgagacccaacagacacctggccaacatcgtgagaagactgagagaggtggtgctgggccccggcaagcagctgaaggccgtgctgtgcgccgaccacggcgagaagctgcagctgttctgccaggaggacggcaaggtgatctgctggctgtgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggtggacgtgaccctgaacccccacaccgccaacctgaacctggtgctggccaagaacagaagacaggtgagattcgtgggcgccaaggtgagcggccccagctgcctggagaagcactacgactgcagcgtgctgggcagccagcacttcagcagcggcaagcactactgggaggtggacgtggccaagaagaccgcctggatcctgggcgtgtgcagcaacagcctgggccccaccttcagcttcaaccacttcgcccagaaccacagcgcctacagcagataccagccccagagcggctactgggtgatcggcctgcagcacaaccacgagtacagagcctacgaggacagcagccccagcctgctgctgagcatgaccgtgccccccagaagagtgggcgtgttcctggactacgaggccggcaccgtgagcttctacaacgtgaccaaccacggcttccccatctacaccttcagcaagtactacttccccaccaccctgtgcccctacttcaacccctgcaactgcgtgatccccatgaccctgagaagacccagcagctag

SEQ ID NO: 103596 - DNA, 1551 bp, Artificial Sequence
  Description of Artificial Sequence: Synthetic coding sequence
atgtgcggcagcgagagaatcctgcaggccggcaacatcctggagatcagagtgggccaggccggcgccagaagagtggccaccatgaccagccccgtgctggtggacatcagagaggaggtgacctgccccatctgcctggagctgctgaccgagcccctgagcatcgactgcggccacagcttctgccaggcctgcatcacccccaacggcagagagagcgtgatcggccaggagggcgagagaagctgccccgtgtgccagaccagctaccagcccggcaacctgagacccaacagacacctggccaacatcgtgagaagactgagagaggtggtgctgggccccggcaagcagctgaaggccgtgctgtgcgccgaccacggcgagaagctgcagctgttctgccaggaggacggcaaggtgatctgctggctgtgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggtggacgtgaccctgaacccccacaccgccaacctgaacctggtgctggccaagaacagaagacaggtgagattcgtgggcgccaaggtgagcggccccagctgcctggagaagcactacgactgcagcgtgctgggcagccagcacttcagcagcggcaagcactactgggaggtggacgtggccaagaagaccgcctggatcctgggcgtgtgcagcaacagcctgggccccaccttcagcttcaaccacttcgcccagaaccacagcgcctacagcagataccagccccagagcggctactgggtgatcggcctgcagcacaaccacgagtacagagcctacgaggacagcagccccagcctgctgctgagcatgaccgtgccccccagaagagtgggcgtgttcctggactacgaggccggcaccgtgagcttctacaacgtgaccaaccacggcttccccatctacaccttcagcaagtactacttccccaccaccctgtgcccctacttcaacccctgcaactgcgtgatccccatgaccctgagaagacccagcagctag

SEQ ID NO: 103597 - DNA, 1389 bp, Artificial Sequence
  Description of Artificial Sequence: Synthetic coding sequence
atgaccagccccgtgctggtggacatcagagaggaggtgacctgccccatctgcctggagctgctgaccgagcccctgagcatcgactgcggccacagcttctgccaggcctgcatcacccccaacggcagagagagcgtgatcggccaggagggcgagagaagctgccccgtgtgccagaccagctaccagcccggcaacctgagacccaacagacacctggccaacatcgtgagaagactgagagaggaggacggcaaggtgatctgctggctgtgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggtggacgtgaccctgaacccccacaccgccaacctgaacctggtgctggccaagaacagaagacaggtgagattcgtgggcgccaaggtgagcggccccagctgcctggagaagcactacgactgcagcgtgctgggcagccagcacttcagcagcggcaagcactactgggaggtggacgtggccaagaagaccgcctggatcctgggcgtgtgcagcaacagcctgggccccaccttcagcttcaaccacttcgcccagaaccacagcgcctacagcagataccagccccagagcggctactgggtgatcggcctgcagcacaaccacgagtacagagcctacgaggacagcagccccagcctgctgctgagcatgaccgtgccccccagaagagtgggcgtgttcctggactacgaggccggcaccgtgagcttctacaacgtgaccaaccacggcttccccatctacaccttcagcaagtactacttccccaccaccctgtgcccctacttcaacccctgcaactgcgtgatccccatgaccctgagaagacccagcagctag

SEQ ID NO: 103598 - DNA, 1188 bp, Artificial Sequence
  Description of Artificial Sequence: Synthetic coding sequence
atgtgcggcagcgagagaccctggagaaagaccgccgccctgctgagcggcggctgggagggccacctgctggcctgcgagagaagccaggagcacagaggccaccacaccttcctggtggaggaggtggcccaggagtaccaggagaagttccaggagagcctgaagaagctgaagaacgaggagcaggaggccgagaagctgaccgccttcatcagagagaagaagaccagctggaagaaccagatggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggtggacgtgaccctgaacccccacaccgccaacctgaacctggtgctggccaagaacagaagacaggtgagattcgtgggcgccaaggtgagcggccccagctgcctggagaagcactacgactgcagcgtgctgggcagccagcacttcagcagcggcaagcactactgggaggtggacgtggccaagaagaccgcctggatcctgggcgtgtgcagcaacagcctgggccccaccttcagcttcaaccacttcgcccagaaccacagcgcctacagcagataccagccccagagcggctactgggtgatcggcctgcagcacaaccacgagtacagagcctacgaggacagcagccccagcctgctgctgagcatgaccgtgccccccagaagagtgggcgtgttcctggactacgaggccggcaccgtgagcttctacaacgtgaccaaccacggcttccccatctacaccttcagcaagtactacttccccaccaccctgtgcccctacttcaacccctgcaactgcgtgatccccatgaccctgagaagacccagcagctag

SEQ ID NO: 103599 - DNA, 942 bp, Artificial Sequence
  Description of Artificial Sequence: Synthetic coding sequence
atggagcccgagagatgcagaatccagaccgagttcaaccagctgagaaacatcctggacagagtggagcagagagagctgaagaagctggagcaggaggagaagaagggcctgagaatcatcgaggaggccgagaacgacctggtgcaccagacccagagcctgagagagctgatcagcgacctggagagaagatgccagggcagcaccatggagctgctgcaggacgtgagcgacgtgaccgagagaagcgagttctggaccctgagaaagcccgaggccctgcccaccaagctgagaagcatgttcagagcccccgacctgaagagaatgctgagagtgtgcagagagctgaccgacgtgcagagctactgggtggacgtgaccctgaacccccacaccgccaacctgaacctggtgctggccaagaacagaagacaggtgagattcgtgggcgccaaggtgagcggccccagctgcctggagaagcactacgactgcagcgtgctgggcagccagcacttcagcagcggcaagcactactgggaggtggacgtggccaagaagaccgcctggatcctgggcgtgtgcagcaacagcctgggccccaccttcagcttcaaccacttcgcccagaaccacagcgcctacagcagataccagccccagagcggctactgggtgatcggcctgcagcacaaccacgagtacagagcctacgaggacagcagccccagcctgctgctgagcatgaccgtgccccccagaagagtgggcgtgttcctggactacgaggccggcaccgtgagcttctacaacgtgaccaaccacggcttccccatctacaccttcagcaagtactacttccccaccaccctgtgcccctacttcaacccctgcaactgcgtgatccccatgaccctgagaagacccagcagctag

SEQ ID NO: 103600 - DNA, 942 bp, Artificial Sequence; identical to SEQ ID NO: 103599
  Description of Artificial Sequence: Synthetic coding sequence

SEQ ID NO: 103601 - DNA, 942 bp, Artificial Sequence; identical to SEQ ID NO: 103599
  Description of Artificial Sequence: Synthetic coding sequence

SEQ ID NO: 103602 - DNA, 942 bp, Artificial Sequence; identical to SEQ ID NO: 103599
  Description of Artificial Sequence: Synthetic coding sequence

SEQ ID NO: 103603 - DNA, 3651 bp, Artificial Sequence
  Description of Artificial Sequence: Synthetic coding sequence
atggccagaaactgcagcgagtgcaaggagaagagagccgcccacatcctgtgcacctactgcaacagatggctgtgcagcagctgcaccgaggagcacagacacagccccgtgcccggcggccccttcttccccagagcccagaagggcagccccggcgtgaacggcggccccggcgacttcaccctgtactgccccctgcacacccaggaggtgctgaagctgttctgcgagacctgcgacatgctgacctgccacagctgcctggtggtggagcacaaggagcacagatgcagacacgtggaggaggtgctgcagaaccagagaatgctgctggagggcgtgaccacccaggtggcccacaagaagagcagcctgcagaccagcgccaagcagatcgaggacagaatcttcgaggtgaagcaccagcacagaaaggtggagaaccagatcaagatggccaagatggtgctgatgaacgagctgaacaagcaggccaacggcctgatcgaggagctggagggcatcaccaacgagagaaagagaaagctggagcagcagctgcagagcatcatggtgctgaacagacagttcgagcacgtgcagaacttcatcaactgggccgtgtgcagcaagaccagcgtgcccttcctgttcagcaaggagctgatcgtgttccagatgcagagactgctggagaccagctgcaacaccgaccccggcagcccctggagcatcagattcacctgggagcccaacttctggaccaagcagctggccagcctgggctgcatcaccaccgagggcggccagatgagcagagccgacgcccccgcctacggcggcctgcagggcagcagccccttctaccagagccaccagagccccgtggcccagcaggaggccctgagccaccccagccacaagttccagagccccgccgtgtgcagcagcagcgtgtgctgcagccactgcagccccgtgagccccagcctgaagggccaggtgcccccccccagcatccaccccgcccacagcttcagacagccccccgagatggtgccccagcagctgggcagcctgcagtgcagcgccctgctgcccagagagaaggagctggcctgcagcccccacccccccaagctgctgcagccctggctggagacccagccccccgtggagcaggagagcaccagccagagactgggccagcagctgaccagccagcccgtgtgcatcgtgcccccccaggacgtgcagcagggcgcccacgcccagcccaccctgcagacccccagcatccaggtgcagttcggccaccaccagaagctgaagctgagccacttccagcagcagccccagcagcagctgccccccccccccccccccctgccccacccccccccccccctgcccccccccccccagcagccccacccccccctgccccccagccagcacctggccagcagccagcacgagagcccccccggccccgcctgcagccagaacatggacatcatgcaccacaagttcgagctggaggagatgcagaaggacctggagctgctgctgcaggcccagcagcccagcctgcagctgagccagaccaagagcccccagcacctgcagcagaccatcgtgggccagatcaactacatcgtgagacagcccgcccccgtgcagagccagagccaggaggagaccctgcaggccaccgacgagccccccgccagccagggcagcaagcccgccctgcccctggacaagaacaccgccgccgccctgccccaggccagcggcgaggagacccccctgagcgtgccccccgtggacagcaccatccagcacagcagccccaacgtggtgagaaagcacagcaccagcctgagcatcatgggcttcagcaacaccctggagatggagctgagcagcaccagactggagagacccctggagccccagatccagagcgtgagcaacctgaccgccggcgccccccaggccgtgcccagcctgctgagcgccccccccaagatggtgagcagcctgaccagcgtgcagaaccaggccatgcccagcctgaccaccagccacctgcagaccgtgcccagcctggtgcacagcaccttccagagcatgcccaacctgatcagcgacagcccccaggccatggccagcctggccagcgaccacccccaggccggccccagcctgatgagcggccacacccaggccgtgcccagcctggccacctgccccctgcagagcatcccccccgtgagcgacatgcagcccgagaccggcagcagcagcagcagcggcagaaccagcggcagcctgtgccccagagacggcgccgaccccagcctggagaacgccctgtgcaaggtgaagctggaggagcccatcaacctgagcgtgaagaagccccccctggcccccgtggtgagcaccagcaccgccctgcagcagtaccagaaccccaaggagtgcgagaacttcgagcagggcgccctggagctggacgccaaggagaaccagagcatcagagccttcaacagcgagcacaagatcccctacgtgagactggagagactgaagatctgcgccgccagcagcggcgagatgcccgtgttcaagctgaagccccagaagaacgaccaggacggcagcttcctgctgatcatcgagtgcggcaccgagagcagcagcatgagcatcaaggtgagccaggacagactgagcgaggccacccaggcccccggcctggagggcagaaaggtgaccgtgaccagcctggccggccagagaccccccgaggtggagggcaccagccccgaggagcacagactgatccccagaacccccggcgccaagaagggcccccccgcccccatcgagaacgaggacttctgcgccgtgtgcctgaacggcggcgagctgctgtgctgcgacagatgccccaaggtgttccacctgagctgccacgtgcccgccctgctgagcttccccggcggcgagtgggtgtgcaccctgtgcagaagcctgacccagcccgagatggagtacgactgcgagaacgcctgctacaaccagcccggcatgagagccagccccggcctgagcatgtacgaccagaagaagtgcgagaagctggtgctgagcctgtgctgcaacaacctgagcctgcccttccacgagcccgtgagccccctggccagacactactaccagatcatcaagagacccatggacctgagcatcatcagaagaaagctgcagaagaaggaccccgcccactacaccacccccgaggaggtggtgagcgacgtgagactgatgttctggaactgcgccaagttcaactaccccgacagcgaggtggccgaggccggcagatgcctggaggtgttcttcgagggctggctgaaggagatctaccccgagaagagattcgcccagcccagacaggaggacagcgacagcgaggaggtgagcagcgagagcggctgcagcaccccccagggcttcccctggcccccctacatgcaggagggcatccagcccaagagaagaagaagacacatggagaacgagagagccaagagaatgagcttcagactggccaacagcatcagccaggtgtag

SEQ ID NO: 103604 - DNA, 1458 bp, Artificial Sequence
  Description of Artificial Sequence: Synthetic coding sequence
atggaccccaccgccctggtggaggccatcgtggaggaggtggcctgccccatctgcatgaccttcctgagagagcccatgagcatcgactgcggccacagcttctgccacagctgcctgagcggcctgtgggagatccccggcgagagccagaactggggctacacctgccccctgtgcagagcccccgtgcagcccagaaacctgagacccaactggcagctggccaacgtggtggagaaggtgagactgctgagactgcaccccggcatgggcctgaagggcgacctgtgcgagagacacggcgagaagctgaagatgttctgcaaggaggacgtgctgatcatgtgcgaggcctgcagccagagccccgagcacgaggcccacagcgtggtgcccatggaggacgtggcctgggagtacaagtgggagctgcacgaggccctggagcacctgaagaaggagcaggaggaggcctggaagctggaggtgggcgagagaaagagaaccgccacctggaagatccaggtggagaccagaaagcagagcatcgtgtgggagttcgagaagtaccagagactgctggagaagaagcagcccccccacagacagctgggcgccgaggtggccgccgccctggccagcctgcagagagaggccgccgagaccatgcagaagctggagctgaaccacagcgagctgatccagcagagccaggtgctgtggagaatgatcgccgagctgaaggagagaagccagagacccgtgagatggatgctgcaggacatccaggaggtgctgaacagaagcaagagctggagcctgcagcagcccgagcccatcagcctggagctgaagaccgactgcagagtgctgggcctgagagagatcctgaagacctacgccgccgacgtgagactggaccccgacaccgcctacagcagactgatcgtgagcgaggacagaaagagagtgcactacggcgacaccaaccagaagctgcccgacaaccccgagagattctacagatacaacatcgtgctgggcagccagtgcatcagcagcggcagacactactgggaggtggaggtgggcgacagaagcgagtggggcctgggcgtgtgcaagcagaacgtggacagaaaggaggtggtgtacctgagcccccactacggcttctgggtgatcagactgagaaagggcaacgagtacagagccggcaccgacgagtaccccatcctgagcctgcccgtgccccccagaagagtgggcatcttcgtggactacgaggcccacgacatcagcttctacaacgtgaccgactgcggcagccacatcttcaccttccccagataccccttccccggcagactgctgccctacttcagcccctgctacagcatcggcaccaacaacaccgcccccctggccatctgcagcctggacggcgaggactag

SEQ ID NO: 103605 - DNA, 621 bp, Artificial Sequence
  Description of Artificial Sequence: Synthetic coding sequence
atgcagaagctggagctgaagaccgactgcagagtgctgggcctgagagagatcctgaagacctacgccgccgacgtgagactggaccccgacaccgcctacagcagactgatcgtgagcgaggacagaaagagagtgcactacggcgacaccaaccagaagctgcccgacaaccccgagagattctacagatacaacatcgtgctgggcagccagtgcatcagcagcggcagacactactgggaggtggaggtgggcgacagaagcgagtggggcctgggcgtgtgcaagcagaacgtggacagaaaggaggtggtgtacctgagcccccactacggcttctgggtgatcagactgagaaagggcaacgagtacagagccggcaccgacgagtaccccatcctgagcctgcccgtgccccccagaagagtgggcatcttcgtggactacgaggcccacgacatcagcttctacaacgtgaccgactgcggcagccacatcttcaccttccccagataccccttccccggcagactgctgccctacttcagcccctgctacagcatcggcaccaacaacaccgcccccctggccatctgcagcctggacggcgaggactag

SEQ ID NO: 103606 - DNA, 1536 bp, Artificial Sequence
  Description of Artificial Sequence: Synthetic coding sequence
atggccgccgtgggccccagaaccggccccggcaccggcgccgaggccctggccctggccgccgagctgcagggcgaggccacctgcagcatctgcctggagctgttcagagagcccgtgagcgtggagtgcggccacagcttctgcagagcctgcatcggcagatgctgggagagacccggcgccggcagcgtgggcgccgccaccagagccccccccttccccctgccctgcccccagtgcagagagcccgccagacccagccagctgagacccaacagacagctggccgccgtggccaccctgctgagaagattcagcctgcccgccgccgcccccggcgagcacggcagccaggccgccgccgccagagccgccgccgccagatgcggccagcacggcgagcccttcaagctgtactgccaggacgacggcagagccatctgcgtggtgtgcgacagagccagagagcacagagagcacgccgtgctgcccctggacgaggccgtgcaggaggccaaggagctgctggagagcagactgagagtgctgaagaaggagctggaggactgcgaggtgttcagaagcaccgagaagaaggagagcaaggagctgctgaagcagatggccgccgagcaggagaaggtgggcgccgagttccaggccctgagagccttcctggtggagcaggagggcagactgctgggcagactggaggagctgagcagagaggtggcccagaagcagaacgagaacctggcccagctgggcgtggagatcacccagctgagcaagctgagcagccagatccaggagaccgcccagaagcccgacctggacttcctgcaggagttcaagagcaccctgagcagatgcagcaacgtgcccggccccaagcccaccaccgtgagcagcgagatgaagaacaaggtgtggaacgtgagcctgaagaccttcgtgctgaagggcatgctgaagaagttcaaggaggacctgagaggcgagctggagaaggaggagaaggtggagctgaccctggaccccgacaccgccaaccccagactgatcctgagcctggacctgaagggcgtgagactgggcgagagagcccaggacctgcccaaccacccctgcagattcgacaccaacaccagagtgctggccagctgcggcttcagcagcggcagacaccactgggaggtggaggtgggcagcaaggacggctgggccttcggcgtggccagagagagcgtgagaagaaagggcctgacccccttcacccccgaggagggcgtgtgggccctgcagctgaacggcggccagtactgggccgtgaccagccccgagagaagccccctgagctgcggccacctgagcagagtgagagtggccctggacctggaggtgggcgccgtgagcttctacgccgtggaggacatgagacacctgtacaccttcagagtgaacttccaggagagagtgttccccctgttcagcgtgtgcagcaccggcacctacctgagaatctggccctag

SEQ ID NO: 103607 - DNA, 666 bp, Artificial Sequence
  Description of Artificial Sequence: Synthetic coding sequence
atggccgccgtgggccccagaaccggccccggcaccggcgccgaggccctggccctggccgccgagctgcagggcgaggccacctgcagcatctgcctggagctgttcagagagcccgtgagcgtggagtgcggccacagcttctgcagagcctgcatcggcagatgctgggagagacccggcgccggcagcgtgggcgccgccaccagagccccccccttccccctgccctgcccccagtgcagagagcccgccagacccagccagctgagacccaacagacagctggccgccgtggccaccctgctgagaagattcagcctgcccgccgccgcccccggcgagcacggcagccaggccgccgccgccagagccgccgccgccagatgcggccagcacggcgagcccttcaagctgtactgccaggacgacggcagagccatctgcgtggtgtgcgacagagccagagagcacagagagcacgccgtgctgcccctggacgaggccgtgcaggaggccaaggagctgctggagagcagactgagagtgctgaagaaggagctggaggactgcgaggtgttcagaagcaccgagaagaaggagagcaaggagctgctggtgagccaggcccccgccggccccccctgggacatcaccgaggcctag

SEQ ID NO: 103608 - DNA, 912 bp, Artificial Sequence
  Description of Artificial Sequence: Synthetic coding sequence
atggccgccgagcaggagaaggtgggcgccgagttccaggccctgagagccttcctggtggagcaggagggcagactgctgggcagactggaggagctgagcagagaggtggcccagaagcagaacgagaacctggcccagctgggcgtggagatcacccagctgagcaagctgagcagccagatccaggagaccgcccagaagcccgacctggacttcctgcaggagttcaagagcaccctgagcagatgcagcaacgtgcccggccccaagcccaccaccgtgagcagcgagatgaagaacaaggtgtggaacgtgagcctgaagaccttcgtgctgaagggcatgctgaagaagttcaaggaggacctgagaggcgagctggagaaggaggagaaggtggagctgaccctggaccccgacaccgccaaccccagactgatcctgagcctggacctgaagggcgtgagactgggcgagagagcccaggacctgcccaaccacccctgcagattcgacaccaacaccagagtgctggccagctgcggcttcagcagcggcagacaccactgggaggtggaggtgggcagcaaggacggctgggccttcggcgtggccagagagagcgtgagaagaaagggcctgacccccttcacccccgaggagggcgtgtgggccctgcagctgaacggcggccagtactgggccgtgaccagccccgagagaagccccctgagctgcggccacctgagcagagtgagagtggccctggacctggaggtgggcgccgtgagcttctacgccgtggaggacatgagacacctgtacaccttcagagtgaacttccaggagagagtgttccccctgttcagcgtgtgcagcaccggcacctacctgagaatctggccctag

SEQ ID NO: 103609 - DNA, 912 bp, Artificial Sequence; identical to SEQ ID NO: 103608
  Description of Artificial Sequence: Synthetic coding sequence

SEQ ID NO: 103610 - DNA, 990 bp, Artificial Sequence
  Description of Artificial Sequence: Synthetic coding sequence
atgacccaggccaccggccagatgctgtgcctgcacgtgcaggtgcccctgcagctgctgctgctgggccagaagcagatggccgccgagcaggagaaggtgggcgccgagttccaggccctgagagccttcctggtggagcaggagggcagactgctgggcagactggaggagctgagcagagaggtggcccagaagcagaacgagaacctggcccagctgggcgtggagatcacccagctgagcaagctgagcagccagatccaggagaccgcccagaagcccgacctggacttcctgcaggagttcaagagcaccctgagcagatgcagcaacgtgcccggccccaagcccaccaccgtgagcagcgagatgaagaacaaggtgtggaacgtgagcctgaagaccttcgtgctgaagggcatgctgaagaagttcaaggaggacctgagaggcgagctggagaaggaggagaaggtggagctgaccctggaccccgacaccgccaaccccagactgatcctgagcctggacctgaagggcgtgagactgggcgagagagcccaggacctgcccaaccacccctgcagattcgacaccaacaccagagtgctggccagctgcggcttcagcagcggcagacaccactgggaggtggaggtgggcagcaaggacggctgggccttcggcgtggccagagagagcgtgagaagaaagggcctgacccccttcacccccgaggagggcgtgtgggccctgcagctgaacggcggccagtactgggccgtgaccagccccgagagaagccccctgagctgcggccacctgagcagagtgagagtggccctggacctggaggtgggcgccgtgagcttctacgccgtggaggacatgagacacctgtacaccttcagagtgaacttccaggagagagtgttccccctgttcagcgtgtgcagcaccggcacctacctgagaatctggccctag

SEQ ID NO: 103611 - DNA, 912 bp, Artificial Sequence; identical to SEQ ID NO: 103608
  Description of Artificial Sequence: Synthetic coding sequence

SEQ ID NO: 103612 - DNA, 1434 bp, Artificial Sequence
  Description of Artificial Sequence: Synthetic coding sequence
atgagcgccgcccccggcctgctgcaccaggagctgagctgccccctgtgcctgcagctgttcgacgcccccgtgaccgccgagtgcggccacagcttctgcagagcctgcctgggcagagtggccggcgagcccgccgccgacggcaccgtgctgtgcccctgctgccaggcccccaccagaccccaggccctgagcaccaacctgcagctggccagactggtggagggcctggcccaggtgccccagggccactgcgaggagcacctggaccccctgagcatctactgcgagcaggacagagccctggtgtgcggcgtgtgcgccagcctgggcagccacagaggccacagactgctgcccgccgccgaggcccacgccagactgaagacccagctgccccagcagaagctgcagctgcaggaggcctgcatgagaaaggagaagagcgtggccgtgctggagcaccagctggtggaggtggaggagaccgtgagacagttcagaggcgccgtgggcgagcagctgggcaagatgagagtgttcctggccgccctggagggcagcctggacagagaggccgagagagtgagaggcgaggccggcgtggccctgagaagagagctgggcagcctgaacagctacctggagcagctgagacagatggagaaggtgctggaggaggtggccgacaagccccagaccgagttcctgatgaagtactgcctggtgaccagcagactgcagaagatcctggccgagagccccccccccgccagactggacatccagctgcccatcatcagcgacgacttcaagttccaggtgtggagaaagatgttcagagccctgatgcccgccctggaggagctgaccttcgaccccagcagcgcccaccccagcctggtggtgagcagcagcggcagaagagtggagtgcagcgagcagaaggccccccccgccggcgaggaccccagacagttcgacaaggccgtggccgtggtggcccaccagcagctgagcgagggcgagcactactgggaggtggacgtgggcgacaagcccagatgggccctgggcgtgatcgccgccgaggcccccagaagaggcagactgcacgccgtgcccagccagggcctgtggctgctgggcctgagagagggcaagatcctggaggcccacgtggaggccaaggagcccagagccctgagaagccccgagagaagacccaccagaatcggcctgtacctgagcttcggcgacggcgtgctgagcttctacgacgccagcgacgccgacgccctggtgcccctgttcgccttccacgagagactgcccagacccgtgtaccccttcttcgacgtgtgctggcacgacaagggcaagaacgcccagcccctgctgctggtgggccccgagggcgccgaggcctag

SEQ ID NO: 103613 - DNA, 753 bp, Artificial Sequence
  Description of Artificial Sequence: Synthetic coding sequence
atggcctggcaggtgagcctgctggagctggaggacagactgcagtgccccatctgcctggaggtgttcaaggagagcctgatgctgcagtgcggccacagctactgcaagggctgcctggtgagcctgagctaccacctggacaccaaggtgagatgccccatgtgctggcaggtggtggacggcagcagcagcctgcccaacgtgagcctggcctgggtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtgcagcagaatgaaggaggagctggccgccctgttcagcgagctgaagcaggagcagaagaaggtggacgagctgatcgccaagctggtgaagaacagaaccagaatcgtgaacgagagcgacgtgttcagctgggtgatcagaagagagttccaggagctgagacaccccgtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacgagttcatctggaagttccacagcatggccagcagatag

SEQ ID NO: 103614 - DNA, 849 bp, Artificial Sequence
  Description of Artificial Sequence: Synthetic coding sequence
atggcctggcaggtgagcctgctggagctggaggacagactgcagtgccccatctgcctggaggtgttcaaggagagcctgatgctgcagtgcggccacagctactgcaagggctgcctggtgagcctgagctaccacctggacaccaaggtgagatgccccatgtgctggcaggtggtggacggcagcagcagcctgcccaacgtgagcctggcctgggtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtgcagcagaatgaaggaggagctggccgccctgttcagcgagctgaagcaggagcagaagaaggtggacgagctgatcgccaagctggtgaagaacagaaccagaatcgtgaacgagagcgacgtgttcagctgggtgatcagaagagagttccaggagctgagacaccccgtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacgagttcatctggaagttccacagcatggccagcagactgaccaagaccgaggagctggagaagaagtggagaaacggcctggccgccagccacagcctgccccagcaggtgagaccccagagaagaaccccctag

SEQ ID NO: 103615 - DNA, 753 bp, Artificial Sequence; identical to SEQ ID NO: 103613
  Description of Artificial Sequence: Synthetic coding sequence

SEQ ID NO: 103616 - DNA, 750 bp, Artificial Sequence
  Description of Artificial Sequence: Synthetic coding sequence
atggcctggcaggtgagcctgctggagctggaggacagactgcagtgccccatctgcctggaggtgttcaaggagagcctgatgctgcagtgcggccacagctactgcaagggctgcctggtgagcctgagctaccacctggacaccaaggtgagatgccccatgtgctggcaggtggtggacggcagcagcagcctgcccaacgtgagcctggcctgggtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtgcagcagaatgaaggaggagctggccgccctgttcagcgagctgaagcaggagcagaagaaggtggacgagctgatcgccaagctggtgaagaacagaaccagaatcgtgaacgagagcgacgtgttcagctgggtgatcagaagagagttccaggagctgagacaccccgtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacgagttcatctggttccacagcatggccagcagatag

SEQ ID NO: 103617 - DNA, 753 bp, Artificial Sequence
  Description of Artificial Sequence: Synthetic coding sequence
atggcctggcaggtgagcctgctggagctggaggactggctgcagtgccccatctgcctggaggtgttcaaggagagcctgatgctgcagtgcggccacagctactgcaagggctgcctggtgagcctgagctaccacctggacaccaaggtgagatgccccatgtgctggcaggtggtggacggcagcagcagcctgcccaacgtgagcctggcctgggtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtgcagcagaatgaaggaggagctggccgccctgttcagcgagctgaagcaggagcagaagaaggtggacgagctgatcgccaagctggtgaagaacagaaccagaatcgtgaacgagagcgacgtgttcagctgggtgatcagaagagagttccaggagctgagacaccccgtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacgagttcatctggaagttccacagcatggccagcagatag

SEQ ID NO: 103618 - DNA, 750 bp, Artificial Sequence
  Description of Artificial Sequence: Synthetic coding sequence
atggcctggcaggtgagcctgctggagctggaggactggctgcagtgccccatctgcctggaggtgttcaaggagagcctgatgctgcagtgcggccacagctactgcaagggctgcctggtgagcctgagctaccacctggacaccaaggtgagatgccccatgtgctggcaggtggtggacggcagcagcagcctgcccaacgtgagcctggcctgggtgatcgaggccctgagactgcccggcgaccccgagcccaaggtgtgcgtgcaccacagaaaccccctgagcctgttctgcgagaaggaccaggagctgatctgcggcctgtgcggcctgctgggcagccaccagcaccaccccgtgacccccgtgagcaccgtgtgcagcagaatgaaggaggagctggccgccctgttcagcgagctgaagcaggagcagaagaaggtggacgagctgatcgccaagctggtgaagaacagaaccagaatcgtgaacgagagcgacgtgttcagctgggtgatcagaagagagttccaggagctgagacaccccgtggacgaggagaaggccagatgcctggagggcatcggcggccacaccagaggcctggtggccagcctggacatgcagctggagcaggcccagggcaccagagagagactggcccaggccgagtgcgtgctggagcagttcggcaacgaggaccaccacgagttcatctggttccacagcatggccagcagatag

SEQ ID NO: 103619 - DNA, 1656 bp, Artificial Sequence
  Description of Artificial Sequence: Synthetic coding sequence
atggccgagaactggaagaactgcttcgaggaggagctgatctgccccatctgcctgcacgtgttcgtggagcccgtgcagctgccctgcaagcacaacttctgcagaggctgcatcggcgaggcctgggccaaggacagcggcctggtgagatgccccgagtgcaaccaggcctacaaccagaagcccggcctggagaagaacctgaagctgaccaacatcgtggagaagttcaacgccctgcacgtggagaagccccccgccgccctgcactgcgtgttctgcagaagaggcccccccctgcccgcccagaaggtgtgcctgagatgcgaggccccctgctgccagagccacgtgcagacccacctgcagcagcccagcaccgccagaggccacctgctggtggaggccgacgacgtgagagcctggagctgcccccagcacaacgcctacagactgtaccactgcgaggccgagcaggtggccgtgtgccagtactgctgctactacagcggcgcccaccagggccacagcgtgtgcgacgtggagatcagaagaaacgagatcagaaagatgctgatgaagcagcaggacagactggaggagagagagcaggacatcgaggaccagctgtacaagctggagagcgacaagagactggtggaggagaaggtgaaccagctgaaggaggaggtgagactgcagtacgagaagctgcaccagctgctggacgaggacctgagacagaccgtggaggtgctggacaaggcccaggccaagttctgcagcgagaacgccgcccaggccctgcacctgggcgagagaatgcaggaggccaagaagctgctgggcagcctgcagctgctgttcgacaagaccgaggacgtgagcttcatgaagaacaccaagagcgtgaagatcctgatggacagaacccagacctgcaccagcagcagcctgagccccaccaagatcggccacctgaacagcaagctgttcctgaacgaggtggccaagaaggagaagcagctgagaaagatgctggagggccccttcagcacccccgtgcccttcctgcagagcgtgcccctgtacccctgcggcgtgagcagcagcggcgccgagaagagaaagcacagcaccgccttccccgaggccagcttcctggagaccagcagcggccccgtgggcggccagtacggcgccgccggcaccgccagcggcgagggccagagcggccagcccctgggcccctgcagcagcacccagcacctggtggccctgcccggcggcgcccagcccgtgcacagcagccccgtgttcccccccagccagtaccccaacggcagcgccgcccagcagcccatgctgccccagtacggcggcagaaagatcctggtgtgcagcgtggacaactgctactgcagcagcgtggccaaccacggcggccaccagccctaccccagaagcggccacttcccctggaccgtgcccagccaggagtacagccaccccctgccccccacccccagcgtgccccagagcctgcccagcctggccgtgagagactggctggacgccagccagcagcccggccaccaggacttctacagagtgtacggccagcccagcaccaagcactacgtgaccagctag

SEQ ID NO: 103620 - DNA, 1653 bp, Artificial Sequence
  Description of Artificial Sequence: Synthetic coding sequence
atggccgagaactggaagaactgcttcgaggaggagctgatctgccccatctgcctgcacgtgttcgtggagcccgtgcagctgccctgcaagcacaacttctgcagaggctgcatcggcgaggcctgggccaaggacagcggcctggtgagatgccccgagtgcaaccaggcctacaaccagaagcccggcctggagaagaacctgaagctgaccaacatcgtggagaagttcaacgccctgcacgtggagaagccccccgccgccctgcactgcgtgttctgcagaagaggcccccccctgcccgcccagaaggtgtgcctgagatgcgaggccccctgctgccagagccacgtgcagacccacctgcagcagcccagcaccgccagaggccacctgctggtggaggccgacgacgtgagagcctggagctgcccccagcacaacgcctacagactgtaccactgcgaggccgagcaggtggccgtgtgccagtactgctgctactacagcggcgcccaccagggccacagcgtgtgcgacgtggagatcagaagaaacgagatcagaatgctgatgaagcagcaggacagactggaggagagagagcaggacatcgaggaccagctgtacaagctggagagcgacaagagactggtggaggagaaggtgaaccagctgaaggaggaggtgagactgcagtacgagaagctgcaccagctgctggacgaggacctgagacagaccgtggaggtgctggacaaggcccaggccaagttctgcagcgagaacgccgcccaggccctgcacctgggcgagagaatgcaggaggccaagaagctgctgggcagcctgcagctgctgttcgacaagaccgaggacgtgagcttcatgaagaacaccaagagcgtgaagatcctgatggacagaacccagacctgcaccagcagcagcctgagccccaccaagatcggccacctgaacagcaagctgttcctgaacgaggtggccaagaaggagaagcagctgagaaagatgctggagggccccttcagcacccccgtgcccttcctgcagagcgtgcccctgtacccctgcggcgtgagcagcagcggcgccgagaagagaaagcacagcaccgccttccccgaggccagcttcctggagaccagcagcggccccgtgggcggccagtacggcgccgccggcaccgccagcggcgagggccagagcggccagcccctgggcccctgcagcagcacccagcacctggtggccctgcccggcggcgcccagcccgtgcacagcagccccgtgttcccccccagccagtaccccaacggcagcgccgcccagcagcccatgctgccccagtacggcggcagaaagatcctggtgtgcagcgtggacaactgctactgcagcagcgtggccaaccacggcggccaccagccctaccccagaagcggccacttcccctggaccgtgcccagccaggagtacagccaccccctgccccccacccccagcgtgccccagagcctgcccagcctggccgtgagagactggctggacgccagccagcagcccggccaccaggacttctacagagtgtacggccagcccagcaccaagcactacgtgaccagctag

SEQ ID NO: 103621 - DNA, 2133 bp, Artificial Sequence
  Description of Artificial Sequence: Synthetic coding sequence
atggaggagatggaggaggagctgaagtgccccgtgtgcggcagcttctacagagagcccatcatcctgccctgcagccacaacctgtgccaggcctgcgccagaaacatcctggtgcagacccccgagagcgagagcccccagagccacagagccgccggcagcggcgtgagcgactacgactacctggacctggacaagatgagcctgtacagcgaggccgacagcggctacggcagctacggcggcttcgccagcgcccccaccaccccctgccagaagagccccaacggcgtgagagtgttcccccccgccatgcccccccccgccacccacctgagccccgccctggcccccgtgcccagaaacagctgcatcacctgcccccagtgccacagaagcctgatcctggacgacagaggcctgagaggcttccccaagaacagagtgctggagggcgtgatcgacagataccagcagagcaaggccgccgccctgaagtgccagctgtgcgagaaggcccccaaggaggccaccgtgatgtgcgagcagtgcgacgtgttctactgcgacccctgcagactgagatgccacccccccagaggccccctggccaagcacagactggtgccccccgcccagggcagagtgagcagaagactgagccccagaaaggtgagcacctgcaccgaccacgagctggagaaccacagcatgtactgcgtgcagtgcaagatgcccgtgtgctaccagtgcctggaggagggcaagcacagcagccacgaggtgaaggccctgggcgccatgtggaagctgcacaagagccagctgagccaggccctgaacggcctgagcgacagagccaaggaggccaaggagttcctggtgcagctgagaaacatggtgcagcagatccaggagaacagcgtggagttcgaggcctgcctggtggcccagtgcgacgccctgatcgacgccctgaacagaagaaaggcccagctgctggccagagtgaacaaggagcacgagcacaagctgaaggtggtgagagaccagatcagccactgcaccgtgaagctgagacagaccaccggcctgatggagtactgcctggaggtgatcaaggagaacgaccccagcggcttcctgcagatcagcgacgccctgatcagaagagtgcacctgaccgaggaccagtggggcaagggcaccctgacccccagaatgaccaccgacttcgacctgagcctggacaacagccccctgctgcagagcatccaccagctggacttcgtgcaggtgaaggccagcagccccgtgcccgccacccccatcctgcagctggaggagtgctgcacccacaacaacagcgccaccctgagctggaagcagccccccctgagcaccgtgcccgccgacggctacatcctggagctggacgacggcaacggcggccagttcagagaggtgtacgtgggcaaggagaccatgtgcaccgtggacggcctgcacttcaacagcacctacaacgccagagtgaaggccttcaacaagaccggcgtgagcccctacagcaagaccctggtgctgcagaccagcgaggtggcctggttcgccttcgaccccggcagcgcccacagcgacatcatcctgagcaacgacaacctgaccgtgacctgcagcagctacgacgacagagtggtgctgggcaagaccggcttcagcaagggcatccactactgggagctgaccgtggacagatacgacaaccaccccgaccccgccttcggcgtggccagaatggacgtgatgaaggacgtgatgctgggcaaggacgacaaggcctgggccatgtacgtggacaacaacagaagctggttcatgcacaacaacagccacaccaacagaaccgagggcggcatcaccaagggcgccaccatcggcgtgctgctggacctgaacagaaagaacctgaccttcttcatcaacgacgagcagcagggccccatcgccttcgacaacgtggagggcctgttcttccccgccgtgagcctgaacagaaacgtgcaggtgaccctgcacaccggcctgcccgtgcccgacttctacagcagcagagccagcatcgcctag

SEQ ID NO: 103622 - DNA, 2409 bp, Artificial Sequence
  Description of Artificial Sequence: Synthetic coding sequence
atggaggagatggaggaggagctgaagtgccccgtgtgcggcagcttctacagagagcccatcatcctgccctgcagccacaacctgtgccaggcctgcgccagaaacatcctggtgcagacccccgagagcgagagcccccagagccacagagccgccggcagcggcgtgagcgactacgactacctggacctggacaagatgagcctgtacagcgaggccgacagcggctacggcagctacggcggcttcgccagcgcccccaccaccccctgccagaagagccccaacggcgtgagagtgttcccccccgccatgcccccccccgccacccacctgagccccgccctggcccccgtgcccagaaacagctgcatcacctgcccccagtgccacagaagcctgatcctggacgacagaggcctgagaggcttccccaagaacagagtgctggagggcgtgatcgacagataccagcagagcaaggccgccgccctgaagtgccagctgtgcgagaaggcccccaaggaggccaccgtgatgtgcgagcagtgcgacgtgttctactgcgacccctgcagactgagatgccacccccccagaggccccctggccaagcacagactggtgccccccgcccagggcagagtgagcagaagactgagccccagaaaggtgagcacctgcaccgaccacgagctggagaaccacagcatgtactgcgtgcagtgcaagatgcccgtgtgctaccagtgcctggaggagggcaagcacagcagccacgaggtgaaggccctgggcgccatgtggaagctgcacaagagccagctgagccaggccctgaacggcctgagcgacagagccaaggaggccaaggagttcctggtgcagctgagaaacatggtgcagcagatccaggagaacagcgtggagttcgaggcctgcctggtggcccagtgcgacgccctgatcgacgccctgaacagaagaaaggcccagctgctggccagagtgaacaaggagcacgagcacaagctgaaggtggtgagagaccagatcagccactgcaccgtgaagctgagacagaccaccggcctgatggagtactgcctggaggtgatcaaggagaacgaccccagcggcttcctgcagatcagcgacgccctgatcagaagagtgcacctgaccgaggaccagtggggcaagggcaccctgacccccagaatgaccaccgacttcgacctgagcctggacaacagccccctgctgcagagcatccaccagctggacttcgtgcaggtgaaggtgcccgccacccccatcctgcagctggaggagtgctgcacccacaacaacagcgccaccctgagctggaagcagccccccctgagcaccgtgcccgccgacggctacatcctggagctggacgacggcaacggcggccagttcagagaggtgtacgtgggcaaggagaccatgtgcaccgtggacggcctgcacttcaacagcacctacaacgccagagtgaaggccttcaacaagaccggcgtgagcccctacagcaagaccctggtgctgcagaccagcgaggacaccgacagcgaggagcagaccctgcccttccccgtgcccagcgagagactgcccctgagaagaatgagccccttcagcagcaccctgaacctgcagcccagcttccccggcagaagctacttcgacttcagaagcagcccccaccagctgagcctgcacagcagcctgcagagcctgaacgcccccggctgcaacttcgagacccagagcgccccctacagccagctggtggacatcaagaagctgctggccgtggcctggttcgccttcgaccccggcagcgcccacagcgacatcatcctgagcaacgacaacctgaccgtgacctgcagcagctacgacgacagagtggtgctgggcaagaccggcttcagcaagggcatccactactgggagctgaccgtggacagatacgacaaccaccccgaccccgccttcggcgtggccagaatggacgtgatgaaggacgtgatgctgggcaaggacgacaaggcctgggccatgtacgtggacaacaacagaagctggttcatgcacaacaacagccacaccaacagaaccgagggcggcatcaccaagggcgccaccatcggcgtgctgctggacctgaacagaaagaacctgaccttcttcatcaacgacgagcagcagggccccatcgccttcgacaacgtggagggcctgttcttccccgccgtgagcctgaacagaaacgtgcaggtgagcaccctgcccctgagactgaacagctgctgctggctgcccgtgcagagactgcccagagccgtgcagagcaacagaagagagggcagctag

SEQ ID NO: 103623 - DNA, 1653 bp, Artificial Sequence
  Description of Artificial Sequence: Synthetic coding sequence
atggaggagatggaggaggagctgaagtgccccgtgtgcggcagcttctacagagagcccatcatcctgccctgcagccacaacctgtgccaggcctgcgccagaaacatcctggtgcagacccccgagagcgagagcccccagagccacagagccgccggcagcggcgtgagcgactacgactacctggacctggacaagatgagcctgtacagcgaggccgacagcggctacggcagctacggcggcttcgccagcgcccccaccaccccctgccagaagagccccaacggcgtgagagtgttcccccccgccatgcccccccccgccacccacctgagccccgccctggcccccgtgcccagaaacagctgcatcacctgcccccagtgccacagaagcctgatcctggacgacagaggcctgagaggcttccccaagaacagagtgctggagggcgtgatcgacagataccagcagagcaaggccgccgccctgaagtgccagctgtgcgagaaggcccccaaggaggccaccgtgatgtgcgagcagtgcgacgtgttctactgcgacccctgcagactgagatgccacccccccagaggccccctggccaagcacagactggtgccccccgcccagggcagagtgagcagaagactgagccccagaaaggtgagcacctgcaccgaccacgagctggagaaccacagcatgtactgcgtgcagtgcaagatgcccgtgtgctaccagtgcctggaggagggcaagcacagcagccacgaggtgaaggccctgggcgccatgtggaagctgcacaagagccagctgagccaggccctgaacggcctgagcgacagagccaaggaggccaaggagttcctggtgcagctgagaaacatggtgcagcagatccaggagaacagcgtggagttcgaggcctgcctggtggcccagtgcgacgccctgatcgacgccctgaacagaagaaaggcccagctgctggccagagtgaacaaggagcacgagcacaagctgaaggtggtgagagaccagatcagccactgcaccgtgaagctgagacagaccaccggcctgatggagtactgcctggaggtgatcaaggagaacgaccccagcggcttcctgcagatcagcgacgccctgatcagaagagtgcacctgaccgaggaccagtggggcaagggcaccctgacccccagaatgaccaccgacttcgacctgagcctggacaacagccccctgctgcagagcatccaccagctggacttcgtgcaggtgaaggccagcagccccgtgcccgccacccccatcctgcagctggaggagtgctgcacccacaacaacagcgccaccctgagctggaagcagccccccctgagcaccgtgcccgccgacggctacatcctggagctggacgacggcaacggcggccagttcagagaggtgtacgtgggcaaggagaccatgtgcaccgtggacggcctgcacttcaacagcacctacaacgccagagtgaaggccttcaacaagaccggcgtgagcccctacagcaagaccctggtgctgcagaccagcgagggcaaggccctgcagcagtaccccagcgagagagagctgagaggcatctag

SEQ ID NO: 103624 - DNA, 3750 bp, Artificial Sequence
  Description of Artificial Sequence: Synthetic coding sequence
atggccaccgccgccaccgaggagcccttccccttccacggcctgctgcccaagaaggagaccggcgccgccagcttcctgtgcagataccccgagtacgacggcagaggcgtgctgatcgccgtgctggacaccggcgtggaccccggcgcccccggcatgcaggtgaccaccgacggcaagcccaagatcgtggacatcatcgacaccaccggcagcggcgacgtgaacaccgccaccgaggtggagcccaaggacggcgagatcgtgggcctgagcggcagagtgctgaagatccccgccagctggaccaaccccagcggcaagtaccacatcggcatcaagaacggctacgacttctaccccaaggccctgaaggagagaatccagaaggagagaaaggagaagatctgggaccccgtgcacagagtggccctggccgaggcctgcagaaagcaggaggagttcgacgtggccaacaacggcagcagccaggccaacaagctgatcaaggaggagctgcagagccaggtggagctgctgaacagcttcgagaagaagtacagcgaccccggccccgtgtacgactgcctggtgtggcacgacggcgaggtgtggagagcctgcatcgacagcaacgaggacggcgacctgagcaagagcaccgtgctgagaaactacaaggaggcccaggagtacggcagcttcggcaccgccgagatgctgaactacagcgtgaacatctacgacgacggcaacctgctgagcatcgtgaccagcggcggcgcccacggcacccacgtggccagcatcgccgccggccacttccccgaggagcccgagagaaacggcgtggcccccggcgcccagatcctgagcatcaagatcggcgacaccagactgagcaccatggagaccggcaccggcctgatcagagccatgatcgaggtgatcaaccacaagtgcgacctggtgaactacagctacggcgaggccacccactggcccaacagcggcagaatctgcgaggtgatcaacgaggccgtgtggaagcacaacatcatctacgtgagcagcgccggcaacaacggcccctgcctgagcaccgtgggctgccccggcggcaccaccagcagcgtgatcggcgtgggcgcctacgtgagccccgacatgatggtggccgagtacagcctgagagagaagctgcccgccaaccagtacacctggagcagcagaggccccagcgccgacggcgccctgggcgtgagcatcagcgcccccggcggcgccatcgccagcgtgcccaactggaccctgagaggcacccagctgatgaacggcaccagcatgagcagccccaacgcctgcggcggcatcgccctgatcctgagcggcctgaaggccaacaacatcgactacaccgtgcacagcgtgagaagagccctggagaacaccgccgtgaaggccgacaacatcgaggtgttcgcccagggccacggcatcatccaggtggacaaggcctacgactacctggtgcagaacaccagcttcgccaacaagctgggcttcaccgtgaccgtgggcaacaacagaggcatctacctgagagaccccgtgcaggtggccgcccccagcgaccacggcgtgggcatcgagcccgtgttccccgagaacaccgagaacagcgagaagatcagcctgcagctgcacctggccctgaccagcaacagcagctgggtgcagtgccccagccacctggagctgatgaaccagtgcagacacatcaacatcagagtggaccccagaggcctgagagagggcctgcactacaccgaggtgtgcggctacgacatcgccagccccaacgccggccccctgttcagagtgcccatcaccgccgtgatcgccgccaaggtgaacgagagcagccactacgacctggccttcaccgacgtgcacttcaagcccggccagatcagaagacacttcatcgaggtgcccgagggcgccacctgggccgaggtgaccgtgtgcagctgcagcagcgaggtgagcgccaagttcgtgctgcacgccgtgcagctggtgaagcagagagcctacagaagccacgagttctacaagttctgcagcctgcccgagaagggcaccctgaccgaggccttccccgtgctgggcggcaaggccatcgagttctgcatcgccagatggtgggccagcctgagcgacgtgaacatcgactacaccatcagcttccacggcatcgtgtgcaccgccccccagctgaacatccacgccagcgagggcatcaacagattcgacgtgcagagcagcctgaagtacgaggacctggccccctgcatcaccctgaagaactgggtgcagaccctgagacccgtgagcgccaagaccaagcccctgggcagcagagacgtgctgcccaacaacagacagctgtacgagatggtgctgacctacaacttccaccagcccaagagcggcgaggtgacccccagctgccccctgctgtgcgagctgctgtacgagagcgagttcgacagccagctgtggatcatcttcgaccagaacaagagacagatgggcagcggcgacgcctacccccaccagtacagcctgaagctggagaagggcgactacaccatcagactgcagatcagacacgagcagatcagcgacctggagagactgaaggacctgcccttcatcgtgagccacagactgagcaacaccctgagcctggacatccacgagaaccacagcttcgccctgctgggcaagaagaagagcagcaacctgaccctgccccccaagtacaaccagcccttcttcgtgaccagcctgcccgacgacaagatccccaagggcgccggccccggctgctacctggccggcagcctgaccctgagcaagaccgagctgggcaagaaggccgacgtgatccccgtgcactactacctgatccccccccccaccaagaccaagaacggcagcaaggacaaggagaaggacagcgagaaggagaaggacctgaaggaggagttcaccgaggccctgagagacctgaagatccagtggatgaccaagctggacagcagcgacatctacaacgagctgaaggagacctaccccaactacctgcccctgtacgtggccagactgcaccagctggacgccgagaaggagagaatgaagagactgaacgagatcgtggacgccgccaacgccgtgatcagccacatcgaccagaccgccctggccgtgtacatcgccatgaagaccgaccccagacccgacgccgccaccatcaagaacgacatggacaagcagaagagcaccctggtggacgccctgtgcagaaagggctgcgccctggccgaccacctgctgcacacccaggcccaggacggcgccatcagcaccgacgccgagggcaaggaggaggagggcgagagccccctggacagcctggccgagaccttctgggagaccaccaagtggaccgacctgttcgacaacaaggtgctgaccttcgcctacaagcacgccctggtgaacaagatgtacggcagaggcctgaagttcgccaccaagctggtggaggagaagcccaccaaggagaactggaagaactgcatccagctgatgaagctgctgggctggacccactgcgccagcttcaccgagaactggctgcccatcatgtacccccccgactactgcgtgttctag

SEQ ID NO: 103625 - DNA, 1791 bp, Artificial Sequence
  Description of Artificial Sequence: Synthetic coding sequence
atgctgcccagccaggcccagggcctgctgtggtgggtgttccccctgttccccgccagcagcctgagctacccccccgtgagctacagagccgacggcctggccagaaacaccttcctgaaggcctgcagcgagagcagcagcagcagcaacatcagcaccatgctggtgacccacgactacaccgccgtgaaggaggacgagatcaacgtgtaccagggcgaggtggtgcagatcctggccagcaaccagcagaacatgttcctggtgttcagagccgccaccgaccagtgccccgccgccgagggctggatccccggcttcgtgctgggccacaccagcgccgtgatcgtggagaaccccgacggcaccctgaagaagagcaccagctggcacaccgccctgagactgagaaagaagagcgagaagaaggacaaggacggcaagagagagggcaagctggagaacggctacagaaagagcagagagggcctgagcaacaaggtgagcgtgaagctgctgaaccccaactacatctacgacgtgccccccgagttcgtgatccccctgagcgaggtgacctgcgagaccggcgagaccgtggtgctgagatgcagagtgtgcggcagacccaaggccagcatcacctggaagggccccgagcacaacaccctgaacaacgacggccactacagcatcagctacagcgacctgggcgaggccaccctgaagatcgtgggcgtgaccaccgaggacgacggcatctacacctgcatcgccgtgaacgacatgggcagcgccagcagcagcgccagcctgagagtgctgggccccggcatggacggcatcatggtgacctggaaggacaacttcgacagcttctacagcgaggtggccgagctgggcagaggcagattcagcgtggtgaagaagtgcgaccagaagggcaccaagagagccgtggccaccaagttcgtgaacaagaagctgatgaagagagaccaggtgacccacgagctgggcatcctgcagagcctgcagcaccccctgctggtgggcctgctggacaccttcgagacccccaccagctacatcctggtgctggagatggccgaccagggcagactgctggactgcgtggtgagatggggcagcctgaccgagggcaagatcagagcccacctgggcgaggtgctggaggccgtgagatacctgcacaactgcagaatcgcccacctggacctgaagcccgagaacatcctggtggacgagagcctggccaagcccaccatcaagctggccgacttcggcgacgccgtgcagctgaacaccacctactacatccaccagctgctgggcaaccccgagttcgccgcccccgagatcatcctgggcaaccccgtgagcctgaccagcgacacctggagcgtgggcgtgctgacctacgtgctgctgagcggcgtgagccccttcctggacgacagcgtggaggagacctgcctgaacatctgcagactggacttcagcttccccgacgactacttcaagggcgtgagccagaaggccaaggagttcgtgtgcttcctgctgcaggaggaccccgccaagagacccagcgccgccctggccctgcaggagcagtggctgcaggccggcaacggcagaagcaccggcgtgctggacaccagcagactgaccagcttcatcgagagaagaaagcaccagaacgacgtgagacccatcagaagcatcaagaacttcctgcagagcagactgctgcccagagtgtag

SEQ ID NO: 103626 - DNA, 9294 bp, Artificial Sequence
  Description of Artificial Sequence: Synthetic coding sequence
atgagcggcagcagcggcggcgccgccgcccccgccgccagcagcggccccgccgccgccgccagcgccgccggcagcggctgcggcggcggcgccggcgagggcgccgaggaggccgccaaggacctggccgacatcgccgccttcttcagaagcggcttcagaaagaacgacgagatgaaggccatggacgtgctgcccatcctgaaggagaaggtggcctacctgagcggcggcagagacaagagaggcggccccatcctgaccttccccgccagaagcaaccacgacagaatcagacaggaggacctgagaagactgatcagctacctggcctgcatccccagcgaggaggtgtgcaagagaggcttcaccgtgatcgtggacatgagaggcagcaagtgggacagcatcaagcccctgctgaagatcctgcaggagagcttcccctgctgcatccacgtggccctgatcatcaagcccgacaacttctggcagaagcagagaaccaacttcggcagcagcaagttcgagttcgagaccaacatggtgagcctggagggcctgaccaaggtggtggaccccagccagctgacccccgagttcgacggctgcctggagtacaaccacgaggagtggatcgagatcagagtggccttcgaggactacatcagcaacgccacccacatgctgagcagactggaggagctgcaggacatcctggccaagaaggagctgccccaggacctggagggcgccagaaacatgatcgaggagcacagccagctgaagaagaaggtgatcaaggcccccatcgaggacctggacctggagggccagaagctgctgcagagaatccagagcagcgagagcttccccaagaagaacagcggcagcggcaacgccgacctgcagaacctgctgcccaaggtgagcaccatgctggacagactgcacagcaccagacagcacctgcaccagatgtggcacgtgagaaagctgaagctggaccagtgcttccagctgagactgttcgagcaggacgccgagaagatgttcgactggatcacccacaacaagggcctgttcctgaacagctacaccgagatcggcaccagccacccccacgccatggagctgcagacccagcacaaccacttcgccatgaactgcatgaacgtgtacgtgaacatcaacagaatcatgagcgtggccaacagactggtggagagcggccactacgccagccagcagatcagacagatcgccagccagctggagcaggagtggaaggccttcgccgccgccctggacgagagaagcaccctgctggacatgagcagcatcttccaccagaaggccgagaagtacatgagcaacgtggacagctggtgcaaggcctgcggcgaggtggacctgcccagcgagctgcaggacctggaggacgccatccaccaccaccagggcatctacgagcacatcaccctggcctacagcgaggtgagccaggacggcaagagcctgctggacaagctgcagagacccctgacccccggcagcagcgacagcctgaccgccagcgccaactacagcaaggccgtgcaccacgtgctggacgtgatccacgaggtgctgcaccaccagagacagctggagaacatctggcagcacagaaaggtgagactgcaccagagactgcagctgtgcgtgttccagcaggacgtgcagcaggtgctggactggatcgagaaccacggcgaggccttcctgagcaagcacaccggcgtgggcaagagcctgcacagagccagagccctgcagaagagacacgaggacttcgaggaggtggcccagaacacctacaccaacgccgacaagctgctggaggccgccgagcagctggcccagaccggcgagtgcgaccccgaggagatctaccaggccgcccaccagctggaggacagaatccaggacttcgtgagaagagtggagcagagaaagatcctgctggacatgagcgtgagcttccacacccacgtgaaggagctgtggacctggctggaggagctgcagaaggagctgctggacgacgtgtacgccgagagcgtggaggccgtgcaggacctgatcaagagattcggccagcagcagcagaccaccctgcaggtgaccgtgaacgtgatcaaggagggcgaggacctgatccagcagctgagagacagcgccatcagcagcaacaagaccccccacaacagcagcatcaaccacatcgagaccgtgctgcagcagctggacgaggcccagagccagatggaggagctgttccaggagagaaagatcaagctggagctgttcctgcagctgagaatcttcgagagagacgccatcgacatcatcagcgacctggagagctggaacgacgagctgagccagcagatgaacgacttcgacaccgaggacctgaccatcgccgagcagagactgcagcaccacgccgacaaggccctgaccatgaacaacctgaccttcgacgtgatccaccagggccaggacctgctgcagtacgtgaacgaggtgcaggccagcggcgtggagctgctgtgcgacagagacgtggacatggccaccagagtgcaggacctgctggagttcctgcacgagaagcagcaggagctggacctggccgccgagcagcacagaaagcacctggagcagtgcgtgcagctgagacacctgcaggccgaggtgaagcaggtgctgggctggatcagaaacggcgagagcatgctgaacgccggcctgatcaccgccagcagcctgcaggaggccgagcagctgcagagagagcacgagcagttccagcacgccatcgagaagacccaccagagcgccctgcaggtgcagcagaaggccgaggccatgctgcaggccaaccactacgacatggacatgatcagagactgcgccgagaaggtggccagccactggcagcagctgatgctgaagatggaggacagactgaagctggtgaacgccagcgtggccttctacaagaccagcgagcaggtgtgcagcgtgctggagagcctggagcaggagtacaagagagaggaggactggtgcggcggcgccgacaagctgggccccaacagcgagaccgaccacgtgacccccatgatcagcaagcacctggagcagaaggaggccttcctgaaggcctgcaccctggccagaagaaacgccgacgtgttcctgaagtacctgcacagaaacagcgtgaacatgcccggcatggtgacccacatcaaggcccccgagcagcaggtgaagaacatcctgaacgagctgttccagagagagaacagagtgctgcactactggaccatgagaaagagaagactggaccagtgccagcagtacgtggtgttcgagagaagcgccaagcaggccctggagtggatccacgacaacggcgagttctacctgagcacccacaccagcaccggcagcagcatccagcacacccaggagctgctgaaggagcacgaggagttccagatcaccgccaagcagaccaaggagagagtgaagctgctgatccagctggccgacggcttctgcgagaagggccacgcccacgccgccgagatcaagaagtgcgtgaccgccgtggacaagagatacagagacttcagcctgagaatggagaagtacagaaccagcctggagaaggccctgggcatcagcagcgacagcaacaagagcagcaagagcctgcagctggacatcatccccgccagcatccccggcagcgaggtgaagctgagagacgccgcccacgagctgaacgaggagaagagaaagagcgccagaagaaaggagttcatcatggccgagctgatccagaccgagaaggcctacgtgagagacctgagagagtgcatggacacctacctgtgggagatgaccagcggcgtggaggagatcccccccggcatcgtgaacaaggagctgatcatcttcggcaacatgcaggagatctacgagttccacaacaacatcttcctgaaggagctggagaagtacgagcagctgcccgaggacgtgggccactgcttcgtgacctgggccgacaagttccagatgtacgtgacctactgcaagaacaagcccgacagcacccagctgatcctggagcacgccggcagctacttcgacgagatccagcagagacacggcctggccaacagcatcagcagctacctgatcaagcccgtgcagagaatcaccaagtaccagctgctgctgaaggagctgctgacctgctgcgaggagggcaagggcgagatcaaggacggcctggaggtgatgctgagcgtgcccaagagagccaacgacgccatgcacctgagcatgctggagggcttcgacgagaacatcgagagccagggcgagctgatcctgcaggagagcttccaggtgtgggaccccaagaccctgatcagaaagggcagagagagacacctgttcctgttcgagatgagcctggtgttcagcaaggaggtgaaggacagcagcggcagaagcaagtacctgtacaagagcaagctgttcaccagcgagctgggcgtgaccgagcacgtggagggcgacccctgcaagttcgccctgtgggtgggcagaacccccaccagcgacaacaagatcgtgctgaaggccagcagcatcgagaacaagcaggactggatcaagcacatcagagaggtgatccaggagagaaccatccacctgaagggcgccctgaaggagcccatccacatccccaagaccgcccccgccaccagacagaagggcagaagagacggcgaggacctggacagccagggcgacggcagcagccagcccgacaccatcagcatcgccagcagaaccagccagaacaccctggacagcgacaagctgagcggcggctgcgagctgaccgtggtgatccacgacttcaccgcctgcaacagcaacgagctgaccatcagaagaggccagaccgtggaggtgctggagagaccccacgacaagcccgactggtgcctggtgagaaccaccgacagaagccccgccgccgagggcctggtgccctgcggcagcctgtgcatcgcccacagcagaagcagcatggagatggagggcatcttcaaccacaaggacagcctgagcgtgagcagcaacgacgccagcccccccgccagcgtggccagcctgcagccccacatgatcggcgcccagagcagccccggccccaagagacccggcaacaccctgagaaagtggctgaccagccccgtgagaagactgagcagcggcaaggccgacggccacgtgaagaagctggcccacaagcacaagaagagcagagaggtgagaaagagcgccgacgccggcagccagaaggacagcgacgacagcgccgccaccccccaggacgagaccgtggaggagagaggcagaaacgagggcctgagcagcggcaccctgagcaagagcagcagcagcggcatgcagagctgcggcgaggaggagggcgaggagggcgccgacgccgtgcccctgcccccccccatggccatccagcagcacagcctgctgcagcccgacagccaggacgacaaggccagcagcagactgctggtgagacccaccagcagcgagacccccagcgccgccgagctggtgagcgccatcgaggagctggtgaagagcaagatggccctggaggacagacccagcagcctgctggtggaccagggcgacagcagcagccccagcttcaaccccagcgacaacagcctgctgagcagcagcagccccatcgacgagatggaggagagaaagagcagcagcctgaagagaagacactacgtgctgcaggagctggtggagaccgagagagactacgtgagagacctgggctacgtggtggagggctacatggccctgatgaaggaggacggcgtgcccgacgacatgaagggcaaggacaagatcgtgttcggcaacatccaccagatctacgactggcacagagacttcttcctgggcgagctggagaagtgcctggaggaccccgagaagctgggcagcctgttcgtgaagcacgagagaagactgcacatgtacatcgcctactgccagaacaagcccaagagcgagcacatcgtgagcgagtacatcgacaccttcttcgaggacctgaagcagagactgggccacagactgcagctgaccgacctgctgatcaagcccgtgcagagaatcatgaagtaccagctgctgctgaaggacttcctgaagtacagcaagaaggccagcctggacaccagcgagctggagagagccgtggaggtgatgtgcatcgtgcccagaagatgcaacgacatgatgaacgtgggcagactgcagggcttcgacggcaagatcgtggcccagggcaagctgctgctgcaggacaccttcctggtgaccgaccaggacgccggcctgctgcccagatgcagagagagaagaatcttcctgttcgagcagatcgtgatcttcagcgagcccctggacaagaagaagggcttcagcatgcccggcttcctgttcaagaacagcatcaaggtgagctgcctgtgcctggaggagaacgtggagaacgacccctgcaagttcgccctgaccagcagaaccggcgacgtggtggagaccttcatcctgcacagcagcagccccagcgtgagacagacctggatccacgagatcaaccagatcctggagaaccagagaaacttcctgaacgccctgaccagccccatcgagtaccagagaaaccacagcggcggcggcggcggcggcggcagcggcggcagcggcggcggcggcggcagcggcggcggcggcgcccccagcggcggcagcggccacagcggcggccccagcagctgcggcggcgcccccagcaccagcagaagcagacccagcagaatcccccagcccgtgagacaccacccccccgtgctggtgagcagcgccgccagcagccaggccgaggccgacaagatgagcggcaccagcacccccggccccagcctgcccccccccggcgccgcccccgaggccggccccagcgcccccagcagaagaccccccggcgccgacgccgagggcagcgagagagaggccgagcccatccccaagatgaaggtgctggagagccccagaaagggcgccgccaacgccagcggcagcagccccgacgcccccgccaaggacgccagagccagcctgggcaccctgcccctgggcaagcccagagccggcgccgccagccccctgaacagccccctgagcagcgccgtgcccagcctgggcaaggagcccttcccccccagcagccccctgcagaagggcggcagcttctggagcagcatccccgccagccccgccagcagacccggcagcttcaccttccccggcgacagcgacagcctgcagagacagacccccagacacgccgcccccggcaaggacaccgacagaatgagcacctgcagcagcgccagcgagcagagcgtgcagagcacccagagcaacggcagcgagagcagcagcagcagcaacatcagcaccatgctggtgacccacgactacaccgccgtgaaggaggacgagatcaacgtgtaccagggcgaggtggtgcagatcctggccagcaaccagcagaacatgttcctggtgttcagagccgccaccgaccagtgccccgccgccgagggctggatccccggcttcgtgctgggccacaccagcgccgtgatcgtggagaaccccgacggcaccctgaagaagagcaccagctggcacaccgccctgagactgagaaagaagagcgagaagaaggacaaggacggcaagagagagggcaagctggagaacggctacagaaagagcagagagggcctgagcaacaaggtgagcgtgaagctgctgaaccccaactacatctacgacgtgccccccgagttcgtgatccccctgagcgaggtgacctgcgagaccggcgagaccgtggtgctgagatgcagagtgtgcggcagacccaaggccagcatcacctggaagggccccgagcacaacaccctgaacaacgacggccactacagcatcagctacagcgacctgggcgaggccaccctgaagatcgtgggcgtgaccaccgaggacgacggcatctacacctgcatcgccgtgaacgacatgggcagcgccagcagcagcgccagcctgagagtgctgggccccggcatggacggcatcatggtgacctggaaggacaacttcgacagcttctacagcgaggtggccgagctgggcagaggcagattcagcgtggtgaagaagtgcgaccagaagggcaccaagagagccgtggccaccaagttcgtgaacaagaagctgatgaagagagaccaggtgacccacgagctgggcatcctgcagagcctgcagcaccccctgctggtgggcctgctggacaccttcgagacccccaccagctacatcctggtgctggagatggccgaccagggcagactgctggactgcgtggtgagatggggcagcctgaccgagggcaagatcagagcccacctgggcgaggtgctggaggccgtgagatacctgcacaactgcagaatcgcccacctggacctgaagcccgagaacatcctggtggacgagagcctggccaagcccaccatcaagctggccgacttcggcgacgccgtgcagctgaacaccacctactacatccaccagctgctgggcaaccccgagttcgccgcccccgagatcatcctgggcaaccccgtgagcctgaccagcgacacctggagcgtgggcgtgctgacctacgtgctgctgagcggcgtgagccccttcctggacgacagcgtggaggagacctgcctgaacatctgcagactggacttcagcttccccgacgactacttcaagggcgtgagccagaaggccaaggagttcgtgtgcttcctgctgcaggaggaccccgccaagagacccagcgccgccctggccctgcaggagcagtggctgcaggccggcaacggcagaagcaccggcgtgctggacaccagcagactgaccagcttcatcgagagaagaaagcaccagaacgacgtgagacccatcagaagcatcaagaacttcctgcagagcagactgctgcccagagtgtag

SEQ ID NO: 103627 - DNA, 7503 bp, Artificial Sequence
  Description of Artificial Sequence: Synthetic coding sequence
atgctggacagactgcacagcaccagacagcacctgcaccagatgtggcacgtgagaaagctgaagctggaccagtgcttccagctgagactgttcgagcaggacgccgagaagatgttcgactggatcacccacaacaagggcctgttcctgaacagctacaccgagatcggcaccagccacccccacgccatggagctgcagacccagcacaaccacttcgccatgaactgcatgaacgtgtacgtgaacatcaacagaatcatgagcgtggccaacagactggtggagagcggccactacgccagccagcagatcagacagatcgccagccagctggagcaggagtggaaggccttcgccgccgccctggacgagagaagcaccctgctggacatgagcagcatcttccaccagaaggccgagaagtacatgagcaacgtggacagctggtgcaaggcctgcggcgaggtggacctgcccagcgagctgcaggacctggaggacgccatccaccaccaccagggcatctacgagcacatcaccctggcctacagcgaggtgagccaggacggcaagagcctgctggacaagctgcagagacccctgacccccggcagcagcgacagcctgaccgccagcgccaactacagcaaggccgtgcaccacgtgctggacgtgatccacgaggtgctgcaccaccagagacagctggagaacatctggcagcacagaaaggtgagactgcaccagagactgcagctgtgcgtgttccagcaggacgtgcagcaggtgctggactggatcgagaaccacggcgaggccttcctgagcaagcacaccggcgtgggcaagagcctgcacagagccagagccctgcagaagagacacgaggacttcgaggaggtggcccagaacacctacaccaacgccgacaagctgctggaggccgccgagcagctggcccagaccggcgagtgcgaccccgaggagatctaccaggccgcccaccagctggaggacagaatccaggacttcgtgagaagagtggagcagagaaagatcctgctggacatgagcgtgagcttccacacccacgtgaaggagctgtggacctggctggaggagctgcagaaggagctgctggacgacgtgtacgccgagagcgtggaggccgtgcaggacctgatcaagagattcggccagcagcagcagaccaccctgcaggtgaccgtgaacgtgatcaaggagggcgaggacctgatccagcagctgagagacagcgccatcagcagcaacaagaccccccacaacagcagcatcaaccacatcgagaccgtgctgcagcagctggacgaggcccagagccagatggaggagctgttccaggagagaaagatcaagctggagctgttcctgcagctgagaatcttcgagagagacgccatcgacatcatcagcgacctggagagctggaacgacgagctgagccagcagatgaacgacttcgacaccgaggacctgaccatcgccgagcagagactgcagcaccacgccgacaaggccctgaccatgaacaacctgaccttcgacgtgatccaccagggccaggacctgctgcagtacgtgaacgaggtgcaggccagcggcgtggagctgctgtgcgacagagacgtggacatggccaccagagtgcaggacctgctggagttcctgcacgagaagcagcaggagctggacctggccgccgagcagcacagaaagcacctggagcagtgcgtgcagctgagacacctgcaggccgaggtgaagcaggtgctgggctggatcagaaacggcgagagcatgctgaacgccggcctgatcaccgccagcagcctgcaggaggccgagcagctgcagagagagcacgagcagttccagcacgccatcgagaagacccaccagagcgccctgcaggtgcagcagaaggccgaggccatgctgcaggccaaccactacgacatggacatgatcagagactgcgccgagaaggtggccagccactggcagcagctgatgctgaagatggaggacagactgaagctggtgaacgccagcgtggccttctacaagaccagcgagcaggtgtgcagcgtgctggagagcctggagcaggagtacaagagagaggaggactggtgcggcggcgccgacaagctgggccccaacagcgagaccgaccacgtgacccccatgatcagcaagcacctggagcagaaggaggccttcctgaaggcctgcaccctggccagaagaaacgccgacgtgttcctgaagtacctgcacagaaacagcgtgaacatgcccggcatggtgacccacatcaaggcccccgagcagcaggtgaagaacatcctgaacgagctgttccagagagagaacagagtgctgcactactggaccatgagaaagagaagactggaccagtgccagcagtacgtggtgttcgagagaagcgccaagcaggccctggagtggatccacgacaacggcgagttctacctgagcacccacaccagcaccggcagcagcatccagcacacccaggagctgctgaaggagcacgaggagttccagatcaccgccaagcagaccaaggagagagtgaagctgctgatccagctggccgacggcttctgcgagaagggccacgcccacgccgccgagatcaagaagtgcgtgaccgccgtggacaagagatacagagacttcagcctgagaatggagaagtacagaaccagcctggagaaggccctgggcatcagcagcgacagcaacaagagcagcaagagcctgcagctggacatcatccccgccagcatccccggcagcgaggtgaagctgagagacgccgcccacgagctgaacgaggagaagagaaagagcgccagaagaaaggagttcatcatggccgagctgatccagaccgagaaggcctacgtgagagacctgagagagtgcatggacacctacctgtgggagatgaccagcggcgtggaggagatcccccccggcatcgtgaacaaggagctgatcatcttcggcaacatgcaggagatctacgagttccacaacaacatcttcctgaaggagctggagaagtacgagcagctgcccgaggacgtgggccactgcttcgtgacctgggccgacaagttccagatgtacgtgacctactgcaagaacaagcccgacagcacccagctgatcctggagcacgccggcagctacttcgacgagatccagcagagacacggcctggccaacagcatcagcagctacctgatcaagcccgtgcagagaatcaccaagtaccagctgctgctgaaggagctgctgacctgctgcgaggagggcaagggcgagatcaaggacggcctggaggtgatgctgagcgtgcccaagagagccaacgacgccatgcacctgagcatgctggagggcttcgacgagaacatcgagagccagggcgagctgatcctgcaggagagcttccaggtgtgggaccccaagaccctgatcagaaagggcagagagagacacctgttcctgttcgagatgagcctggtgttcagcaaggaggtgaaggacagcagcggcagaagcaagtacctgtacaagagcaagctgttcaccagcgagctgggcgtgaccgagcacgtggagggcgacccctgcaagttcgccctgtgggtgggcagaacccccaccagcgacaacaagatcgtgctgaaggccagcagcatcgagaacaagcaggactggatcaagcacatcagagaggtgatccaggagagaaccatccacctgaagggcgccctgaaggagcccatccacatccccaagaccgcccccgccaccagacagaagggcagaagagacggcgaggacctggacagccagggcgacggcagcagccagcccgacaccatcagcatcgccagcagaaccagccagaacaccctggacagcgacaagctgagcggcggctgcgagctgaccgtggtgatccacgacttcaccgcctgcaacagcaacgagctgaccatcagaagaggccagaccgtggaggtgctggagagaccccacgacaagcccgactggtgcctggtgagaaccaccgacagaagccccgccgccgagggcctggtgccctgcggcagcctgtgcatcgcccacagcagaagcagcatggagatggagggcatcttcaaccacaaggacagcctgagcgtgagcagcaacgacgccagcccccccgccagcgtggccagcctgcagccccacatgatcggcgcccagagcagccccggccccaagagacccggcaacaccctgagaaagtggctgaccagccccgtgagaagactgagcagcggcaaggccgacggccacgtgaagaagctggcccacaagcacaagaagagcagagaggtgagaaagagcgccgacgccggcagccagaaggacagcgacgacagcgccgccaccccccaggacgagaccgtggaggagagaggcagaaacgagggcctgagcagcggcaccctgagcaagagcagcagcagcggcatgcagagctgcggcgaggaggagggcgaggagggcgccgacgccgtgcccctgcccccccccatggccatccagcagcacagcctgctgcagcccgacagccaggacgacaaggccagcagcagactgctggtgagacccaccagcagcgagacccccagcgccgccgagctggtgagcgccatcgaggagctggtgaagagcaagatggccctggaggacagacccagcagcctgctggtggaccagggcgacagcagcagccccagcttcaaccccagcgacaacagcctgctgagcagcagcagccccatcgacgagatggaggagagaaagagcagcagcctgaagagaagacactacgtgctgcaggagctggtggagaccgagagagactacgtgagagacctgggctacgtggtggagggctacatggccctgatgaaggaggacggcgtgcccgacgacatgaagggcaaggacaagatcgtgttcggcaacatccaccagatctacgactggcacagagacttcttcctgggcgagctggagaagtgcctggaggaccccgagaagctgggcagcctgttcgtgaagcacgagagaagactgcacatgtacatcgcctactgccagaacaagcccaagagcgagcacatcgtgagcgagtacatcgacaccttcttcgaggacctgaagcagagactgggccacagactgcagctgaccgacctgctgatcaagcccgtgcagagaatcatgaagtaccagctgctgctgaaggacttcctgaagtacagcaagaaggccagcctggacaccagcgagctggagagagccgtggaggtgatgtgcatcgtgcccagaagatgcaacgacatgatgaacgtgggcagactgcagggcttcgacggcaagatcgtggcccagggcaagctgctgctgcaggacaccttcctggtgaccgaccaggacgccggcctgctgcccagatgcagagagagaagaatcttcctgttcgagcagatcgtgatcttcagcgagcccctggacaagaagaagggcttcagcatgcccggcttcctgttcaagaacagcatcaaggtgagctgcctgtgcctggaggagaacgtggagaacgacccctgcaagttcgccctgaccagcagaaccggcgacgtggtggagaccttcatcctgcacagcagcagccccagcgtgagacagacctggatccacgagatcaaccagatcctggagaaccagagaaacttcctgaacgccctgaccagccccatcgagtaccagagaaaccacagcggcggcggcggcggcggcggcagcggcggcagcggcggcggcggcggcagcggcggcggcggcgcccccagcggcggcagcggccacagcggcggccccagcagctgcggcggcgcccccagcaccagcagaagcagacccagcagaatcccccagcccgtgagacaccacccccccgtgctggtgagcagcgccgccagcagccaggccgaggccgacaagatgagcggcaccagcacccccggccccagcctgcccccccccggcgccgcccccgaggccggccccagcgcccccagcagaagaccccccggcgccgacgccgagggcagcgagagagaggccgagcccatccccaagatgaaggtgctggagagccccagaaagggcgccgccaacgccagcggcagcagccccgacgcccccgccaaggacgccagagccagcctgggcaccctgcccctgggcaagcccagagccggcgccgccagccccctgaacagccccctgagcagcgccgtgcccagcctgggcaaggagcccttcccccccagcagccccctgcagaagggcggcagcttctggagcagcatccccgccagccccgccagcagacccggcagcttcaccttccccggcgacagcgacagcctgcagagacagacccccagacacgccgcccccggcaaggacaccgacagaatgagcacctgcagcagcgccagcgagcagagcgtgcagagcacccagagcaacggcagcgagagcagcagcagcagcaacatcagcaccatgctggtgacccacgactacaccgccgtgaaggaggacgagatcaacgtgtaccagggcgaggtggtgcagatcctggccagcaaccagcagaacatgttcctggtgttcagagccgccaccgaccagtgccccgccgccgagggctggatccccggcttcgtgctgggccacaccagcgccgtgatcgtggagaaccccgacggcaccctgaagaagagcaccagctggcacaccgccctgagactgagaaagaagagcgagaagaaggacaaggacggcaagagagagggcaagctggagaacggctacagaaagagcagagagggcctgagcaacaaggtgagcgtgaagctgctgaaccccaactacatctacgacgtgccccccgagttcgtgatccccctgagcgaggtgacctgcgagaccggcgagaccgtggtgctgagatgcagagtgtgcggcagacccaaggccagcatcacctggaagggccccgagcacaacaccctgaacaacgacggccactacagcatcagctacagcgacctgggcgaggccaccctgaagatcgtgggcgtgaccaccgaggacgacggcatctacacctgcatcgccgtgaacgacatgggcagcgccagcagcagcgccagcctgagagtgctgggccccggcatggacggcatcatggtgacctggaaggacaacttcgacagcttctacagcgaggtggccgagctgggcagagccaactggaacaactggagcccctactag

SEQ ID NO: 103628 - DNA, 8766 bp, Artificial Sequence
  Description of Artificial Sequence: Synthetic coding sequence
atgagcggcagcagcggcggcgccgccgcccccgccgccagcagcggccccgccgccgccgccagcgccgccggcagcggctgcggcggcggcgccggcgagggcgccgaggaggccgccaaggacctggccgacatcgccgccttcttcagaagcggcttcagaaagaacgacgagatgaaggccatggacgtgctgcccatcctgaaggagaaggtggcctacctgagcggcggcagagacaagagaggcggccccatcctgaccttccccgccagaagcaaccacgacagaatcagacaggaggacctgagaagactgatcagctacctggcctgcatccccagcgaggaggtgtgcaagagaggcttcaccgtgatcgtggacatgagaggcagcaagtgggacagcatcaagcccctgctgaagatcctgcaggagagcttcccctgctgcatccacgtggccctgatcatcaagcccgacaacttctggcagaagcagagaaccaacttcggcagcagcaagttcgagttcgagaccaacatggtgagcctggagggcctgaccaaggtggtggaccccagccagctgacccccgagttcgacggctgcctggagtacaaccacgaggagtggatcgagatcagagtggccttcgaggactacatcagcaacgccacccacatgctgagcagactggaggagctgcaggacatcctggccaagaaggagctgccccaggacctggagggcgccagaaacatgatcgaggagcacagccagctgaagaagaaggtgatcaaggcccccatcgaggacctggacctggagggccagaagctgctgcagagaatccagagcagcgagagcttccccaagaagaacagcggcagcggcaacgccgacctgcagaacctgctgcccaaggtgagcaccatgctggacagactgcacagcaccagacagcacctgcaccagatgtggcacgtgagaaagctgaagctggaccagtgcttccagctgagactgttcgagcaggacgccgagaagatgttcgactggatcacccacaacaagggcctgttcctgaacagctacaccgagatcggcaccagccacccccacgccatggagctgcagacccagcacaaccacttcgccatgaactgcatgaacgtgtacgtgaacatcaacagaatcatgagcgtggccaacagactggtggagagcggccactacgccagccagcagatcagacagatcgccagccagctggagcaggagtggaaggccttcgccgccgccctggacgagagaagcaccctgctggacatgagcagcatcttccaccagaaggccgagaagtacatgagcaacgtggacagctggtgcaaggcctgcggcgaggtggacctgcccagcgagctgcaggacctggaggacgccatccaccaccaccagggcatctacgagcacatcaccctggcctacagcgaggtgagccaggacggcaagagcctgctggacaagctgcagagacccctgacccccggcagcagcgacagcctgaccgccagcgccaactacagcaaggccgtgcaccacgtgctggacgtgatccacgaggtgctgcaccaccagagacagctggagaacatctggcagcacagaaaggtgagactgcaccagagactgcagctgtgcgtgttccagcaggacgtgcagcaggtgctggactggatcgagaaccacggcgaggccttcctgagcaagcacaccggcgtgggcaagagcctgcacagagccagagccctgcagaagagacacgaggacttcgaggaggtggcccagaacacctacaccaacgccgacaagctgctggaggccgccgagcagctggcccagaccggcgagtgcgaccccgaggagatctaccaggccgcccaccagctggaggacagaatccaggacttcgtgagaagagtggagcagagaaagatcctgctggacatgagcgtgagcttccacacccacgtgaaggagctgtggacctggctggaggagctgcagaaggagctgctggacgacgtgtacgccgagagcgtggaggccgtgcaggacctgatcaagagattcggccagcagcagcagaccaccctgcaggtgaccgtgaacgtgatcaaggagggcgaggacctgatccagcagctgagagacagcgccatcagcagcaacaagaccccccacaacagcagcatcaaccacatcgagaccgtgctgcagcagctggacgaggcccagagccagatggaggagctgttccaggagagaaagatcaagctggagctgttcctgcagctgagaatcttcgagagagacgccatcgacatcatcagcgacctggagagctggaacgacgagctgagccagcagatgaacgacttcgacaccgaggacctgaccatcgccgagcagagactgcagcaccacgccgacaaggccctgaccatgaacaacctgaccttcgacgtgatccaccagggccaggacctgctgcagtacgtgaacgaggtgcaggccagcggcgtggagctgctgtgcgacagagacgtggacatggccaccagagtgcaggacctgctggagttcctgcacgagaagcagcaggagctggacctggccgccgagcagcacagaaagcacctggagcagtgcgtgcagctgagacacctgcaggccgaggtgaagcaggtgctgggctggatcagaaacggcgagagcatgctgaacgccggcctgatcaccgccagcagcctgcaggaggccgagcagctgcagagagagcacgagcagttccagcacgccatcgagaagacccaccagagcgccctgcaggtgcagcagaaggccgaggccatgctgcaggccaaccactacgacatggacatgatcagagactgcgccgagaaggtggccagccactggcagcagctgatgctgaagatggaggacagactgaagctggtgaacgccagcgtggccttctacaagaccagcgagcaggtgtgcagcgtgctggagagcctggagcaggagtacaagagagaggaggactggtgcggcggcgccgacaagctgggccccaacagcgagaccgaccacgtgacccccatgatcagcaagcacctggagcagaaggaggccttcctgaaggcctgcaccctggccagaagaaacgccgacgtgttcctgaagtacctgcacagaaacagcgtgaacatgcccggcatggtgacccacatcaaggcccccgagcagcaggtgaagaacatcctgaacgagctgttccagagagagaacagagtgctgcactactggaccatgagaaagagaagactggaccagtgccagcagtacgtggtgttcgagagaagcgccaagcaggccctggagtggatccacgacaacggcgagttctacctgagcacccacaccagcaccggcagcagcatccagcacacccaggagctgctgaaggagcacgaggagttccagatcaccgccaagcagaccaaggagagagtgaagctgctgatccagctggccgacggcttctgcgagaagggccacgcccacgccgccgagatcaagaagtgcgtgaccgccgtggacaagagatacagagacttcagcctgagaatggagaagtacagaaccagcctggagaaggccctgggcatcagcagcgacagcaacaagagcagcaagagcctgcagctggacatcatccccgccagcatccccggcagcgaggtgaagctgagagacgccgcccacgagctgaacgaggagaagagaaagagcgccagaagaaaggagttcatcatggccgagctgatccagaccgagaaggcctacgtgagagacctgagagagtgcatggacacctacctgtgggagatgaccagcggcgtggaggagatcccccccggcatcgtgaacaaggagctgatcatcttcggcaacatgcaggagatctacgagttccacaacaacatcttcctgaaggagctggagaagtacgagcagctgcccgaggacgtgggccactgcttcgtgacctgggccgacaagttccagatgtacgtgacctactgcaagaacaagcccgacagcacccagctgatcctggagcacgccggcagctacttcgacgagatccagcagagacacggcctggccaacagcatcagcagctacctgatcaagcccgtgcagagaatcaccaagtaccagctgctgctgaaggagctgctgacctgctgcgaggagggcaagggcgagatcaaggacggcctggaggtgatgctgagcgtgcccaagagagccaacgacgccatgcacctgagcatgctggagggcttcgacgagaacatcgagagccagggcgagctgatcctgcaggagagcttccaggtgtgggaccccaagaccctgatcagaaagggcagagagagacacctgttcctgttcgagatgagcctggtgttcagcaaggaggtgaaggacagcagcggcagaagcaagtacctgtacaagagcaagctgttcaccagcgagctgggcgtgaccgagcacgtggagggcgacccctgcaagttcgccctgtgggtgggcagaacccccaccagcgacaacaagatcgtgctgaaggccagcagcatcgagaacaagcaggactggatcaagcacatcagagaggtgatccaggagagaaccatccacctgaagggcgccctgaaggagcccatccacatccccaagaccgcccccgccaccagacagaagggcagaagagacggcgaggacctggacagccagggcgacggcagcagccagcccgacaccatcagcatcgccagcagaaccagccagaacaccctggacagcgacaagctgagcggcggctgcgagctgaccgtggtgatccacgacttcaccgcctgcaacagcaacgagctgaccatcagaagaggccagaccgtggaggtgctggagagaccccacgacaagcccgactggtgcctggtgagaaccaccgacagaagccccgccgccgagggcctggtgccctgcggcagcctgtgcatcgcccacagcagaagcagcatggagatggagggcatcttcaaccacaaggacagcctgagcgtgagcagcaacgacgccagcccccccgccagcgtggccagcctgcagccccacatgatcggcgcccagagcagccccggccccaagagacccggcaacaccctgagaaagtggctgaccagccccgtgagaagactgagcagcggcaaggccgacggccacgtgaagaagctggcccacaagcacaagaagagcagagaggtgagaaagagcgccgacgccggcagccagaaggacagcgacgacagcgccgccaccccccaggacgagaccgtggaggagagaggcagaaacgagggcctgagcagcggcaccctgagcaagagcagcagcagcggcatgcagagctgcggcgaggaggagggcgaggagggcgccgacgccgtgcccctgcccccccccatggccatccagcagcacagcctgctgcagcccgacagccaggacgacaaggccagcagcagactgctggtgagacccaccagcagcgagacccccagcgccgccgagctggtgagcgccatcgaggagctggtgaagagcaagatggccctggaggacagacccagcagcctgctggtggaccagggcgacagcagcagccccagcttcaaccccagcgacaacagcctgctgagcagcagcagccccatcgacgagatggaggagagaaagagcagcagcctgaagagaagacactacgtgctgcaggagctggtggagaccgagagagactacgtgagagacctgggctacgtggtggagggctacatggccctgatgaaggaggacggcgtgcccgacgacatgaagggcaaggacaagatcgtgttcggcaacatccaccagatctacgactggcacagagacttcttcctgggcgagctggagaagtgcctggaggaccccgagaagctgggcagcctgttcgtgaagcacgagagaagactgcacatgtacatcgcctactgccagaacaagcccaagagcgagcacatcgtgagcgagtacatcgacaccttcttcgaggacctgaagcagagactgggccacagactgcagctgaccgacctgctgatcaagcccgtgcagagaatcatgaagtaccagctgctgctgaaggacttcctgaagtacagcaagaaggccagcctggacaccagcgagctggagagagccgtggaggtgatgtgcatcgtgcccagaagatgcaacgacatgatgaacgtgggcagactgcagggcttcgacggcaagatcgtggcccagggcaagctgctgctgcaggacaccttcctggtgaccgaccaggacgccggcctgctgcccagatgcagagagagaagaatcttcctgttcgagcagatcgtgatcttcagcgagcccctggacaagaagaagggcttcagcatgcccggcttcctgttcaagaacagcatcaaggtgagctgcctgtgcctggaggagaacgtggagaacgacccctgcaagttcgccctgaccagcagaaccggcgacgtggtggagaccttcatcctgcacagcagcagccccagcgtgagacagacctggatccacgagatcaaccagatcctggagaaccagagaaacttcctgaacgccctgaccagccccatcgagtaccagagaaaccacagcggcggcggcggcggcggcggcagcggcggcagcggcggcggcggcggcagcggcggcggcggcgcccccagcggcggcagcggccacagcggcggccccagcagctgcggcggcgcccccagcaccagcagaagcagacccagcagaatcccccagcccgtgagacaccacccccccgtgctggtgagcagcgccgccagcagccaggccgaggccgacaagatgagcgagagcgagagcagcagcagcagcaacatcagcaccatgctggtgacccacgactacaccgccgtgaaggaggacgagatcaacgtgtaccagggcgaggtggtgcagatcctggccagcaaccagcagaacatgttcctggtgttcagagccgccaccgaccagtgccccgccgccgagggctggatccccggcttcgtgctgggccacaccagcgccgtgatcgtggagaaccccgacggcaccctgaagaagagcaccagctggcacaccgccctgagactgagaaagaagagcgagaagaaggacaaggacggcaagagagagggcaagctggagaacggctacagaaagagcagagagggcctgagcaacaaggtgagcgtgaagctgctgaaccccaactacatctacgacgtgccccccgagttcgtgatccccctgagcgaggtgacctgcgagaccggcgagaccgtggtgctgagatgcagagtgtgcggcagacccaaggccagcatcacctggaagggccccgagcacaacaccctgaacaacgacggccactacagcatcagctacagcgacctgggcgaggccaccctgaagatcgtgggcgtgaccaccgaggacgacggcatctacacctgcatcgccgtgaacgacatgggcagcgccagcagcagcgccagcctgagagtgctgggccccggcatggacggcatcatggtgacctggaaggacaacttcgacagcttctacagcgaggtggccgagctgggcagaggcagattcagcgtggtgaagaagtgcgaccagaagggcaccaagagagccgtggccaccaagttcgtgaacaagaagctgatgaagagagaccaggtgacccacgagctgggcatcctgcagagcctgcagcaccccctgctggtgggcctgctggacaccttcgagacccccaccagctacatcctggtgctggagatggccgaccagggcagactgctggactgcgtggtgagatggggcagcctgaccgagggcaagatcagagcccacctgggcgaggtgctggaggccgtgagatacctgcacaactgcagaatcgcccacctggacctgaagcccgagaacatcctggtggacgagagcctggccaagcccaccatcaagctggccgacttcggcgacgccgtgcagctgaacaccacctactacatccaccagctgctgggcaaccccgagttcgccgcccccgagatcatcctgggcaaccccgtgagcctgaccagcgacacctggagcgtgggcgtgctgacctacgtgctgctgagcggcgtgagccccttcctggacgacagcgtggaggagacctgcctgaacatctgcagactggacttcagcttccccgacgactacttcaagggcgtgagccagaaggccaaggagttcgtgtgcttcctgctgcaggaggaccccgccaagagacccagcgccgccctggccctgcaggagcagtggctgcaggccggcaacggcagaagcaccggcgtgctggacaccagcagactgaccagcttcatcgagagaagaaagcaccagaacgacgtgagacccatcagaagcatcaagaacttcctgcagagcagactgctgcccagagtgtag

SEQ ID NO: 103629 - DNA, 768 bp, Artificial Sequence
  Description of Artificial Sequence: Synthetic coding sequence
atggccctggaggacagacccagcagcctgctggtggaccagggcgacagcagcagccccagcttcaaccccagcgacaacagcctgctgagcagcagcagccccatcgacgagatggaggagagaaagagcagcagcctgaagagaagacactacgtgctgcaggagctggtggagaccgagagagactacgtgagagacctgggctacgtggtggagggctacatggccctgatgaaggaggacggcgtgcccgacgacatgaagggcaaggacaagatcgtgttcggcaacatccaccagatctacgactggcacagagacttcttcctgggcgagctggagaagtgcctggaggaccccgagaagctgggcagcctgttcgtgaagcacgagagaagactgcacatgtacatcgcctactgccagaacaagcccaagagcgagcacatcgtgagcgagtacatcgacaccttcttcgaggacctgaagcagagactgggccacagactgcagctgaccgacctgctgatcaagcccgtgcagagaatcatgaagtaccagctgctgctgaaggacttcctgaagtacagcaagaaggccagcctggacaccagcgagctggagagagccgtggaggtgatgtgcatcgtgcccagaagatgcaacgacatgatgaacgtgggcagactgcagggcttcgacggcagagtggtggccctgtgccacagattcaaggagaccttcagagagatctgctggttctag

SEQ ID NO: 103630 - DNA, 1203 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagcccggccccagcaccaacatccccgagaacgacaccgtggacggcagagaggagaagagcgccagcgacagcagcggcaagcagagcacccaggtgatggccgccagcatgagcgccttcgaccccctgaagaaccaggacgagatcaacaagaacgtgatgagcgccttcggcctgaccgacgaccaggtgagcggcccccccagcgcccccgccgaggacagaagcggcacccccgacagcatcgccagcagcagcagcgccgcccacccccccggcgtgcagccccagcagcccccctacaccggcgcccagacccaggccggccagatcgagggccagatgtaccagcagtaccagcagcaggccggctacggcgcccagcagccccaggcccccccccagcagccccagcagtacggcatccagtacagcgccagctacagccagcagaccggcccccagcagccccagcagttccagggctacggccagcagcccaccagccaggcccccgcccccgccttcagcggccagccccagcagctgcccgcccagcccccccagcagtaccaggccagcaactaccccgcccagacctacaccgcccagaccagccagcccaccaactacaccgtggcccccgccagccagcccggcatggcccccagccagcccggcgcctaccagcccagacccggcttcaccagcctgcccggcagcaccatgacccccccccccagcggccccaacccctacgccagaaacagaccccccttcggccagggctacacccagcccggccccggctacagatag

SEQ ID NO: 103631 - DNA, 1101 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagcccggccccagcaccaacatccccgagaacgacaccgtggacggcagagaggagaagagcgccagcgacagcagcggcaagcagagcacccaggtgatggccgccagcatgagcgccttcgaccccctgaagaaccaggacgagatcaacaagaacgtgatgagcgccttcggcctgaccgacgaccaggtgagcggcccccccagcgcccccgccgaggacagaagcggcacccccgacagcatcgccagcagcagcagcgccgcccacccccccggcgtgcagccccagcagcccccctacaccggcgcccagacccaggccggccagatgtaccagcagtacagcaacagacccgccatggtgcacagcagcagaagactgcacctgagcagcctgaacagcatggtgttcagcatccagcaggccatcgtgagcagactggacctgaacaacctgagcagcagcagagacatggccagcaaccagctgcccagacaccagctgctgcccttcctggtgagcctgaacaactgcctgctgagcagacacagcagcaccagaagagccatcatcctgcacaagctgaccctgcccaagctgctgagcctgctgatcatcctgtggctgctgcccctgaacctggagtggctgcaggccaacctgggccccatcaaccaggaccaggtgctgctgcacttcctggaggtgccctag

SEQ ID NO: 103632 - DNA, 474 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagcccggccccagcaccaacatccccgagaacgacaccgtggacggcagagaggagaagagcgccagcgacagcagcggcaagcagagctag

SEQ ID NO: 103633 - DNA, 387 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagtag

SEQ ID NO: 103634 - DNA, 546 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagcccggccccagcaccaacatccccgagaacgacaccgtggacggcagagaggagaagagcgccagcgacagcagcggcaagcagagcacccaggtgatggccgccagcatgagcgccttcgaccccctgaagaaccaggacgagatcaacaagaacgtgtag

SEQ ID NO: 103635 - DNA, 1203 bp, Artificial Sequence; identical to SEQ ID NO: 103630
  Description of Artificial Sequence: Synthetic coding sequence

SEQ ID NO: 103636 - DNA, 1191 bp, Artificial Sequence
  Description of Artificial Sequence: Synthetic coding sequence
atgaacggccagctggacctgagcggcaagctgatcatcaaggcccagctgggcgaggacatcagaagaatccccatccacaacgaggacatcacctacgacgagctggtgctgatgatgcagagagtgttcagaggcaagctgctgagcaacgacgaggtgaccatcaagtacaaggacgaggacggcgacctgatcaccatcttcgacagcagcgacctgagcttcgccatccagtgcagcagaatcctgaagctgaccctgttcgtgaacggccagcccagacccctggagagcagccaggtgaagtacctgagaagagagctgatcgagctgagaaacaaggtgaacagactgctggacagcctggagccccccggcgagcccggccccagcaccaacatccccgagaacgacaccgtggacggcagagaggagaagagcgccagcgacagcagcggcaagcagagcacccaggtgatggccgccagcatgagcgccttcgaccccctgaagaaccaggacgagatcaacaagaacgtgatgagcgccttcggcctgaccgacgaccaggtgagcggcccccccagcgcccccgccgaggacagaagcggcacccccgacagcatcgccagcagcagcagcgccgcccacccccccggcgtgcagccccagcagcccccctacaccggcgcccagacccaggccggccagatgtaccagcagtaccagcagcaggccggctacggcgcccagcagccccaggcccccccccagcagccccagcagtacggcatccagtacagcgccagctacagccagcagaccggcccccagcagccccagcagttccagggctacggccagcagcccaccagccaggcccccgcccccgccttcagcggccagccccagcagctgcccgcccagcccccccagcagtaccaggccagcaactaccccgcccagacctacaccgcccagaccagccagcccaccaactacaccgtggcccccgccagccagcccggcatggcccccagccagcccggcgcctaccagcccagacccggcttcaccagcctgcccggcagcaccatgacccccccccccagcggccccaacccctacgccagaaacagaccccccttcggccagggctacacccagcccggccccggctacagatag

SEQ ID NO: 103637 - DNA, 729 bp, Artificial Sequence
  Description of Artificial Sequence: Synthetic coding sequence
atgggcgaggccagcccccccgcccccgccagaagacacctgctggtgctgctgctgctgctgagcaccctggtgatccccagcgccgccgcccccatccacgacgccgacgcccaggagagcagcctgggcctgaccggcctgcagagcctgctgcagggcttcagcagactgttcctgaagggcaacctgctgagaggcatcgacagcctgttcagcgcccccatggacttcagaggcctgcccggcaactaccacaaggaggagaaccaggagcaccagctgggcaacaacaccctgagcagccacctgcagatcgacaagatgaccgacaacaagaccggcgaggtgctgatcagcgagaacgtggtggccagcatccagcccgccgagggcagcttcgagggcgacctgaaggtgcccagaatggaggagaaggaggccctggtgcccatccagaaggccaccgacagcttccacaccgagctgcaccccagagtggccttctggatcatcaagctgcccagaagaagaagccaccaggacgccctggagggcggccactggctgagcgagaagagacacagactgcaggccatcagagacggcctgagaaagggcacccacaaggacgtgctggaggagggcaccgagagcagcagccacagcagactgagccccagaaagacccacctgctgtacatcctgagacccagcagacagctgtag

SEQ ID NO: 103638 - DNA, 1980 bp, Artificial Sequence
  Description of Artificial Sequence: Synthetic coding sequence
atgcagggcagcagcctgtggctgagcctgaccttcagaagcgccagagtgctgagcagagccagattcttcgagtggcagagccccggcctgcccaacaccgccgccatggagaacggcaccggcccctacggcgaggagagacccagagaggtgcaggagaccaccgtgaccgagggcgccgccaagatcgccttccccagcgccaacgaggtgttctacaaccccgtgcaggagttcaacagagacctgacctgcgccgtgatcaccgagttcgccagaatccagctgggcgccaagggcatccagatcaaggtgcccggcgagaaggacacccagaaggtggtggtggacctgagcgagcaggaggaggagaaggtggagctgaaggagagcgagaacctggccagcggcgaccagcccagaaccgccgccgtgggcgagatctgcgaggagggcctgcacgtgctggagggcctggccgccagcggcctgagaagcatcagattcgccctggaggtgcccggcctgagaagcgtggtggccaacgacgccagcaccagagccgtggacctgatcagaagaaacgtgcagctgaacgacgtggcccacctggtgcagcccagccaggccgacgccagaatgctgatgtaccagcaccagagagtgagcgagagattcgacgtgatcgacctggacccctacggcagccccgccaccttcctggacgccgccgtgcaggccgtgagcgagggcggcctgctgtgcgtgacctgcaccgacatggccgtgctggccggcaacagcggcgagacctgctacagcaagtacggcgccatggccctgaagagcagagcctgccacgagatggccctgagaatcgtgctgcacagcctggacctgagagccaactgctaccagagattcgtggtgcccctgctgagcatcagcgccgacttctacgtgagagtgttcgtgagagtgttcaccggccaggccaaggtgaaggccagcgccagcaagcaggccctggtgttccagtgcgtgggctgcggcgccttccacctgcagagactgggcaaggccagcggcgtgcccagcggcagagccaagttcagcgccgcctgcggcccccccgtgacccccgagtgcgagcactgcggccagagacaccagctgggcggccccatgtgggccgagcccatccacgacctggacttcgtgggcagagtgctggaggccgtgagcgccaaccccggcagattccacaccagcgagagaatcagaggcgtgctgagcgtgatcaccgaggagctgcccgacgtgcccctgtactacaccctggaccagctgagcagcaccatccactgcaacacccccagcctgctgcagctgagaagcgccctgctgcacgccgacttcagagtgagcctgagccacgcctgcaagaacgccgtgaagaccgacgcccccgccagcgccctgtgggacatcatgagatgctgggagaaggagtgccccgtgaagagagagagactgagcgagaccagccccgccttcagaatcctgagcgtggagcccagactgcaggccaacttcaccatcagagaggacgccaaccccagcagcagacagagaggcctgaagagattccaggccaaccccgaggccaactggggccccagacccagagccagacccggcggcaaggccgccgacgaggccatggaggagagaagaagactgctgcagaacaagagaaaggagccccccgaggacgtggcccagagagccgccagactgaagaccttcccctgcaagagattcaaggagggcacctgccagagaggcgaccagtgctgctacagccacagcccccccacccccagagtgagcgccgacgccgcccccgactgccccgagaccagcaaccagaccccccccggccccggcgccgccgccggccccggcatcgactag

SEQ ID NO: 103639 - DNA, 1980 bp, Artificial Sequence; identical to SEQ ID NO: 103638
  Description of Artificial Sequence: Synthetic coding sequence

SEQ ID NO: 103640 - DNA, 1878 bp, Artificial Sequence
  Description of Artificial Sequence: Synthetic coding sequence
atgagcgagaacctggacaacgagggccccaagcccatggagagctgcggccaggagagcagcagcgccctgagctgccccaccgtgagcgtgccccccgccgcccccgccgccctggaggaggtggagaaggagggcgccggcgccgccaccggccccggcccccagcccggcctgtacagctacatcagagacgacctgttcaccagcgagatcttcaagctggagctgcagaacgtgcccagacacgccagcttcagcgacgtgagaagattcctgggcagattcggcctgcagccccacaagaccaagctgttcggccagcccccctgcgccttcgtgaccttcagaagcgccgccgagagagacaaggccctgagagtgctgcacggcgccctgtggaagggcagacccctgagcgtgagactggccagacccaaggccgaccccatggccagaagaagaagacaggagggcgagagcgagccccccgtgaccagagtggccgacgtggtgacccccctgtggaccgtgccctacgccgagcagctggagagaaagcagctggagtgcgagcaggtgctgcagaagctggccaaggagatcggcagcaccaacagagccctgctgccctggctgctggagcagagacacaagcacaacaaggcctgctgccccctggagggcgtgagacccagcccccagcagaccgagtacagaaacaagtgcgagttcctggtgggcgtgggcgtggacggcgaggacaacaccgtgggctgcagactgggcaagtacaagggcggcacctgcgccgtggccgcccccttcgacaccgtgcacatccccgaggccaccaagcaggtggtgaaggccttccaggagttcatcagaagcaccccctacagcgcctacgaccccgagacctacaccggccactggaagcagctgaccgtgagaaccagcagaagacaccaggccatggccatcgcctacttccacccccagaagctgagccccgaggagctggccgagctgaagaccagcctggcccagcacttcaccgccggccccggcagagccagcggcgtgacctgcctgtacttcgtggaggagggccagagaaagacccccagccaggagggcctgcccctggagcacgtggccggcgacagatgcatccacgaggacctgctgggcctgaccttcagaatcagcccccacgccttcttccaggtgaacacccccgccgccgaggtgctgtacaccgtgatccaggactgggcccagctggacgccggcagcatggtgctggacgtgtgctgcggcaccggcaccatcggcctggccctggccagaaaggtgaagagagtgatcggcgtggagctgtgccccgaggccgtggaggacgccagagtgaacgcccaggacaacgagctgagcaacgtggagttccactgcggcagagccgaggacctggtgcccaccctggtgagcagactggccagccagcacctggtggccatcctggacccccccagagccggcctgcacagcaaggtgatcctggccatcagaagagccaagaacctgagaagactgctgtacgtgagctgcaaccccagagccgccatgggcaacttcgtggacctgtgcagagcccccagcaacagagtgaagggcatccccttcagacccgtgaaggccgtggccgtggacctgttcccccagaccccccactgcgagatgctgatcctgttcgagagagtggagcaccccaacggcaccggcgtgctgggcccccacagcccccccgcccagcccacccccggcccccccgacaacaccctgcaggagaccggcaccttccccagcagctag

SEQ ID NO: 103641 - DNA, 1878 bp, Artificial Sequence; identical to SEQ ID NO: 103640
  Description of Artificial Sequence: Synthetic coding sequence

SEQ ID NO: 103642 - DNA, 1689 bp, Artificial Sequence
  Description of Artificial Sequence: Synthetic coding sequence
atgagcgagaacctggacaacgagggccccaagcccatggagagctgcggccaggagagcagcagcgccctgagctgccccaccgtgagcgtgccccccgccgcccccgccgccctggaggaggtggagaaggagggcgccggcgccgccaccggccccggcccccagcccggcctgtacagctacatcagagacgacctgttcaccagcgagatcttcaagctggagctgcagaacgtgcccagacacgccagcttcagcgacgtgagaagattcctgggcagattcggcctgcagccccacaagaccaagctgttcggccagcccccctgcgccttcgtgaccttcagaagcgccgccgagagagacaaggccctgagagtgctgcacggcgccctgtggaagggcagacccctgagcgtgagactggccagacccaaggccgaccccatggccagaagaagaagacaggagggcgagagcgagccccccgtgaccagagtggccgacgtggtgacccccctgtggaccgtgccctacgccgagcagctggagagaaagcagctggagtgcgagcaggtgctgcagaagctggccaaggagatcggcagcaccaacagagccctgctgccctggctgctggagcagagacacaagcacaacaaggcctgctgccccctggagggcgtgagacccagcccccagcagaccgagtacagaaacaagtgcgagttcctggtgggcgtgggcgtggacggcgaggacaacaccgtgggctgcagactgggcaagtacaagggcggcacctgcgccgtggccgcccccttcgacaccgtgcacatccccgaggccaccaagcaggtggtgaaggccttccaggagttcatcagaagcaccccctacagcgcctacgaccccgagacctacaccggccactggaagcagctgaccgtgagaaccagcagaagacaccaggccatggccatcgcctacttccacccccagaagctgagccccgaggagctggccgagctgaagaccagcctggcccagcacttcaccgccggccccggcagagccagcggcgtgacctgcctgtacttcgtggaggagggccagagaaagacccccagccaggagggcctgcccctggagcacgtggccggcgacagatgcatccacgaggacctgctgggcctgaccttcagaatcagcccccacgccttcttccaggtgaacacccccgccgccgaggtgctgtacaccgtgatccaggactgggcccagctggacgccggcagcatggtgctggacgtgtgctgcggcaccggcaccatcggcctggccctggccagaaaggtgaagagagtgatcggcgtggagctgtgccccgaggccgtggaggacgccagagtgaacgcccaggacaacgagctgagcaacgtggagttccactgcggcagagccgaggacctggtgcccaccctggtgagcagactggccagccagcacctggtggccatcctggacccccccagagccggcctgcacagcaaggtgatcctggccatcagaagagccaagaacctgagaagactgctgtacgtgagctgcaaccccagagccgccatgggcaacttcgtggacgcccccctgttccccccccagcccctgcagagccccatctag

SEQ ID NO: 103643 - DNA, 1530 bp, Artificial Sequence
  Description of Artificial Sequence: Synthetic coding sequence
atggtgctgtggatcctgtggagacccttcggcttcagcggcagattcctgaagctggagagccacagcatcaccgagagcaagagcctgatccccgtggcctggaccagcctgacccagatgctgctggaggcccccggcatcttcctgctgggccagagaaagagattcagcaccatgcccgagaccgagacccacgagagagagaccgagctgttcagcccccccagcgacgtgagaggcatgaccaagctggacagaaccgccttcaagaagaccgtgaacatccccgtgctgaaggtgagaaaggagatcgtgagcaagctgatgagaagcctgaagagagccgccctgcagagacccggcatcagaagagtgatcgaggaccccgaggacaaggagagcagactgatcatgctggacccctacaagatcttcacccacgacagcttcgagaaggccgagctgagcgtgctggagcagctgaacgtgagcccccagatcagcaagtacaacctggagctgacctacgagcacttcaagagcgaggagatcctgagagccgtgctgcccgagggccaggacgtgaccagcggcttcagcagaatcggccacatcgcccacctgaacctgagagaccaccagctgagcttcaagcacctgatcggccaggtgatgatcgacaagaaccccggcatcaccagcgccgtgaacaagatcaacaacatcgacaacatgtacagaaacttccagatggaggtgctgagcggcgagcagaacatgatgaccaaggtgagagagaacaactacacctacgagttcgacttcagcaaggtgtactggaaccccagactgagcaccgagcacagcagaatcaccgagctgctgaagcccggcgacgtgctgttcgacgtgttcgccggcgtgggccccttcgccatccccgtggccaagaagaactgcaccgtgttcgccaacgacctgaaccccgagagccacaagtggctgctgtacaactgcaagctgaacaaggtggaccagaaggtgaaggtgttcaacctggacggcaaggacttcctgcagggccccgtgaaggaggagctgatgcagctgctgggcctgagcaaggagagaaagcccagcgtgcacgtggtgatgaacctgcccgccaaggccatcgagttcctgagcgccttcaagtggctgctggacggccagccctgcagcagcgagttcctgcccatcgtgcactgctacagcttcagcaaggacgccaaccccgccgaggacgtgagacagagagccggcgccgtgctgggcatcagcctggaggcctgcagcagcgtgcacctggtgagaaacgtggcccccaacaaggagatgctgtgcatcaccttccagatccccgccagcgtgctgtacaagaaccagaccagaaaccccgagaaccacgaggacccccccctgaagagacagagaaccgccgaggccttcagcgacgagaagacccagatcgtgagcaacacctag

SEQ ID NO: 103644 - DNA, 1266 bp, Artificial Sequence
  Description of Artificial Sequence: Synthetic coding sequence
atgcaggccctgagacacgtggtgtgcgccctgagcggcggcgtggacagcgccgtggccgccctgctgctgagaagaagaggctaccaggtgaccggcgtgttcatgaagaactgggacagcctggacgagcacggcgtgtgcaccgccgacaaggactgcgaggacgcctacagagtgtgccagatcctggacatccccttccaccaggtgagctacgtgaaggagtactggaacgacgtgttcagcgacttcctgaacgagtacgagaagggcagaacccccaaccccgacatcgtgtgcaacaagcacatcaagttcagctgcttcttccactacgccgtggacaacctgggcgccgacgccatcgccaccggccactacgccagaaccagcctggaggacgaggaggtgttcgagcagaagcacgtgaagaagcccgagggcctgttcagaaacagattcgaggtgagaaacgccgtgaagctgctgcaggccgccgacagcttcaaggaccagaccttcttcctgagccaggtgagccaggacgccctgagaagaaccatcttccccctgggcggcctgaccaaggagttcgtgaagaagatcgccgccgagaacagactgcaccacgtgctgcagaagaaggagagcatgggcatgtgcttcatcggcaagagaaacttcgagcacttcctgctgcagtacctgcagcccagacccggccacttcatcagcatcgaggacaacaaggtgctgggcacccacaagggctggttcctgtacaccctgggccagagagccaacatcggcggcctgagagagccctggtacgtggtggagaaggacagcgtgaagggcgacgtgttcgtggcccccagaaccgaccaccccgccctgtacagagacctgctgagaaccagcagagtgcactggatcgccgaggagccccccgccgccctggtgagagacaagatgatggagtgccacttcagattcagacaccagatggccctggtgccctgcgtgctgaccctgaaccaggacggcaccgtgtgggtgaccgccgtgcaggccgtgagagccctggccaccggccagttcgccgtgttctacaagggcgacgagtgcctgggcagcggcaagatcctgagactgggccccagcgcctacaccctgcagaagggccagagaagagccggcatggccaccgagagccccagcgacagccccgaggacggccccggcctgagccccctgctgtag

SEQ ID NO: 103645 - DNA, 300 bp, Artificial Sequence
  Description of Artificial Sequence: Synthetic coding sequence
atgcaggccctgagacacgtggtgtgcgccctgagcggcggcgtggacagcgccgtggccgccctgctgctgagaagaagaggctaccaggtgaccggcgtgttcatgaagaactgggacagcctggacgagcacggcgtgtgcaccgccgacaaggactgcgaggacgcctacagagtgtgccagatcctggacatccccttccaccaggtgagctacgtgaaggagtactggaacgacgtgttcagaggcagatgccactgccacagaagcctgtgcaagaacttccccggcagatag

SEQ ID NO: 103646 - DNA, 396 bp, Artificial Sequence
  Description of Artificial Sequence: Synthetic coding sequence
atgaagaactgggacagcctggacgagcacggcgtgtgcaccgccgacaaggactgcgaggacgcctacagagtgtgccagatcctggacatccccttccaccaggtgagctacgtgaaggagtactggaacgacgtgttcagcgacttcctgaacgagtacgagaagggcagaacccccaaccccgacatcgtgtgcaacaagcacatcaagttcagctgcttcttccactacgccgtggacaacctgggcgccgacgccatcgccaccggccactacgccagaaccagcctggaggacgaggaggtgttcgagcagaagcacgtgaagaagcccgagggcctgttcagaaacagattcgaggtgagaaacgccagattccccagaatgccctag

SEQ ID NO: 103647 - DNA, 300 bp, Artificial Sequence; identical to SEQ ID NO: 103645
  Description of Artificial Sequence: Synthetic coding sequence

SEQ ID NO: 103648 - DNA, 300 bp, Artificial Sequence; identical to SEQ ID NO: 103645
  Description of Artificial Sequence: Synthetic coding sequence

SEQ ID NO: 103649 - DNA, 300 bp, Artificial Sequence; identical to SEQ ID NO: 103645
  Description of Artificial Sequence: Synthetic coding sequence

SEQ ID NO: 103650 - DNA, 501 bp, Artificial Sequence
  Description of Artificial Sequence: Synthetic coding sequence
atgcaggccctgagacacgtggtgtgcgccctgagcggcggcgtggacagcgccgtggccgccctgctgctgagaagaagaggctaccaggtgaccggcgtgttcatgaagaactgggacagcctggacgagcacggcgtgtgcaccgccgacaaggactgcgaggacgcctacagagtgtgccagatcctggacatccccttccaccaggtgagctacgtgaaggagtactggaacgacgtgttcagcgacttcctgaacgagtacgagaagggcagaacccccaaccccgacatcgtgtgcaacaagcacatcaagttcagctgcttcttccactacgccgtggacaacctgggcgccgacgccatcgccaccggccactacgccagaaccagcctggaggacgaggaggtgttcgagcagaagcacgtgaagaagcccgagggcctgttcagaaacagattcgaggtgagaaacgccagattccccagaatgccctag

SEQ ID NO: 103651 - DNA, 1038 bp, Artificial Sequence
  Description of Artificial Sequence: Synthetic coding sequence
atggagcccctgagagtgctggagctgtacagcggcgtgggcggcatgcaccacgccctgagagagagctgcatccccgcccaggtggtggccgccatcgacgtgaacaccgtggccaacgaggtgtacaagtacaacttcccccacacccagctgctggccaagaccatcgagggcatcaccctggaggagttcgacagactgagcttcgacatgatcctgatgagccccccctgccagcccttcaccagagacctgctgatccagaccatcgagaactgcggcttccagtaccaggagttcctgctgagccccaccagcctgggcatccccaacagcagactgagatacttcctgatcgccaagctgcagagcgagcccctgcccttccaggcccccggccaggtgctgatggagttccccaagatcgagagcgtgcacccccagaagtacgccatggacgtggagaacaagatccaggagaagaacgtggagcccaacatcagcttcgacggcagcatccagtgcagcggcaaggacgccatcctgttcaagctggagaccgccgaggagatccacagaaagaaccagcaggacagcgacctgagcgtgaagatgctgaaggacttcctggaggacgacaccgacgtgaaccagtacctgctgccccccaagagcctgctgagatacgccctgctgctggacatcgtgcagcccacctgcagaagaagcgtgtgcttcaccaagggctacggcagctacatcgagggcaccggcagcgtgctgcagaccgccgaggacgtgcaggtggagaacatctacaagagcctgaccaacctgagccaggaggagcagatcaccaagctgctgatcctgaagctgagatacttcacccccaaggagatcgccaacctgctgggcttcccccccgagttcggcttccccgagaagatcaccgtgaagcagagatacagactgctgggcaacagcctgaacgtgcacgtggtggccaagctgatcaagatcctgtacgagtag

SEQ ID NO: 103652 - DNA, 216 bp, Artificial Sequence
  Description of Artificial Sequence: Synthetic coding sequence
atggagcccctgagagtgctggagctgtacagcggcgtgggcggcatgcaccacgccctgagagagagctgcatccccgcccaggtggtggccgccatcgacgtgaacaccgtggccaacgaggtgtacaagtacaacttcccccacacccagctgctggccaagaccatcgagatcaccaagatcaccaaggtgtacagcttcggcaagtgctag

SEQ ID NO: 103653 - DNA, 354 bp, Artificial Sequence
  Description of Artificial Sequence: Synthetic coding sequence
atggagcccctgagagtgctggagctgtacagcggcgtgggcggcatgcaccacgccctgagagagagctgcatccccgcccaggtggtggccgccatcgacgtgaacaccgtggccaacgaggtgtacaagtacaacttcccccacacccagctgctggccaagaccatcgagagacccctggacaccaacaacagaaagctgtggctgagcgtgcccagagtgagcatcatcagcaacctgagctggcacagcaagttcaaggccaccatcttcagctactgcaaggccagcgtgagagccatcaccctgagcagcccctggagcggcaccgacggcgtgccccagaactag

SEQ ID NO: 103654 - DNA, 1176 bp, Artificial Sequence
  Description of Artificial Sequence: Synthetic coding sequence
atggagcccctgagagtgctggagctgtacagcggcgtgggcggcatgcaccacgccctgagagagagctgcatccccgcccaggtggtggccgccatcgacgtgaacaccgtggccaacgaggtgtacaagtacaacttcccccacacccagctgctggccaagaccatcgagggcatcaccctggaggagttcgacagactgagcttcgacatgatcctgatgagccccccctgccagcccttcaccagaatcggcagacagggcgacatgaccgacagcagaaccaacagcttcctgcacatcctggacatcctgcccagactgcagaagctgcccaagtacatcctgctggagaacgtgaagggcttcgaggtgagcagcaccagagacctgctgatccagaccatcgagaactgcggcttccagtaccaggagttcctgctgagccccaccagcctgggcatccccaacagcagactgagatacttcctgatcgccaagctgcagagcgagcccctgcccttccaggcccccggccaggtgctgatggagttccccaagatcgagagcgtgcacccccagaagtacgccatggacgtggagaacaagatccaggagaagaacgtggagcccaacatcagcttcgacggcagcatccagtgcagcggcaaggacgccatcctgttcaagctggagaccgccgaggagatccacagaaagaaccagcaggacagcgacctgagcgtgaagatgctgaaggacttcctggaggacgacaccgacgtgaaccagtacctgctgccccccaagagcctgctgagatacgccctgctgctggacatcgtgcagcccacctgcagaagaagcgtgtgcttcaccaagggctacggcagctacatcgagggcaccggcagcgtgctgcagaccgccgaggacgtgcaggtggagaacatctacaagagcctgaccaacctgagccaggaggagcagatcaccaagctgctgatcctgaagctgagatacttcacccccaaggagatcgccaacctgctgggcttcccccccgagttcggcttccccgagaagatcaccgtgaagcagagatacagactgctgggcaacagcctgaacgtgcacgtggtggccaagctgatcaagatcctgtacgagtag

SEQ ID NO: 103655 - DNA, 1104 bp, Artificial Sequence
  Description of Artificial Sequence: Synthetic coding sequence
atggagcccctgagagtgctggagctgtacagcggcgtgggcggcatgcaccacgccctgagagagagctgcatccccgcccaggtggtggccgccatcgacgtgaacaccgtggccaacgaggtgtacaagtacaacttcccccacacccagctgctggccaagaccatcgagggcatcaccctggaggagttcgacagactgagcttcgacatgatcctgatgagccccccctgccagcccttcaccagactgcagaagctgcccaagtacatcctgctggagaacgtgaagggcttcgaggtgagcagcaccagagacctgctgatccagaccatcgagaactgcggcttccagtaccaggagttcctgctgagccccaccagcctgggcatccccaacagcagactgagatacttcctgatcgccaagctgcagagcgagcccctgcccttccaggcccccggccaggtgctgatggagttccccaagatcgagagcgtgcacccccagaagtacgccatggacgtggagaacaagatccaggagaagaacgtggagcccaacatcagcttcgacggcagcatccagtgcagcggcaaggacgccatcctgttcaagctggagaccgccgaggagatccacagaaagaaccagcaggacagcgacctgagcgtgaagatgctgaaggacttcctggaggacgacaccgacgtgaaccagtacctgctgccccccaagagcctgctgagatacgccctgctgctggacatcgtgcagcccacctgcagaagaagcgtgtgcttcaccaagggctacggcagctacatcgagggcaccggcagcgtgctgcagaccgccgaggacgtgcaggtggagaacatctacaagagcctgaccaacctgagccaggaggagcagatcaccaagctgctgatcctgaagctgagatacttcacccccaaggagatcgccaacctgctgggcttcccccccgagttcggcttccccgagaagatcaccgtgaagcagagatacagactgctgggcaacagcctgaacgtgcacgtggtggccaagctgatcaagatcctgtacgagtag

SEQ ID NO: 103656 - DNA, 933 bp, Artificial Sequence
  Description of Artificial Sequence: Synthetic coding sequence
atgagcaccctgagcctgatgaagtacaccagcatcatcttcctgacccacagctacctgcccagaagactgaagatcggcagacagggcgacatgaccgacagcagaaccaacagcttcctgcacatcctggacatcctgcccagagacctgctgatccagaccatcgagaactgcggcttccagtaccaggagttcctgctgagccccaccagcctgggcatccccaacagcagactgagatacttcctgatcgccaagctgcagagcgagcccctgcccttccaggcccccggccaggtgctgatggagttccccaagatcgagagcgtgcacccccagaagtacgccatggacgtggagaacaagatccaggagaagaacgtggagcccaacatcagcttcgacggcagcatccagtgcagcggcaaggacgccatcctgttcaagctggagaccgccgaggagatccacagaaagaaccagcaggacagcgacctgagcgtgaagatgctgaaggacttcctggaggacgacaccgacgtgaaccagtacctgctgccccccaagagcctgctgagatacgccctgctgctggacatcgtgcagcccacctgcagaagaagcgtgtgcttcaccaagggctacggcagctacatcgagggcaccggcagcgtgctgcagaccgccgaggacgtgcaggtggagaacatctacaagagcctgaccaacctgagccaggaggagcagatcaccaagctgctgatcctgaagctgagatacttcacccccaaggagatcgccaacctgctgggcttcccccccgagttcggcttccccgagaagatcaccgtgaagcagagatacagactgctgggcaacagcctgaacgtgcacgtggtggccaagctgatcaagatcctgtacgagtag

SEQ ID NO: 103657 - DNA, 1305 bp, Artificial Sequence
  Description of Artificial Sequence: Synthetic coding sequence
atgctgagatgcctgtaccactggcacagacccgtgctgaacagaagatggagcagactgtgcctgcccaagcagtacctgttcaccatgaagctgcagagccccgagttccagagcctgttcaccgagggcctgaagagcctgaccgagctgttcgtgaaggagaaccacgagctgagaatcgccggcggcgccgtgagagacctgctgaacggcgtgaagccccaggacatcgacttcgccaccaccgccacccccacccagatgaaggagatgttccagagcgccggcatcagaatgatcaacaacagaggcgagaagcacggcaccatcaccgccagactgcacgaggagaacttcgagatcaccaccctgagaatcgacgtgaccaccgacggcagacacgccgaggtggagttcaccaccgactggcagaaggacgccgagagaagagacctgaccatcaacagcatgttcctgggcttcgacggcaccctgttcgactacttcaacggctacgaggacctgaagaacaagaaggtgagattcgtgggccacgccaagcagagaatccaggaggactacctgagaatcctgagatacttcagattctacggcagaatcgtggacaagcccggcgaccacgaccccgagaccctggaggccatcgccgagaacgccaagggcctggccggcatcagcggcgagagaatctgggtggagctgaagaagatcctggtgggcaaccacgtgaaccacctgatccacctgatctacgacctggacgtggccccctacatcggcctgcccgccaacgccagcctggaggagttcgacaaggtgagcaagaacgtggacggcttcagccccaagcccgtgaccctgctggccagcctgttcaaggtgcaggacgacgtgaccaagctggacctgagactgaagatcgccaaggaggagaagaacctgggcctgttcatcgtgaagaacagaaaggacctgatcaaggccaccgacagcagcgaccccctgaagccctaccaggacttcatcatcgacagcagagagcccgacgccaccaccagagtgtgcgagctgctgaagtaccagggcgagcactgcctgctgaaggagatgcagcagtggagcatcccccccttccccgtgagcggccacgacatcagaaaggtgggcatcagcagcggcaaggagatcggcgccctgctgcagcagctgagagagcagtggaagaagagcggctaccagatggagaaggacgagctgctgagctacatcaagaagacctag

SEQ ID NO: 103658 - DNA, 1245 bp, Artificial Sequence
  Description of Artificial Sequence: Synthetic coding sequence
atgctgagatgcctgtaccactggcacagacccgtgctgaacagaagatggagcagactgtgcctgcccaagcagtacctgttcaccatgaagctgcagagccccgagttccagagcctgttcaccgagggcctgaagagcctgaccgagctgttcgtgaaggagaaccacgagctgagaatcgccggcggcgccgtgagagacctgctgaacggcgtgaagccccaggacatcgacttcgccaccaccgccacccccacccagatgaaggagatgttccagagcgccggcatcagaatgatcaacaacagaggcgagaagcacggcaccatcaccgccagactgcacgaggagaacttcgagatcaccaccctgagaatcgacgtgaccaccgacggcagacacgccgaggtggagttcaccaccgactggcagaaggacgccgagagaagagacctgaccatcaacagcatgttcctgggcttcgacggcaccctgttcgactacttcaacggctacgaggacctgaagaacaagaaggtgagattcgtgggccacgccaagcagagaatccaggaggactacctgagaatcctgagatacttcagattctacggcagaatcgtggacaagcccggcgaccacgaccccgagaccctggaggccatcgccgagaacgccaagggcctggccggcatcagcggcgagagaatctgggtggagctgaagaagatcctggtgggcctgcccgccaacgccagcctggaggagttcgacaaggtgagcaagaacgtggacggcttcagccccaagcccgtgaccctgctggccagcctgttcaaggtgcaggacgacgtgaccaagctggacctgagactgaagatcgccaaggaggagaagaacctgggcctgttcatcgtgaagaacagaaaggacctgatcaaggccaccgacagcagcgaccccctgaagccctaccaggacttcatcatcgacagcagagagcccgacgccaccaccagagtgtgcgagctgctgaagtaccagggcgagcactgcctgctgaaggagatgcagcagtggagcatcccccccttccccgtgagcggccacgacatcagaaaggtgggcatcagcagcggcaaggagatcggcgccctgctgcagcagctgagagagcagtggaagaagagcggctaccagatggagaaggacgagctgctgagctacatcaagaagacctag

SEQ ID NO: 103659 - DNA, 174 bp, Artificial Sequence
  Description of Artificial Sequence: Synthetic coding sequence
atgctgagatgcctgtaccactggcacagacccgtgctgaacagaagatggagcagactgtgcctgcccaagcagtacctgttcaccatgaagctgcagagccccgagttccagagcctgttcaccgagggcctgaagagcctgaccggcatcaacgccttccacgagaactag

SEQ ID NO: 103660 - DNA, 174 bp, Artificial Sequence; identical to SEQ ID NO: 103659
  Description of Artificial Sequence: Synthetic coding sequence

SEQ ID NO: 103661 - DNA, 189 bp, Artificial Sequence
  Description of Artificial Sequence: Synthetic coding sequence
atgctgagatgcctgtaccactggcacagacccgtgctgaacagaagatggagcagactgtgcctgcccaagcagtacctgttcaccatgaagctgcagagccccgagttccagagcctgttcaccgagggcctgaagagcctgaccgagctgttcgtgaaggagaaccacgagctgagaatcgcctag

SEQ ID NO: 103662 - DNA, 174 bp, Artificial Sequence; identical to SEQ ID NO: 103659
  Description of Artificial Sequence: Synthetic coding sequence

SEQ ID NO: 103663 - DNA, 1305 bp, Artificial Sequence; identical to SEQ ID NO: 103657
  Description of Artificial Sequence: Synthetic coding sequence

SEQ ID NO: 103664 - DNA, 762 bp, Artificial Sequence
  Description of Artificial Sequence: Synthetic coding sequence
atgaacttcagcggcggcggcagacaggaggccgccggcagcagaggcagaagagcccccagacccagagagcaggacagagacgtgcagctgagcaaggccctgagctacgccctgagacacggcgccctgaagctgggcctgcccatgggcgccgacggcttcgtgcccctgggcaccctgctgcagctgccccagttcagaggcttcagcgccgaggacgtgcagagagtggtggacaccaacagaaagcagagattcgccctgcagctgggcgaccccagcaccggcctgctgatcagagccaaccagggccacagcctgcaggtgcccaagctggagctgatgcccctggagaccccccaggccctgccccccatgctggtgcacggcaccttctggaagcactggcccagcatcctgctgaagggcctgagctgccagggcagaacccacatccacctggcccccggcctgcccggcgaccccggcatcatcagcggcatgagaagccactgcgagatcgccgtgttcatcgacggccccctggccctggccgacggcatccccttcttcagaagcgccaacggcgtgatcctgacccccggcaacaccgacggcttcctgctgcccaagtacttcaaggaggccctgcagctgagacccaccagaaagcccctgagcctggccggcgacgaggagaccgagtgccagagcagccccaagcacagcagcagagagagaagaagaatccagcagtag

SEQ ID NO: 103665 - DNA, 768 bp, Artificial Sequence
  Description of Artificial Sequence: Synthetic coding sequence
atgaacttcagcggcggcggcagacaggaggccgccggcagcagaggcagaagagcccccagacccagagagcaggacagagacgtgcagctgagcaaggccctgagctacgccctgagacacggcgccctgaagctgggcctgcccatgggcgccgacggcttcgtgcccctgggcaccctgctgcagctgccccagttcagaggcttcagcgccgaggacgtgcagagagtggtggacaccaacagaaagcagagattcgccctgcagctgggcgaccccagcaccggcctgctgatcagagccaaccagggccacagcctgcaggtgggcgtgcccaagctggagctgatgcccctggagaccccccaggccctgccccccatgctggtgcacggcaccttctggaagcactggcccagcatcctgctgaagggcctgagctgccagggcagaacccacatccacctggcccccggcctgcccggcgaccccggcatcatcagcggcatgagaagccactgcgagatcgccgtgttcatcgacggccccctggccctggccgacggcatccccttcttcagaagcgccaacggcgtgatcctgacccccggcaacaccgacggcttcctgctgcccaagtacttcaaggaggccctgcagctgagacccaccagaaagcccctgagcctggccggcgacgaggagaccgagtgccagagcagccccaagcacagcagcagagagagaagaagaatccagcagtag

SEQ ID NO: 103666 - DNA, 615 bp, Artificial Sequence
  Description of Artificial Sequence: Synthetic coding sequence
atgggcgccgacggcttcgtgcccctgggcaccctgctgcagctgccccagttcagaggcttcagcgccgaggacgtgcagagagtggtggacaccaacagaaagcagagattcgccctgcagctgggcgaccccagcaccggcctgctgatcagagccaaccagggccacagcctgcaggtgcccaagctggagctgatgcccctggagaccccccaggccctgccccccatgctggtgcacggcaccttctggaagcactggcccagcatcctgctgaagggcctgagctgccagggcagaacccacatccacctggcccccggcctgcccggcgaccccggcatcatcagcggcatgagaagccactgcgagatcgccgtgttcatcgacggccccctggccctggccgacggcatccccttcttcagaagcgccaacggcgtgatcctgacccccggcaacaccgacggcttcctgctgcccaagtacttcaaggaggccctgcagctgagacccaccagaaagcccctgagcctggccggcgacgaggagaccgagtgccagagcagccccaagcacagcagcagagagagaagaagaatccagcagtag

SEQ ID NO: 103667 - DNA, 651 bp, Artificial Sequence
  Description of Artificial Sequence: Synthetic coding sequence
atgaacttcagcggcggcggcagacaggaggccgccggcagcagaggcagaagagcccccagacccagagagcaggacagagacgtgcagctgagcaaggccctgagctacgccctgagacacggcgccctgaagctgggcctgcccatgggcgccgacggcttcgtgcccctgggcaccctgctgcagctgccccagttcagaggcttcagcgccgaggacgtgcagagagtggtggacaccaacagaaagcagagattcgccctgcagctgggcgaccccagcaccggcctgctgatcagagccaaccagggccacagcctgcaggtgcccaagctggagctgatgcccctggagaccccccaggccctgccccccatgctggtgcacggcaccttctggaagcactggcccagcatcctgctgaagggcctgagctgccagggcagaacccacatccacctggcccccggcctgcccggcgaccccggcatcatcagcggcatgagaagccactgcgagatcgccgtgttcatcgacggccccctggccctggccggcaagcccctgagcctggccggcgacgaggagaccgagtgccagagcagccccaagcacagcagcagagagagaagaagaatccagcagtag

SEQ ID NO: 103668 - DNA, 504 bp, Artificial Sequence
  Description of Artificial Sequence: Synthetic coding sequence
atgggcgccgacggcttcgtgcccctgggcaccctgctgcagctgccccagttcagaggcttcagcgccgaggacgtgcagagagtggtggacaccaacagaaagcagagattcgccctgcagctgggcgaccccagcaccggcctgctgatcagagccaaccagggccacagcctgcaggtgcccaagctggagctgatgcccctggagaccccccaggccctgccccccatgctggtgcacggcaccttctggaagcactggcccagcatcctgctgaagggcctgagctgccagggcagaacccacatccacctggcccccggcctgcccggcgaccccggcatcatcagcggcatgagaagccactgcgagatcgccgtgttcatcgacggccccctggccctggccggcaagcccctgagcctggccggcgacgaggagaccgagtgccagagcagccccaagcacagcagcagagagagaagaagaatccagcagtag

SEQ ID NO: 103669 - DNA, 516 bp, Artificial Sequence
  Description of Artificial Sequence: Synthetic coding sequence
atggaggagagaggcgacagcgagcccacccccggctgcagcggcctgggccccggcggcgtgagaggcttcggcgacggcggcggcgcccccagctgggcccccgaggacgcctggatgggcacccaccccaagtacctggagatgatggagctggacatcggcgacgccacccaggtgtacgtggccttcctggtgtacctggacctgatggagagcaagagctggcacgaggtgaactgcgtgggcctgcccgagctgcagctgatctgcctggtgggcaccgagatcgagggcgagggcctgcagaccgtggtgcccacccccatcaccgccagcctgagccacaacagaatcagagagatcctgaaggccagcagaaagctgcagggcgaccccgacctgcccatgagcttcaccctggccatcgtggagagcgacagcaccatcgtgtactacaagctgaccgacggcttcatgctgcccgacccccagaacatcagcctgagaagatag

SEQ ID NO: 103670 - DNA, 390 bp, Artificial Sequence
  Description of Artificial Sequence: Synthetic coding sequence
atggaggagagaggcgacagcgagcccacccccggctgcagcggcctgggccccggcggcgtgagaggcttcggcgacggcggcggcgcccccagctgggcccccgaggacgcctggatgggcacccaccccaagtacctggagatgatggagctggacatcggcgacgccacccaggtgtacgtggccttcctggtgtacctggacctgatggagagcaagagctggcacgaggtgaactgcgtgggcctgcccgagctgcagctgatctgcctggtgggcaccgagatcgagggcgagggcctgcagaccgtggtgcccacccccatcaccgccagcctgagccacaacagaatcttcctgctggaggacgacatccacgtgagctag

SEQ ID NO: 103671 - DNA, 1398 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggagctggtgcagagaaacagactgatctgcagaagaaacccctacagaatcttcgagtacctgcagctgagcctggaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggagctgatgctgtgctacctgatcaagcccagcaccatgaccgacaaggagatggagagccccgagtgcatgaagagaatcaaggtgcaggaggtgatcctgagcagatgggtgagcagcagagagagaagcgaccaggacgacctgtag

SEQ ID NO: 103672 - DNA, 1320 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggagctgatgctgtgctacctgatcaagcccagcaccatgaccgacaaggagatggagagccccgagtgcatgaagagaatcaaggtgcaggaggtgatcctgagcagatgggtgagcagcagagagagaagcgaccaggacgacctgtag

SEQ ID NO: 103673 - DNA, 1347 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggagctggtgcagagaaacagactgatctgcagaagaaacccctacagaatcttcgagtacctgcagctgagcctggaggaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggagctgatgctgtgctacctgatcaagcccagcaccatgaccgacaaggagatggagagccccgagtgcatgaagagaatcaaggtgcaggaggtgatcctgagcagatgggtgagcagcagagagagaagcgaccaggacgacctgtag

SEQ ID NO: 103674 - DNA, 1398 bp, Artificial Sequence; identical to SEQ ID NO: 103671
  Description of Artificial Sequence: Synthetic coding sequence

SEQ ID NO: 103675 - DNA, 1320 bp, Artificial Sequence; identical to SEQ ID NO: 103672
  Description of Artificial Sequence: Synthetic coding sequence

SEQ ID NO: 103676 - DNA, 1209 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggtgacccagcaccagctgtgccactggagcgtgacctag

SEQ ID NO: 103677 - DNA, 1137 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggagctggtgcagagaaacagactgatctgcagaagaaacccctacagaatcttcgagtacctgcagctgagcctggaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgcctag

SEQ ID NO: 103678 - DNA, 1317 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtggtgaacggcgacagcggcaagagcggcggcgtgggcgaccccagagagcccctgggctgcctgcaggagggcagcggctgccaccccaccaccgagagcttcgagaagagcgtgagagaggacgccagccccctgccccacgtgtgctgctgcaagcaggacgccctgatcctgcagagaggcctgcaccacgaggacggcagccagcacatcggcctgctgcaccccggcgacagaggccccgaccacgagtacgtgctggtggaggaggccgagtgcgccatgagcgagagagaggccgcccccaacgaggagctggtgcagagaaacagactgatctgcagaagaaacccctacagaatcttcgagtacctgcagctgagcctggaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggagctgatgctgtgctacctgatcaagcccagcaccatgaccgacaaggagatggagagccccgagtgcatgaagagaatcaaggtgcaggaggtgatcctgagcagatgggtgagcagcagagagagaagcgaccaggacgacctgtag

SEQ ID NO: 103679 - DNA, 1221 bp, Artificial Sequence
  Description of Artificial Sequence: Synthetic coding sequence
atggccgaggccgtgttccacgcccccaagagaaagagaagagtgtacgagacctacgagagccccctgcccatccccttcggccaggaccacggccccctgaaggagttcaagatcttcagagccgagatgatcaacaacaacgtgatcgtgagaaacgccgaggacatcgagcagctgtacggcaagggctacttcggcaagggcatcctgagcagaagcagacccagcttcaccatcagcgaccccaagctggtggccaagtggaaggacatgaagaccaacatgcccatcatcaccagcaagagataccagcacagcgtggagtgggccgccgagctgatgagaagacagggccaggacgagagcaccgtgagaagaatcctgaaggactacaccaagcccctggagcacccccccgtgaagagaaacgaggaggcccaggtgcacgacaagctgaacagcggcatggtgagcaacatggagggcaccgccggcggcgagagacccagcgtgagaggcctgcaccacgaggacggcagccagcacatcggcctgctgcaccccggcgacagaggccccgaccacgagtacgtgctggtggaggaggccgagtgcgccatgagcgagagagaggccgcccccaacgaggagctggtgcagagaaacagactgatctgcagaagaaacccctacagaatcttcgagtacctgcagctgagcctggaggaggccttcttcctggtgtacgccctgggctgcctgagcatctactacgagaaggagcccctgaccatcgtgaagctgtggaaggccttcaccgtggtgcagcccaccttcagaaccacctacatggcctaccactacttcagaagcaagggctgggtgcccaaggtgggcctgaagtacggcaccgacctgctgctgtacagaaagggcccccccttctaccacgccagctacagcgtgatcatcgagctggtggacgaccacttcgagggcagcctgagaagacccctgagctggaagagcctggccgccctgagcagagtgagcgtgaacgtgagcaaggagctgatgctgtgctacctgatcaagcccagcaccatgaccgacaaggagatggagagccccgagtgcatgaagagaatcaaggtgcaggaggtgatcctgagcagatgggtgagcagcagagagagaagcgaccaggacgacctgtag

SEQ ID NO: 103680 - DNA, 933 bp, Artificial Sequence
  Description of Artificial Sequence: Synthetic coding sequence
atgctggtggtggaggtggccaacggcagaagcctggtgtggggcgccgaggccgtgcaggccctgagagagagactgggcgtgggcggcagaaccgtgggcgccctgcccagaggccccagacagaacagcagactgggcctgcccctgctgctgatgcccgaggaggccagactgctggccgagatcggcgccgtgaccctggtgagcgcccccagacccgacagcagacaccacagcctggccctgaccagcttcaagagacagcaggaggagagcttccaggagcagagcgccctggccgccgaggccagagagaccagaagacaggagctgctggagaagatcaccgagggccaggccgccaagaagcagaagctggagcaggccagcggcgccagcagcagccaggaggccggcagcagccaggccgccaaggaggacgagaccagcgacggccaggccagcggcgagcaggaggaggccggccccagcagcagccaggccggccccagcaacggcgtggcccccctgcccagaagcgccctgctggtgcagctggccaccgccagacccagacccgtgaaggccagacccctggactggagagtgcagagcaaggactggccccacgccggcagacccgcccacgagctgagatacagcatctacagagacctgtgggagagaggcttcttcctgagcgccgccggcaagttcggcggcgacttcctggtgtaccccggcgaccccctgagattccacgcccactacatcgcccagtgctgggcccccgaggacaccatccccctgcaggacctggtggccgccggcagactgggcaccagcgtgagaaagaccctgctgctgtgcagcccccagcccgacggcaaggtggtgtacaccagcctgcagtgggccagcctgcagtag

SEQ ID NO: 103681 - DNA, 933 bp, Artificial Sequence; identical to SEQ ID NO: 103680
  Description of Artificial Sequence: Synthetic coding sequence

SEQ ID NO: 103682 - DNA, 933 bp, Artificial Sequence; identical to SEQ ID NO: 103680
  Description of Artificial Sequence: Synthetic coding sequence

SEQ ID NO: 103683 - DNA, 939 bp, Artificial Sequence
  Description of Artificial Sequence: Synthetic coding sequence
atgctggtggtggaggtggccaacggcagaagcctggtgtggggcgccgaggccgtgcaggccctgagagagagactgggcgtgggcggcagaaccgtgggcgccctgcccagaggccccagacagaacagcagactgggcctgcccctgctgctgatgcccgaggaggccagactgctggccgagatcggcgccgtgaccctggtgagcgcccccagacccgacagcagacaccacagcctggccctgaccagcttcaagagacagcaggaggagagcttccaggagcagagcgccctggccgccgaggccagagagaccagaagacaggagctgctggagaagatcaccgagggccaggccgccaagaagcagaagctggagcaggccagcggcgccagcagcagccaggaggccggcagcagccaggccgccaaggaggacgagaccagcgacggccaggccagcggcgagcaggaggaggccggccccagcagcagccaggccggccccagcaacggcgtggcccccctgcccagaagcgccctgctggtgcagctggccaccgccagacccagacccgtgaaggccagacccctggactggagagtgcagagcaaggactggccccacgccggcagacccgcccacgagctgagatacagcatctacagagacctgtgggagagaggcttcttcctgagcgccgccggcaagttcggcggcgacttcctggtgtaccccggcgaccccctgagattccacgcccactacatcgcccagtgctgggcccccgaggacaccatccccctgcaggacctggtggccgccggcagactgggcaccagcgtgagaaagaccctgctgctgtgcagcccccagcccgacggcttcaagagccaggaggtgagcatcaacctggtgtacaagtgcagctag

SEQ ID NO: 103684 - DNA, 729 bp, Artificial Sequence
  Description of Artificial Sequence: Synthetic coding sequence
atgctggtggtggaggtggccaacggcagaagcctggtgtggggcgccgaggccgtgcaggccctgagagagagactgggcgtgggcggcagaaccgtgggcgccctgcccagaggccccagacagaacagcagactgggcctgcccctgctgctgatgcccgaggaggccagactgctggccgagatcggcgccgtgaccctggtgagcgcccccagacccgacagcagacaccacagcctggccctgaccagcttcaagagacagcaggaggagagcttccaggagcagagcgccctggccgccgaggccagagagaccagaagacaggagctgctggagaagatcaccgagggccaggccgccaagaagcagaagctggagcaggccagcggcgccagcagcagccaggaggccggcagcagccaggccgccaaggaggacgagaccagcgacggccaggccagcggcgagcaggaggaggccggccccagcagcagccaggccggccccagcaacggcgtggcccccctgcccagaagcgccctgctggtgcagctggccaccgccagacccagacccgtgaaggccagacccctggactggagagtgcagagcaaggactggccccacgccggcagacccgcccacgagctgagatacagcatctacagagacctgtgggagagaggcttcttcctgagcgccgccggcaagttcggcggctag

SEQ ID NO: 103685 - DNA, 1581 bp, Artificial Sequence
  Description of Artificial Sequence: Synthetic coding sequence
atggagcccgagcccgagcccgccgccgtggaggtgcccgccggcagagtgctgagcgccagagagctgttcgccgccagaagcagaagccagaagctgccccagagaagccacggccccaaggacttcctgcccgacggcagcgccgcccaggccgagagactgagaagatgcagagaggagctgtggcagctgctggccgagcagagagtggagagactgggcagcctggtggccgccgagtggagacccgaggagggcttcgtggagctgaagagccccgccggcaagttctggcagaccatgggcttcagcgagcagggcagacagagactgcaccccgaggaggccctgtacctgctggagtgcggcagcatccacctgttccaccaggacctgcccctgagcatccaggaggcctaccagctgctgctgaccgaccacaccgtgaccttcctgcagtaccaggtgttcagccacctgaagagactgggctacgtggtgagaagattccagcccagcagcgtgctgagcccctacgagagacagctgaacctggacgccagcgtgcagcacctggaggacggcgacggcaagagaaagagaagcagcagcagccccagaagcatcaacaagaaggccaaggccctggacaacagcctgcagcccaagagcctggccgccagcagcccccccccctgcagccagcccagccagtgccccgaggagaagccccaggagagcagccccatgaagggccccggcggccccttccagctgctgggcagcctgggccccagccccggccccgccagagagggcgtgggctgcagctgggagagcggcagagccgagaacggcgtgaccggcgccggcaagagaagatggaacttcgagcagatcagcttccccaacatggccagcgacagcagacacaccctgctgagagcccccgcccccgagctgctgcccgccaacgtggccggcagagagaccgacgccgagagctggtgccagaagctgaaccagagaaaggagaagctgagcagaagagagagagagcaccacgccgaggccgcccagttccaggaggacgtgaacgccgaccccgaggtgcagagatgcagcagctggagagagtacaaggagctgctgcagagaagacaggtgcagagaagccagagaagagccccccacctgtggggccagcccgtgacccccctgctgagccccggccaggccagcagccccgccgtggtgctgcagcacatcagcgtgctgcagaccacccacctgcccgacggcggcgccagactgctggagaagagcggcggcctggagatcatcttcgacgtgtaccaggccgacgccgtggccaccttcagaaagaacaaccccggcaagccctacgccagaatgtgcatcagcggcttcgacgagcccgtgcccgacctgtgcagcctgaagagactgagctaccagagcggcgacgtgcccctgatcttcgccctggtggaccacggcgacatcagcttctacagcttcagagacttcaccctgccccaggacgtgggccactag

SEQ ID NO: 103686 - DNA, 594 bp, Artificial Sequence
  Description of Artificial Sequence: Synthetic coding sequence
atgggcttcagcgagcagggcagacagagactgcaccccgaggaggccctgtacctgctggagtgcggcagcatccacctgttccaccaggacctgcccctgagcatccaggaggcctaccagctgctgctgaccgaccacaccgtgaccttcctgcagtaccaggtgttcagccacctgaagagactgggctacgtggtgagaagattccagcccagcagcgtgctgagcccctacgagagacagctgaacctggacgccagcgtgcagcacctggaggacggcgacggcaagagaaagagaagcagcagcagccccagaagcatcaacaagaaggccaaggccctggacaacagcctgcagcccaagagcctggccgccagcagcccccccagcggcaccagcagatgccccagaatgtggggcaccgacctgaccgccctgcagagaatggagctggcccccggcgacagagactgcctgttcagcggcaccatcagcgccgccagctgcacccagaccctgacctgcagcttcagaggccagagcggcccctggccctgggtgagcgacacccacagagtgaagctgtag

SEQ ID NO: 103687 - DNA, 534 bp, Artificial Sequence
  Description of Artificial Sequence: Synthetic coding sequence
atggagcccgagcccgagcccgccgccgtggaggtgcccgccggcagagtgctgagcgccagagagctgttcgccgccagaagcagaagccagaagctgccccagagaagccacggccccaaggacttcctgcccgacggcagcgccgcccaggccgagagactgagaagatgcagagaggagctgtggcagctgctggccgagcagagagtggagagactgggcagcctggtggccgccgagtggagacccgaggagggcttcgtggagctgaagagccccgccggcaagttctggcagaccatgggcttcagcgagcagggcagacagagactgcaccccgaggaggccctgtacctgctggagtgcggcagcatccacctgttccaccaggacctgcccctgagcatccaggaggcctaccagctgctgctgaccgaccacaccgtgaccttcctgcagtaccagccccccgaggaggtgggcctgtgcggcagcaccatccccaccaagctgtgccccgtgcccgtgtag

SEQ ID NO: 103688 - DNA, 4296 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgcccgtgatcagccagaacatccacgcccccatcgccaacgagagcgccagcagccaggccctgatcaccagcatcaagcccaagaaggccagcaaggccaagaaggccgccaacaaggccatcgccagcgccaccgaggtgagcctggccgccaccgccacccacaccgccaccacccagggccagatcaccaacgagaccgccagcatccacaccaccgccgccagcatcagaaccaagaaggccagcaaggccagaaagaccatcgccaaggtgatcaacaccgacaccgagcacatcgaggccctgaacgtgaccgacgccgccaccagacagatcgaggccagcgtggtggccatcagacccaagaagagcaagggcaagaaggccgccagcagaggccccaacagcgtgagcgagatcagcgaggcccccctggccacccagatcgtgaccaaccaggccctggccgccaccctgagagtgaagagaggcagcagagccagaaaggccgccaccaaggccagagccaccgagagccagacccccaacgccgaccagggcgcccaggccaagatcgccagcgcccagaccaacgtgagcgccctggagacccaggtggccgccgccgtgcaggccctggccgacgactacctggcccagctgagcctggagcccaccaccagaaccagaggcaagagaaacagaaagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgaggccagagcccagatgggcatcggcgaggaggccgtggccggcccctggaactgggacgacatggacatcgactgcctgaccagagaggagctgggcgacgacgcccaggcctggagcagattcagcttcgagatcgaggccagagcccaggagaacgccgacgccagcaccaacgtgaacttcagcagaggcgccagcaccagagccggcttcagcgacggcgccagcatcagcttcaacggcgcccccagcagcagcggcggcttcagcggcggccccggcatcaccttcggcgtggcccccagcaccagcgccagcttcagcaacaccgccagcatcagcttcggcggcaccctgagcaccagcagcagcttcagcagcgccgccagcatcagcttcggctgcgcccacagcaccagcaccagcttcagcagcgaggccagcatcagcttcggcggcatgccctgcaccagcgccagcttcagcggcggcgtgagcagcagcttcagcggccccctgagcaccagcgccaccttcagcggcggcgccagcagcggcttcggcggcaccctgagcaccaccgccggcttcagcggcgtgctgagcaccagcaccagcttcggcagcgcccccaccaccagcaccgtgttcagcagcgccctgagcaccagcaccggcttcggcggcatcctgagcaccagcgtgtgcttcggcggcagccccagcagcagcggcagcttcggcggcaccctgagcaccagcatctgcttcggcggcagcccctgcaccagcaccggcttcggcggcaccctgagcaccagcgtgagcttcggcggcagcagcagcaccagcgccaacttcggcggcaccctgagcaccagcatctgcttcgacggcagccccagcaccggcgccggcttcggcggcgccctgaacaccagcgccagcttcggcagcgtgctgaacaccagcaccggcttcggcggcgccatgagcaccagcgccgacttcggcggcaccctgagcaccagcgtgtgcttcggcggcagccccggcaccagcgtgagcttcggcagcgccctgaacaccaacgccggctacggcggcgccgtgagcaccaacaccgacttcggcggcaccctgagcaccagcgtgtgcttcggcggcagccccagcaccagcgccggcttcggcggcgccctgaacaccaacgccagcttcggctgcgccgtgagcaccagcgccagcttcagcggcgccgtgagcaccagcgcctgcttcagcggcgcccccatcaccaaccccggcttcggcggcgccttcagcaccagcgccggcttcggcggcgccctgagcaccgccgccgacttcggcggcacccccagcaacagcatcggcttcggcgccgcccccagcaccagcgtgagcttcggcggcgcccacggcaccagcctgtgcttcggcggcgcccccagcaccagcctgtgcttcggcagcgccagcaacaccaacctgtgcttcggcggcccccccagcaccagcgcctgcttcagcggcgccaccagccccagcttctgcgacggccccagcaccagcaccggcttcagcttcggcaacggcctgagcaccaacgccggcttcggcggcggcctgaacaccagcgccggcttcggcggcggcctgggcaccagcgccggcttcagcggcggcctgagcaccagcagcggcttcgacggcggcctgggcaccagcgccggcttcggcggcggccccggcaccagcaccggcttcggcggcggcctgggcaccagcgccggcttcagcggcggcctgggcaccagcgccggcttcggcggcggcctggtgaccagcgacggcttcggcggcggcctgggcaccaacgccagcttcggcagcaccctgggcaccagcgccggcttcagcggcggcctgagcaccagcgacggcttcggcagcagacccaacgccagcttcgacagaggcctgagcaccatcatcggcttcggcagcggcagcaacaccagcaccggcttcaccggcgagcccagcaccagcaccggcttcagcagcggccccagcagcatcgtgggcttcagcggcggccccagcaccggcgtgggcttctgcagcggccccagcaccagcggcttcagcggcggccccagcaccggcgccggcttcggcggcggccccaacaccggcgccggcttcggcggcggccccagcaccagcgccggcttcggcagcggcgccgccagcctgggcgcctgcggcttcagctacggctag

SEQ ID NO: 103689 - DNA, 2121 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgcccgtgatcagccagaacatccacgcccccatcgccaacgagagcgccagcagccaggccctgatcaccagcatcaagcccaagaaggccagcaaggccaagaaggccgccaacaaggccatcgccagcgccaccgaggtgagcctggccgccaccgccacccacaccgccaccacccagggccagatcaccaacgagaccgccagcatccacaccaccgccgccagcatcagaaccaagaaggccagcaaggccagaaagaccatcgccaaggtgatcaacaccgacaccgagcacatcgaggccctgaacgtgaccgacgccgccaccagacagatcgaggccagcgtggtggccatcagacccaagaagagcaagggcaagaaggccgccagcagaggccccaacagcgtgagcgagatcagcgaggcccccctggccacccagatcgtgaccaaccaggccctggccgccaccctgagagtgaagagaggcagcagagccagaaaggccgccaccaaggccagagccaccgagagccagacccccaacgccgaccagggcgcccaggccaagatcgccagcgcccagaccaacgtgagcgccctggagacccaggtggccgccgccgtgcaggccctggccgacgactacctggcccagctgagcctggagcccaccaccagaaccagaggcaagagaaacagaaagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgagatctacagcccctgcctgcagatccccctgatcaactgcagcagccccagccacggcgccaaggtgcacccctggaacctgtgcccccacagcagccagggcagctacggccagagcgccgagggcgtgatgtag

SEQ ID NO: 103690 - DNA, 1074 bp, Artificial Sequence
  Description of Artificial Sequence: Synthetic coding sequence
atggacagaagaaacgactacggctacagagtgcccctgttccagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcagctgcagctgtggctgtggctgagactgaagcccggcctgagcggcagcaacaccagcaccggcttcaccggcgagcccagcaccagcaccggcttcagcagcggccccagcagcatcgtgggcttcagcggcggccccagcaccggcgtgggcttctgcagcggccccagcaccagcggcttcagcggcggccccagcaccggcgccggcttcggcggcggccccaacaccggcgccggcttcggcggcggccccagcaccagcgccggcttcggcagcggcgccgccagcctgggcgcctgcggcttcagctacggctag

SEQ ID NO: 103691 - DNA, 2121 bp, Artificial Sequence; identical to SEQ ID NO: 103689
  Description of Artificial Sequence: Synthetic coding sequence

SEQ ID NO: 103692 - DNA, 3105 bp, Artificial Sequence
  Description of Artificial Sequence: Synthetic coding sequence
atggacagaagaaacgactacggctacagagtgcccctgttccagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgaggccagagcccagatgggcatcggcgaggaggccgtggccggcccctggaactgggacgacatggacatcgactgcctgaccagagaggagctgggcgacgacgcccaggcctggagcagattcagcttcgagatcgaggccagagcccaggagaacgccgacgccagcaccaacgtgaacttcagcagaggcgccagcaccagagccggcttcagcgacggcgccagcatcagcttcaacggcgcccccagcagcagcggcggcttcagcggcggccccggcatcaccttcggcgtggcccccagcaccagcgccagcttcagcaacaccgccagcatcagcttcggcggcaccctgagcaccagcagcagcttcagcagcgccgccagcatcagcttcggctgcgcccacagcaccagcaccagcttcagcagcgaggccagcatcagcttcggcggcatgccctgcaccagcgccagcttcagcggcggcgtgagcagcagcttcagcggccccctgagcaccagcgccaccttcagcggcggcgccagcagcggcttcggcggcaccctgagcaccaccgccggcttcagcggcgtgctgagcaccagcaccagcttcggcagcgcccccaccaccagcaccgtgttcagcagcgccctgagcaccagcaccggcttcggcggcatcctgagcaccagcgtgtgcttcggcggcagccccagcagcagcggcagcttcggcggcaccctgagcaccagcatctgcttcggcggcagcccctgcaccagcaccggcttcggcggcaccctgagcaccagcgtgagcttcggcggcagcagcagcaccagcgccaacttcggcggcaccctgagcaccagcatctgcttcgacggcagccccagcaccggcgccggcttcggcggcgccctgaacaccagcgccagcttcggcagcgtgctgaacaccagcaccggcttcggcggcgccatgagcaccagcgccgacttcggcggcaccctgagcaccagcgtgtgcttcggcggcagccccggcaccagcgtgagcttcggcagcgccctgaacaccaacgccggctacggcggcgccgtgagcaccaacaccgacttcggcggcaccctgagcaccagcgtgtgcttcggcggcagccccagcaccagcgccggcttcggcggcgccctgaacaccaacgccagcttcggctgcgccgtgagcaccagcgccagcttcagcggcgccgtgagcaccagcgcctgcttcagcggcgcccccatcaccaaccccggcttcggcggcgccttcagcaccagcgccggcttcggcggcgccctgagcaccgccgccgacttcggcggcacccccagcaacagcatcggcttcggcgccgcccccagcaccagcgtgagcttcggcggcgcccacggcaccagcctgtgcttcggcggcgcccccagcaccagcctgtgcttcggcagcgccagcaacaccaacctgtgcttcggcggcccccccagcaccagcgcctgcttcagcggcgccaccagccccagcttctgcgacggccccagcaccagcaccggcttcagcttcggcaacggcctgagcaccaacgccggcttcggcggcggcctgaacaccagcgccggcttcggcggcggcctgggcaccagcgccggcttcagcggcggcctgagcaccagcagcggcttcgacggcggcctgggcaccagcgccggcttcggcggcggccccggcaccagcaccggcttcggcggcggcctgggcaccagcgccggcttcagcggcggcctgggcaccagcgccggcttcggcggcggcctggtgaccagcgacggcttcggcggcggcctgggcaccaacgccagcttcggcagcaccctgggcaccagcgccggcttcagcggcggcctgagcaccagcgacggcttcggcagcagacccaacgccagcttcgacagaggcctgagcaccatcatcggcttcggcagcggcagcaacaccagcaccggcttcaccggcgagcccagcaccagcaccggcttcagcagcggccccagcagcatcgtgggcttcagcggcggccccagcaccggcgtgggcttctgcagcggccccagcaccagcggcttcagcggcggccccagcaccggcgccggcttcggcggcggccccaacaccggcgccggcttcggcggcggccccagcaccagcgccggcttcggcagcggcgccgccagcctgggcgcctgcggcttcagctacggctag

SEQ ID NO: 103693 - DNA, 693 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgcccgtgatcagccagaacatccacgcccccatcgccaacgagagcgccagcagccaggccctgatcaccagcatcaagcccaagaaggccagcaaggccaagaaggccgccaacaaggccatcgccagcgccaccgaggtgagcctggccgccaccgccacccacaccgccaccacccagggccagatcaccaacgagaccgccagcatccacaccaccgccgccagcatcagaaccaagaaggccagcaaggccagaaagaccatcgccaaggtgatcaacaccgacaccgagcactag

SEQ ID NO: 103694 - DNA, 510 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagcccctag

SEQ ID NO: 103695 - DNA, 2889 bp, Artificial Sequence
  Description of Artificial Sequence: Synthetic coding sequence
atgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgaggccagagcccagatgggcatcggcgaggaggccgtggccggcccctggaactgggacgacatggacatcgactgcctgaccagagaggagctgggcgacgacgcccaggcctggagcagattcagcttcgagatcgaggccagagcccaggagaacgccgacgccagcaccaacgtgaacttcagcagaggcgccagcaccagagccggcttcagcgacggcgccagcatcagcttcaacggcgcccccagcagcagcggcggcttcagcggcggccccggcatcaccttcggcgtggcccccagcaccagcgccagcttcagcaacaccgccagcatcagcttcggcggcaccctgagcaccagcagcagcttcagcagcgccgccagcatcagcttcggctgcgcccacagcaccagcaccagcttcagcagcgaggccagcatcagcttcggcggcatgccctgcaccagcgccagcttcagcggcggcgtgagcagcagcttcagcggccccctgagcaccagcgccaccttcagcggcggcgccagcagcggcttcggcggcaccctgagcaccaccgccggcttcagcggcgtgctgagcaccagcaccagcttcggcagcgcccccaccaccagcaccgtgttcagcagcgccctgagcaccagcaccggcttcggcggcatcctgagcaccagcgtgtgcttcggcggcagccccagcagcagcggcagcttcggcggcaccctgagcaccagcatctgcttcggcggcagcccctgcaccagcaccggcttcggcggcaccctgagcaccagcgtgagcttcggcggcagcagcagcaccagcgccaacttcggcggcaccctgagcaccagcatctgcttcgacggcagccccagcaccggcgccggcttcggcggcgccctgaacaccagcgccagcttcggcagcgtgctgaacaccagcaccggcttcggcggcgccatgagcaccagcgccgacttcggcggcaccctgagcaccagcgtgtgcttcggcggcagccccggcaccagcgtgagcttcggcagcgccctgaacaccaacgccggctacggcggcgccgtgagcaccaacaccgacttcggcggcaccctgagcaccagcgtgtgcttcggcggcagccccagcaccagcgccggcttcggcggcgccctgaacaccaacgccagcttcggctgcgccgtgagcaccagcgccagcttcagcggcgccgtgagcaccagcgcctgcttcagcggcgcccccatcaccaaccccggcttcggcggcgccttcagcaccagcgccggcttcggcggcgccctgagcaccgccgccgacttcggcggcacccccagcaacagcatcggcttcggcgccgcccccagcaccagcgtgagcttcggcggcgcccacggcaccagcctgtgcttcggcggcgcccccagcaccagcctgtgcttcggcagcgccagcaacaccaacctgtgcttcggcggcccccccagcaccagcgcctgcttcagcggcgccaccagccccagcttctgcgacggccccagcaccagcaccggcttcagcttcggcaacggcctgagcaccaacgccggcttcggcggcggcctgaacaccagcgccggcttcggcggcggcctgggcaccagcgccggcttcagcggcggcctgagcaccagcagcggcttcgacggcggcctgggcaccagcgccggcttcggcggcggccccggcaccagcaccggcttcggcggcggcctgggcaccagcgccggcttcagcggcggcctgggcaccagcgccggcttcggcggcggcctggtgaccagcgacggcttcggcggcggcctgggcaccaacgccagcttcggcagcaccctgggcaccagcgccggcttcagcggcggcctgagcaccagcgacggcttcggcagcagacccaacgccagcttcgacagaggcctgagcaccatcatcggcttcggcagcggcagcaacaccagcaccggcttcaccggcgagcccagcaccagcaccggcttcagcagcggccccagcagcatcgtgggcttcagcggcggccccagcaccggcgtgggcttctgcagcggccccagcaccagcggcttcagcggcggccccagcaccggcgccggcttcggcggcggccccaacaccggcgccggcttcggcggcggccccagcaccagcgccggcttcggcagcggcgccgccagcctgggcgcctgcggcttcagctacggctag

SEQ ID NO: 103696 - DNA, 366 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagtag

SEQ ID NO: 103697 - DNA, 579 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgcccgtgatcagccagaacatccacgcccccatcgccaacgagagcgccagcagccaggccctgatcaccagcatcaagcccaagaaggccagcaaggccaagaaggccgccaacaaggccatcgccagcgccaccgaggtgagcctggccgccaccgccacccacaccgccaccacccagggctag

SEQ ID NO: 103698 - DNA, 531 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgccctag

SEQ ID NO: 103699 - DNA, 507 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagctag

SEQ ID NO: 103700 - DNA, 2046 bp, Artificial Sequence
  Description of Artificial Sequence: Synthetic coding sequence
atggacagaagaaacgactacggctacagagtgcccctgttccagggccccctgcccccccccggcagcctgggcctgcccttcccccccgacatccagaccgagaccaccgaggaggacagcgtgctgctgatgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagagccccctgcaggtgctgaagctgcccgtgatcagccagaacatccacgcccccatcgccaacgagagcgccagcagccaggccctgatcaccagcatcaagcccaagaaggccagcaaggccaagaaggccgccaacaaggccatcgccagcgccaccgaggtgagcctggccgccaccgccacccacaccgccaccacccagggccagatcaccaacgagaccgccagcatccacaccaccgccgccagcatcagaaccaagaaggccagcaaggccagaaagaccatcgccaaggtgatcaacaccgacaccgagcacatcgaggccctgaacgtgaccgacgccgccaccagacagatcgaggccagcgtggtggccatcagacccaagaagagcaagggcaagaaggccgccagcagaggccccaacagcgtgagcgagatcagcgaggcccccctggccacccagatcgtgaccaaccaggccctggccgccaccctgagagtgaagagaggcagcagagccagaaaggccgccaccaaggccagagccaccgagagccagacccccaacgccgaccagggcgcccaggccaagatcgccagcgcccagaccaacgtgagcgccctggagacccaggtggccgccgccgtgcaggccctggccgacgactacctggcccagctgagcctggagcccaccaccagaaccagaggcaagagaaacagaaagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgagtggttccagcaccagcactggctgtactggagaacccagcaccagcacggcctgcagtag

SEQ ID NO: 103701 - DNA, 372 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatcagccaggccctgcccaccaccgaggtgaccaacacccaggccagcagcgtgaccgcccagcccaagaaggccaacaagatgaagagagtgaccgccaaggccgcccagggcagccagagccccaccggccacgagggcggcaccatccagctgaagtag

SEQ ID NO: 103702 - DNA, 216 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaacctgcccgtgatcacccagatctag

SEQ ID NO: 103703 - DNA, 195 bp, Artificial Sequence
  Description of Artificial Sequence: Synthetic coding sequence
atgcacaccctgctggccgccaccaaggacagcctggccatggacccccccgtggtgaacagacccaagaagagcaagaccaagaaggcccccatcaagaccatcaccaaggccgcccccgccgccccccccgtgcccgccgccaacgagatcgccaccaacaagcccaagatcacctggcaggccctgaactag

SEQ ID NO: 103704 - DNA, 930 bp, Artificial Sequence
  Description of Artificial Sequence: Synthetic coding sequence
atggacagaagaaacgactacggctacagagtgcccctgttccagagcaagcacctgaacggcgacgagagaagcggcagcaactacagaagaatcccctggggcagaagacccgccccccccagagacgtggccatcctgcaggagagagccaacaagctggtgaagtacctgctggtgaaggaccagaccaagatccccatcaagagaagcgacatgctgagagacgtgatccaggagtacgacgagtacttccccgagatcatcgagagagccagctacaccctggagaagatgttcagagtgaacctgaaggagatcgacaagcagagcagcctgtacatcctgatcagcacccaggagagcagcgccggcatcctgggcaccaccaaggacacccccaagctgggcctgctgatggtgatcctgagcgtgatcttcatgaacggcaacaaggccagcgaggccgtgatctgggaggtgctgagaaagctgggcctgagacccggcgtgagacacagcctgttcggcgaggtgagaaagctgatcaccgacgagttcgtgaagcagaagtacctggagtacaagagagtgcccaacagcagaccccccgagtacgagttcttctggggcctgagaagctaccacgagaccagcaagatgaaggtgctgaagttcgcctgcagagtgcagaagaaggaccccaaggactgggccgtgcagtacagagaggccgtggagatggaggtgcaggccgccgccgtggccgtggccgaggccgaggccagagccgagatctacagcccctgcctgcagatccccctgatcaactgcagcagccccagccacggcgccaaggtgcacccctggaacctgtgcccccacagcagccagggcagctacggccagagcgccgagggcgtgatgtag

SEQ ID NO: 103705 - DNA, 1263 bp, Artificial Sequence
  Description of Artificial Sequence: Synthetic coding sequence
atgcccggcggctgcagcagaggccccgccgccggcgacggcagactgagactggccagactggccctggtgctgctgggctgggtgagcagcagcagccccaccagcagcgccagcagcttcagcagcagcgcccccttcctggccagcgccgtgagcgcccagccccccctgcccgaccagtgccccgccctgtgcgagtgcagcgaggccgccagaaccgtgaagtgcgtgaacagaaacctgaccgaggtgcccaccgacctgcccgcctacgtgagaaacctgttcctgaccggcaaccagctggccgtgctgcccgccggcgccttcgccagaagaccccccctggccgagctggccgccctgaacctgagcggcagcagactggacgaggtgagagccggcgccttcgagcacctgcccagcctgagacagctggacctgagccacaaccccctggccgacctgagccccttcgccttcagcggcagcaacgccagcgtgagcgcccccagccccctggtggagctgatcctgaaccacatcgtgccccccgaggacgagagacagaacagaagcttcgagggcatggtggtggccgccctgctggccggcagagccctgcagggcctgagaagactggagctggccagcaaccacttcctgtacctgcccagagacgtgctggcccagctgcccagcctgagacacctggacctgagcaacaacagcctggtgagcctgacctacgtgagcttcagaaacctgacccacctggagagcctgcacctggaggacaacgccctgaaggtgctgcacaacggcaccctggccgagctgcagggcctgccccacatcagagtgttcctggacaacaacccctgggtgtgcgactgccacatggccgacatggtgacctggctgaaggagaccgaggtggtgcagggcaaggacagactgacctgcgcctaccccgagaagatgagaaacagagtgctgctggagctgaacagcgccgacctggactgcgaccccatcctgccccccagcctgcagaccagctacgtgttcctgggcatcgtgctggccctgatcggcgccatcttcctgctggtgctgtacctgaacagaaagggcatcaagaagtggatgcacaacatcagagacgcctgcagagaccacatggagggctaccactacagatacgagatcaacgccgaccccagactgaccaacctgagcagcaacagcgacgtgtag

SEQ ID NO: 103706 - DNA, 1263 bp, Artificial Sequence; identical to SEQ ID NO: 103705
  Description of Artificial Sequence: Synthetic coding sequence

SEQ ID NO: 103707 - DNA, 1263 bp, Artificial Sequence; identical to SEQ ID NO: 103705
  Description of Artificial Sequence: Synthetic coding sequence

SEQ ID NO: 103708 - DNA, 1056 bp, Artificial Sequence
  Description of Artificial Sequence: Synthetic coding sequence
atggccctgcccttccagaaggagctggagaagtacaagaacatcgacgaggacgagctgctgggcaagctgagcgaggaggagctgaagcagctggagaacgtgctggacgacctggaccccgagagcgccatgctgcccgccggcttcagacagaaggaccagacccagaaggccgccaccggccccttcgacagagagcacctgctgatgtacctggagaaggaggccctggagcagaaggacagagaggacttcgtgcccttcaccggcgagaagaagggcagagtgttcatccccaaggagaagcccatcgagaccagaaaggaggagaaggtgaccctggaccccgagctggaggaggccctggccagcgccagcgacaccgagctgtacgacctggccgccgtgctgggcgtgcacaacctgctgaacaaccccaagttcgacgaggagaccgccaacaacaagggcggcaagggccccgtgagaaacgtggtgaagggcgagaaggtgaagcccgtgttcgaggagccccccaaccccaccaacgtggagatcagcctgcagcagatgaaggccaacgaccccagcctgcaggaggtgaacctgaacaacatcaagaacatccccatccccaccctgagagagttcgccaaggccctggagaccaacacccacgtgaagaagttcagcctggccgccaccagaagcaacgaccccgtggccatcgccttcgccgacatgctgaaggtgaacaagaccctgaccagcctgaacatcgagagcaacttcatcaccggcaccggcatcctggccctggtggaggccctgaaggagaacgacaccctgaccgagatcaagatcgacaaccagagacagcagctgggcaccgccgtggagatggagatcgcccagatgctggaggagaacagcagaatcctgaagttcggctaccagttcaccaagcagggccccagaaccagagtggccgccgccatcaccaagaacaacgacctggtgagaaagaagagagtggaggccgacagaagatag

SEQ ID NO: 103709 - DNA, 948 bp, Artificial Sequence
  Description of Artificial Sequence: Synthetic coding sequence
atggccctgcccttccagaaggagctggagaagtacaagaacatcgacgaggacgagctgctgggcaagctgagcgaggaggagctgaagcagctggagaacgtgctggacgacctggaccccgagagcgccatgctgcccgccggcttcagacagaaggaccagacccagaaggccgccaccggccccttcgacagagagcacctgctgatgtacctggagaaggaggccctggagcagaaggacagagaggacttcgtgcccttcaccggcgagaagaagggcagagtgttcatccccaaggagaagcccatcgagaccagaaaggaggagaaggtgaccctggaccccgagctggaggaggccctggccagcgccagcgacaccgagctgtacgacctggccgccgtgctgggcgtgcacaacctgctgaacaaccccaagttcgacgaggagaccgccaacaacaagggcggcaagggccccgtgagaaacgtggtgaagggcgagaaggtgaagcccgtgttcgaggagccccccaaccccaccaacgtggagatcagcctgcagcagatgaaggccaacgaccccagcctgcaggaggtgaacctgaacaacatcaaggccttcgccgacatgctgaaggtgaacaagaccctgaccagcctgaacatcgagagcaacttcatcaccggcaccggcatcctggccctggtggaggccctgaaggagaacgacaccctgaccgagatcaagatcgacaaccagagacagcagctgggcaccgccgtggagatggagatcgcccagatgctggaggagaacagcagaatcctgaagttcggctaccagttcaccaagcagggccccagaaccagagtggccgccgccatcaccaagaacaacgacctggtgagaaagaagagagtggaggccgacagaagatag

SEQ ID NO: 103710 - DNA, 1059 bp, Artificial Sequence
  Description of Artificial Sequence: Synthetic coding sequence
atggccctgcccttcagaaaggacctggagaagtacaaggacctggacgaggacgagctgctgggcaacctgagcgagaccgagctgaagcagctggagaccgtgctggacgacctggaccccgagaacgccctgctgcccgccggcttcagacagaagaaccagaccagcaagagcaccaccggccccttcgacagagagcacctgctgagctacctggagaaggaggccctggagcacaaggacagagaggactacgtgccctacaccggcgagaagaagggcaagatcttcatccccaagcagaagcccgtgcagaccttcaccgaggagaaggtgagcctggaccccgagctggaggaggccctgaccagcgccagcgacaccgagctgtgcgacctggccgccatcctgggcatgcacaacctgatcaccaacaccaagttctgcaacatcatgggcagcagcaacggcgtggaccaggagcacttcagcaacgtggtgaagggcgagaagatcctgcccgtgttcgacgagccccccaaccccaccaacgtggaggagagcctgaagagaaccaaggagaacgacgcccacctggtggaggtgaacctgaacaacatcaagaacatccccatccccaccctgaaggacttcgccaaggccctggagaccaacacccacgtgaagtgcttcagcctggccgccaccagaagcaacgaccccgtggccaccgccttcgccgagatgctgaaggtgaacaagaccctgaagagcctgaacgtggagagcaacttcatcaccggcgtgggcatcctggccctgatcgacgccctgagagacaacgagaccctggccgagctgaagatcgacaaccagagacagcagctgggcaccgccgtggagctggagatggccaagatgctggaggagaacaccaacatcctgaagttcggctaccagttcacccagcagggccccagaaccagagccgccaacgccatcaccaagaacaacgacctggtgagaaagagaagagtggagggcgaccaccagtag

SEQ ID NO: 103711 - DNA, 1059 bp, Artificial Sequence; identical to SEQ ID NO: 103710
  Description of Artificial Sequence: Synthetic coding sequence

SEQ ID NO: 103712 - DNA, 102 bp, Artificial Sequence
  Description of Artificial Sequence: Synthetic coding sequence
atggccctgcccttcagaaaggacctggagaagtacaaggacctggacgaggacgagctgctgggcaacctgagcgagaccgagctgaagcagctggagtag

SEQ ID NO: 103713 - DNA, 1038 bp, Artificial Sequence
  Description of Artificial Sequence: Synthetic coding sequence
atgagcagctaccagaaggagctggagaagtacagagacatcgacgaggacgagatcctgagaaccctgagccccgaggagctggagcagctggactgcgagctgcaggagatggaccccgagaacatgctgctgcccgccggcctgagacagagagaccagaccaagaagagccccaccggccccctggacagagaggccctgctgcagtacctggagcagcaggccctggaggtgaaggagagagacgacctggtgcccttcaccggcgagaagaagggcaagccctacatccagcccaagagagagatccccgccgaggagcagatcaccctggagcccgagctggaggaggccctggcccacgccaccgacgccgagatgtgcgacatcgccgccatcctggacatgtacaccctgatgagcaacaagcagtactacgacgccctgtgcagcggcgagatctgcaacaccgagggcatcagcagcgtggtgcagcccgacaagtacaagcccgtgcccgacgagccccccaaccccaccaacatcgaggagatcctgaagagagtgagaagcaacgacaaggagctggaggaggtgaacctgaacaacatccaggacatccccatccccatgctgagcgagctgtgcgaggccatgaaggccaacacctacgtgagaagcttcagcctggtggccaccagaagcggcgaccccatcgccaacgccgtggccgacatgctgagagagaacagaagcctgcagagcctgaacatcgagagcaacttcatcagcagcaccggcctgatggccgtgctgaaggccgtgagagagaacgccaccctgaccgagctgagagtggacaaccagagacagtggcccggcgacgccgtggagatggagatggccaccgtgctggagcagtgccccagcatcgtgagattcggctaccacttcacccagcagggccccagagccagagccgcccaggccatgaccagaaacaacgagctgagaagacagcagaagaagagatag

SEQ ID NO: 103714 - DNA, 831 bp, Artificial Sequence
  Description of Artificial Sequence: Synthetic coding sequence
atgagcagctaccagaaggagctggagaagtacagagacatcgacgaggacgagatcctgagaaccctgagccccgaggagctggagcagctggactgcgagctgcaggagatggaccccgagaacatgctgctgcccgccggcctgagacagagagaccagaccaagaagagccccaccggccccctggacagagaggccctgctgcagtacctggagcagcaggccctggaggtgaaggagagagacgacctggtgcccttcaccggcgagaagaagggcgtggtgcagcccgacaagtacaagcccgtgcccgacgagccccccaaccccaccaacatcgaggagatcctgaagagagtgagaagcaacgacaaggagctggaggaggtgaacctgaacaacatccaggacatccccatccccatgctgagcgagctgtgcgaggccatgaaggccaacacctacgtgagaagcttcagcctggtggccaccagaagcggcgaccccatcgccaacgccgtggccgacatgctgagagagaacagaagcctgcagagcctgaacatcgagagcaacttcatcagcagcaccggcctgatggccgtgctgaaggccgtgagagagaacgccaccctgaccgagctgagagtggacaaccagagacagtggcccggcgacgccgtggagatggagatggccaccgtgctggagcagtgccccagcatcgtgagattcggctaccacttcacccagcagggccccagagccagagccgcccaggccatgaccagaaacaacgagctgagaagacagcagaagaagagatag

SEQ ID NO: 103715 - DNA, 429 bp, Artificial Sequence
  Description of Artificial Sequence: Synthetic coding sequence
atgagcagctaccagaaggagctggagaagtacagagacatcgacgaggacgagatcctgagaaccctgagccccgaggagctggagcagctggactgcgagctgcaggagatggaccccgagaacatgctgctgcccgccggcctgagacagagagaccagaccaagaagagccccaccggccccctggacagagaggccctgctgcagtacctggagcagcaggccctggaggtgaaggagagagacgacctggtgcccttcaccggcgagaagaagggcaagccctacatccagcccaagagagagatccccgccgaggagcagatcaccctggagcccgagctggaggaggccctggcccacgccaccgacgccgagatgtgcgacatcgccgccatcctggacatgtacaccctgatgagctag

SEQ ID NO: 103716 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggaggacatcgccgccaaggagaagctgctgagagtgagcgaggacgagagagacagagtgctggaggagctgcacaaggccgaggacagcctgctggccgccgaggaggccgccgccaaggccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggagaaggtggcccacgccaaggaggagaacctgagcatgcaccagatgctggaccagaccctgctggagctgaacaacatgtag

SEQ ID NO: 103717 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggccaggtgagacagctggaggagcagctgagaatcatggaccagaccctgaaggccctgatggccgccgaggacaagtacagccagaaggaggacagatacgaggaggagatcaaggtgctgagcgacaagctgaaggaggccgagaccagagccgagttcgccgagagaagcgtgaccaagctggagaagagcatcgacgacctggaggacgagctgtacgcccagaagctgaagtacaaggccatcagcgaggagctggaccacgccctgaacgacatgaccagcatgtag

SEQ ID NO: 103718 - DNA, 738 bp, Artificial Sequence
  Description of Artificial Sequence: Synthetic coding sequence
atggccggcagcagcagcctggaggccgtgagaagaaagatcagaagcctgcaggagcaggccgacgccgccgaggagagagccggcaccctgcagagagagctggaccacgagagaaagctgagagagaccgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggaccagctgtaccagcagctggagcagaacagaagactgaccaacgagctgaagctggccctgaacgaggactag

SEQ ID NO: 103719 - DNA, 981 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggaggacatcgccgccaaggagaagctgctgagagtgagcgaggacgagagagacagagtgctggaggagctgcacaaggccgaggacagcctgctggccgccgaggaggccgccgccaagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggagaaggtggcccacgccaaggaggagaacctgagcatgcaccagatgctggaccagaccctgctggagctgaacaacatgtag

SEQ ID NO: 103720 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggccaggtgagacagctggaggagcagctgagaatcatggaccagaccctgaaggccctgatggccgccgaggacaagtacagccagaaggaggacagatacgaggaggagatcaaggtgctgagcgacaagctgaaggaggccgagaccagagccgagttcgccgagagaagcgtgaccaagctggagaagagcatcgacgacctggaggagaaggtggcccacgccaaggaggagaacctgagcatgcaccagatgctggaccagaccctgctggagctgaacaacatgtag

SEQ ID NO: 103721 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggacgagctgtacgcccagaagctgaagtacaaggccatcagcgaggagctggaccacgccctgaacgacatgaccagcatctag

SEQ ID NO: 103722 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggaggacatcgccgccaaggagaagctgctgagagtgagcgaggacgagagagacagagtgctggaggagctgcacaaggccgaggacagcctgctggccgccgaggaggccgccgccaaggccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggccaggtgagacagctggaggagcagctgagaatcatggaccagaccctgaaggccctgatggccgccgaggacaagtacagccagaaggaggacagatacgaggaggagatcaaggtgctgagcgacaagctgaaggaggccgagaccagagccgagttcgccgagagaagcgtgaccaagctggagaagagcatcgacgacctggaggagaaggtggcccacgccaaggaggagaacctgagcatgcaccagatgctggaccagaccctgctggagctgaacaacatgtag

SEQ ID NO: 103723 - DNA, 855 bp, Artificial Sequence
  Description of Artificial Sequence: Synthetic coding sequence
atggacgccatcaagaagaagatgcagatgctgaagctggacaaggagaacgccctggacagagccgagcaggccgaggccgacaagaaggccgccgaggacagaagcaagcagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggagaaggtggcccacgccaaggaggagaacctgagcatgcaccagatgctggaccagaccctgctggagctgaacaacatgtag

SEQ ID NO: 103724 - DNA, 798 bp, Artificial Sequence
  Description of Artificial Sequence: Synthetic coding sequence
tgaagagccgagcaggccgaggccgacaagaaggccgccgaggacagaagcaagcagctggaggacgagctggtgagcctgcagaagaagctgaagggcaccgaggacgagctggacaagtacagcgaggccctgaaggacgcccaggagaagctggagctggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagagcagagcccagaaggacgaggagaagatggagatccaggagatccagctgaaggaggccaagcacatcgccgaggacgccgacagaaagtacgaggaggtggccagaaagctggtgatcatcgagagcgacctggagagagccgaggagagagccgagctgagcgagggcaagtgcgccgagctggaggaggagctgaagaccgtgaccaacaacctgaagagcctggaggcccaggccgagaagtacagccagaaggaggacagatacgaggaggagatcaaggtgctgagcgacaagctgaaggaggccgagaccagagccgagttcgccgagagaagcgtgaccaagctggagaagagcatcgacgacctggaggacgagctgtacgcccagaagctgaagtacaaggccatcagcgaggagctggaccacgccctgaacgacatgaccagcatgtag

SEQ ID NO: 103725 - DNA, 855 bp, Artificial Sequence
  Description of Artificial Sequence: Synthetic coding sequence
atggacgccatcaagaagaagatgcagatgctgaagctggacaaggagaacgccatcgacagagccgagcaggccgaggccgacaagaagcaggccgaggacagatgcaagcagctggaggaggagcagcaggccctgcagaagaagctgaagggcaccgaggacgaggtggagaagtacagcgagagcgtgaaggaggcccaggagaagctggagcaggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagctgcaggagatgcagctgaaggaggccaagcacatcgccgaggacagcgacagaaagtacgaggaggtggccagaaagctggtgatcctggagggcgagctggagagaagcgaggagagagccgaggtggccgagagcaagtgcggcgacctggaggaggagctgaagatcgtgaccaacaacctgaagagcctggaggcccaggccgacaagtacagcaccaaggaggacaagtacgaggaggagatcaagctgctggaggagaagctgaaggaggccgagaccagagccgagttcgccgagagaagcgtggccaagctggagaagaccatcgacgacctggaggagaccctggccagcgccaaggaggagaacgtggagatccaccagaccctggaccagaccctgctggagctgaacaacctgtag

SEQ ID NO: 103726 - DNA, 855 bp, Artificial Sequence
  Description of Artificial Sequence: Synthetic coding sequence
atggacgccatcaagaagaagatgcagatgctgaagctggacaaggagaacgccatcgacagagccgagcaggccgaggccgacaagaagcaggccgaggacagatgcaagcagctggaggaggagcagcaggccctgcagaagaagctgaagggcaccgaggacgaggtggagaagtacagcgagagcgtgaaggaggcccaggagaagctggagcaggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagctgcaggagatgcagctgaaggaggccaagcacatcgccgaggacagcgacagaaagtacgaggaggtggccagaaagctggtgatcctggagggcgagctggagagaagcgaggagagagccgaggtggccgagagcaagtgcggcgacctggaggaggagctgaagatcgtgaccaacaacctgaagagcctggaggcccaggccgacaagtacagcaccaaggaggacaagtacgaggaggagatcaagctgctggaggagaagctgaaggaggccgagaccagagccgagttcgccgagagaagcgtggccaagctggagaagaccatcgacgacctggaggacgaggtgtacgcccagaagatgaagtacaaggccatcagcgaggagctggacaacgccctgaacgacatcaccagcctgtag

SEQ ID NO: 103727 - DNA, 855 bp, Artificial Sequence
  Description of Artificial Sequence: Synthetic coding sequence
atggacgccatcaagaagaagatgcagatgctgaagctggacaaggagaacgccatcgacagagccgagcaggccgaggccgacaagaagcaggccgaggacagatgcaagcagctggaggaggagcagcaggccctgcagaagaagctgaagggcaccgaggacgaggtggagaagtacagcgagagcgtgaaggaggcccaggagaagctggagcaggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagctgcaggagatgcagctgaaggaggccaagcacatcgccgaggacagcgacagaaagtacgaggaggtggccagaaagctggtgatcctggagggcgagctggagagaagcgaggagagagccgaggtggccgagagcagagccagacagctggaggaggagctgagaaccatggaccaggccctgaagagcctgatggccagcgaggaggagtacagcaccaaggaggacaagtacgaggaggagatcaagctgctggaggagaagctgaaggaggccgagaccagagccgagttcgccgagagaagcgtggccaagctggagaagaccatcgacgacctggaggagaccctggccagcgccaaggaggagaacgtggagatccaccagaccctggaccagaccctgctggagctgaacaacctgtag

SEQ ID NO: 103728 - DNA, 969 bp, Artificial Sequence
  Description of Artificial Sequence: Synthetic coding sequence
atggacgccatcaagaagaagatgcagatgctgaagctggacaaggagaacgccatcgacagagccgagcaggccgaggccgacaagaagcaggccgaggacagatgcaagcagctggaggaggagcagcaggccctgcagaagaagctgaagggcaccgaggacgaggtggagaagtacagcgagagcgtgaaggaggcccaggagaagctggagcaggccgagaagaaggccaccgacgccgaggccgacgtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagctgcaggagatgcagctgaaggaggccaagcacatcgccgaggacagcgacagaaagtacgaggaggtggccagaaagctggtgatcctggagggcgagctggagagaagcgaggagagagccgaggtggccgagagcaagtgcggcgacctggaggaggagctgaagatcgtgaccaacaacctgaagagcctggaggcccaggccgacaagtacagcaccaaggaggacaagtacgaggaggagatcaagctgctggaggagaagctgaaggaggccgagaccagagccgagttcgccgagagaagcgtggccaagctggagaagaccatcgacgacctggaggagagcaccagcatcgccaccaccgagcactggttcacccccgacaccctggccctgaccgacacccccagcccctgcaccgagcccacccacaagaccccctggcccaccctgaagcccctgtgcaccggcaccccctggctgagcctgagcgacagccccctgcacgtgggcacctgcggccccatcaagccctag

SEQ ID NO: 103729 - DNA, 858 bp, Artificial Sequence
  Description of Artificial Sequence: Synthetic coding sequence
atgatggaggccatcaagaagaagatgcagatgctgaagctggacaaggagaacgccctggacagagccgagcaggccgaggccgagcagaagcaggccgaggagagaagcaagcagctggaggacgagctggccgccatgcagaagaagctgaagggcaccgaggacgagctggacaagtacagcgaggccctgaaggacgcccaggagaagctggagctggccgagaagaaggccgccgacgccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcagatgcagagagatggacgagcagatcagactgatggaccagaacctgaagtgcctgagcgccgccgaggagaagtacagccagaaggaggacaagtacgaggaggagatcaagatcctgaccgacaagctgaaggaggccgagaccagagccgagttcgccgagagaagcgtggccaagctggagaagaccatcgacgacctggaggacaagctgaagtgcaccaaggaggagcacctgtgcacccagagaatgctggaccagaccctgctggacctgaacgagatgtag

SEQ ID NO: 103730 - DNA, 744 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcaggccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcaagtgcagcgagctggaggaggagctgaagaacgtgaccaacaacctgaagagcctggaggcccaggccgagaagtacagccagaaggaggacaagtacgaggaggagatcaagatcctgaccgacaagctgaaggaggccgagaccagagccgagttcgccgagagaagcgtggccaagctggagaagaccatcgacgacctggaggagagactgtacagccagctggagagaaacagactgctgagcaacgagctgaagctgaccctgcacgacctgtgcgactag

SEQ ID NO: 103731 - DNA, 747 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcaggccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcagatgcagagagatggacgagcagatcagactgatggaccagaacctgaagtgcctgagcgccgccgaggagaagtacagccagaaggaggacaagtacgaggaggagatcaagatcctgaccgacaagctgaaggaggccgagaccagagccgagttcgccgagagaagcgtggccaagctggagaagaccatcgacgacctggaggacgagctgtacgcccagaagctgaagtacaaggccatcagcgaggagctggaccacgccctgaacgacatgaccagcatctag

SEQ ID NO: 103732 - DNA, 747 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcaggccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcaagtgcagcgagctggaggaggagctgaagaacgtgaccaacaacctgaagagcctggaggcccaggccgagaagtacagccagaaggaggacaagtacgaggaggagatcaagatcctgaccgacaagctgaaggaggccgagaccagagccgagttcgccgagagaagcgtggccaagctggagaagaccatcgacgacctggaggacaagctgaagtgcaccaaggaggagcacctgtgcacccagagaatgctggaccagaccctgctggacctgaacgagatgtag

SEQ ID NO: 103733 - DNA, 675 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcagatgcagagagatggacgagcagatcagactgatggaccagaacctgaagtgcctgagcgccgccgaggagaagtacagccagaaggaggacaagtacgaggaggagatcaagatcctgaccgacaagctgaaggaggccgagaccagagccgagttcgccgagagaagcgtggccaagctggagaagaccatcgacgacctggaggacaagctgaagtgcaccaaggaggagcacctgtgcacccagagaatgctggaccagaccctgctggacctgaacgagatgtag

SEQ ID NO: 103734 - DNA, 858 bp, Artificial Sequence
  Description of Artificial Sequence: Synthetic coding sequence
atgatggaggccatcaagaagaagatgcagatgctgaagctggacaaggagaacgccctggacagagccgagcaggccgaggccgagcagaagcaggccgaggagagaagcaagcagctggaggacgagctggccgccatgcagaagaagctgaagggcaccgaggacgagctggacaagtacagcgaggccctgaaggacgcccaggagaagctggagctggccgagaagaaggccgccgacgccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcaagtgcagcgagctggaggaggagctgaagaacgtgaccaacaacctgaagagcctggaggcccaggccgagaagtacagccagaaggaggacaagtacgaggaggagatcaagatcctgaccgacaagctgaaggaggccgagaccagagccgagttcgccgagagaagcgtggccaagctggagaagaccatcgacgacctggaggacgagctgtacgcccagaagctgaagtacaaggccatcagcgaggagctggaccacgccctgaacgacatgaccagcatctag

SEQ ID NO: 103735 - DNA, 744 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcaggccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcagatgcagagagatggacgagcagatcagactgatggaccagaacctgaagtgcctgagcgccgccgaggagaagtacagccagaaggaggacaagtacgaggaggagatcaagatcctgaccgacaagctgaaggaggccgagaccagagccgagttcgccgagagaagcgtggccaagctggagaagaccatcgacgacctggaggagagactgtacagccagctggagagaaacagactgctgagcaacgagctgaagctgaccctgcacgacctgtgcgactag

SEQ ID NO: 103736 - DNA, 747 bp, Artificial Sequence
  Description of Artificial Sequence: Synthetic coding sequence
atggccggcatcaccaccatcgaggccgtgaagagaaagatccaggtgctgcagcagcaggccgacgacgccgaggagagagccgagagactgcagagagaggtggagggcgagagaagagccagagagcaggccgaggccgaggtggccagcctgaacagaagaatccagctggtggaggaggagctggacagagcccaggagagactggccaccgccctgcagaagctggaggaggccgagaaggccgccgacgagagcgagagaggcatgaaggtgatcgagaacagagccctgaaggacgaggagaagatggagctgcaggagatccagctgaaggaggccaagcacatcgccgaggaggccgacagaaagtacgaggaggtggccagaaagctggtgatcatcgagggcgacctggagagaaccgaggagagagccgagctggccgagagcagatgcagagagatggacgagcagatcagactgatggaccagaacctgaagtgcctgagcgccgccgaggagaagtacagccagaaggaggacaagtacgaggaggagatcaagatcctgaccgacaagctgaaggaggccgagaccagagccgagttcgccgagagaagcgtggccaagctggagaagaccatcgacgacctggaggacaagctgaagtgcaccaaggaggagcacctgtgcacccagagaatgctggaccagaccctgctggacctgaacgagatgtag

SEQ ID NO: 103737 - DNA, 228 bp, Artificial Sequence
  Description of Artificial Sequence: Synthetic coding sequence
atgatggaggccatcaagaagaagatgcagatgctgaagctggacaaggagaacgccctggacagagccgagcaggccgaggccgagcagaagcaggccgaggagagaagcaagcagctggaggacgagctggccgccatgcagaagaagctgaagggcaccgaggacgagctggacaagtacagcgaggccctgaaggacgcccaggagaagctggagctggcctag

SEQ ID NO: 103738 - DNA, 747 bp, Artificial Sequence
  Description of Artificial Sequence: Synthetic coding sequence
atggccggcctgaacagcctggaggccgtgaagagaaagatccaggccctgcagcagcaggccgacgaggccgaggacagagcccagggcctgcagagagagctggacggcgagagagagagaagagagaaggccgagggcgacgtggccgccctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagatccaggagatgcagctgaaggaggccaagcacatcgccgaggaggccgacagaaagtacgaggaggtggccagaaagctggtgatcctggagggcgagctggagagagccgaggagagagccgaggtgagcgagctgaagtgcggcgacctggaggaggagctgaagaacgtgaccaacaacctgaagagcctggaggccgccagcgagaagtacagcgagaaggaggacaagtacgaggaggagatcaagctgctgagcgacaagctgaaggaggccgagaccagagccgagttcgccgagagaaccgtggccaagctggagaagaccatcgacgacctggaggagaagctggcccaggccaaggaggagaacgtgggcctgcaccagaccctggaccagaccctgaacgagctgaactgcatctag

SEQ ID NO: 103739 - DNA, 855 bp, Artificial Sequence
  Description of Artificial Sequence: Synthetic coding sequence
atggaggccatcaagaagaagatgcagatgctgaagctggacaaggagaacgccatcgacagagccgagcaggccgaggccgacaagaaggccgccgaggacaagtgcaagcaggtggaggaggagctgacccacctgcagaagaagctgaagggcaccgaggacgagctggacaagtacagcgaggacctgaaggacgcccaggagaagctggagctgaccgagaagaaggccagcgacgccgagggcgacgtggccgccctgaacagaagaatccagctggtggaggaggagctggacagagcccaggagagactggccaccgccctgcagaagctggaggaggccgagaaggccgccgacgagagcgagagaggcatgaaggtgatcgagaacagagccatgaaggacgaggagaagatggagatccaggagatgcagctgaaggaggccaagcacatcgccgaggaggccgacagaaagtacgaggaggtggccagaaagctggtgatcctggagggcgagctggagagagccgaggagagagccgaggtgagcgagctgaagtgcggcgacctggaggaggagctgaagaacgtgaccaacaacctgaagagcctggaggccgccagcgagaagtacagcgagaaggaggacaagtacgaggaggagatcaagctgctgagcgacaagctgaaggaggccgagaccagagccgagttcgccgagagaaccgtggccaagctggagaagaccatcgacgacctggaggagaagctggcccaggccaaggaggagaacgtgggcctgcaccagaccctggaccagaccctgaacgagctgaactgcatctag

SEQ ID NO: 103740 - DNA, 855 bp, Artificial Sequence; identical to SEQ ID NO: 103739
  Description of Artificial Sequence: Synthetic coding sequence

SEQ ID NO: 103741 - DNA, 2244 bp, Artificial Sequence
  Description of Artificial Sequence: Synthetic coding sequence
atgggcagactgaacgagcagagactgttccagcccgacctgtgcgacgtggacctggtgctggtgccccagagaagcgtgttccccgcccacaagggcgtgctggccgcctacagccagttcttccacagcctgttcacccagaacaagcagctgcagagagtggagctgagcctggaggccctggcccccggcggcctgcagcagatcctgaacttcatctacaccagcaagctgctggtgaacgccgccaacgtgcacgaggtgctgagcgccgccagcctgctgcagatggccgacatcgccgccagctgccaggagctgctggacgccagaagcctgggcccccccggccccggcaccgtggccctggcccagcccgccgccagctgcacccccgccgcccccccctactactgcgacatcaagcaggaggccgacacccccggcctgcccaagatctacgccagagagggccccgacccctacagcgtgagagtggaggacggcgccggcaccgccggcggcaccgtgcccgccaccatcggccccgcccagcccttcttcaaggaggagaaggagggcggcgtggaggaggccggcggcccccccgccagcctgtgcaagctggagggcggcgaggagctggaggaggagctgggcggcagcggcacctacagcagaagagagcagagccagatcatcgtggaggtgaacctgaacaaccagaccctgcacgtgagcaccggccccgagggcaagcccggcgccggccccagccccgccaccgtggtgctgggcagagaggacggcctgcagagacacagcgacgaggaggaggaggacgacgaggaggaggaggaggaggaggaggaggaggagggcggcggcagcggcagagaggaggaggaggaggaggagggcggcagccagggcgaggaggaggaggaggaggaggacggccacagcgagcaggaggaggaggaggaggaggaggaggaggagggccccagcgagcaggaccaggagagcagcgaggaggaggagggcgaggagggcgaggccggcggcaagcagggccccagaggcagcagaagcagcagagccgacccccccccccacagccacatggccaccagaagcagagagaacgccagaagaagaggcacccccgagcccgaggaggccggcagaagaggcggcaagagacccaagcccccccccggcgtggccagcgccagcgccagaggcccccccgccaccgacggcctgggcgccaaggtgaagctggaggagaagcagcaccacccctgccagaagtgccccagagtgttcaacaacagatggtacctggagaagcacatgaacgtgacccacagcagaatgcagatctgcgaccagtgcggcaagagattcctgctggagagcgagctgctgctgcacagacagaccgactgcgagagaaacatccagtgcgtgacctgcggcaaggccttcaagaagctgtggagcctgcacgagcacaacaagatcgtgcacggctacgccgagaagaagttcagctgcgagatctgcgagaagaagttctacaccatggcccacgtgagaaagcacatggtggcccacaccaaggacatgcccttcacctgcgagacctgcggcaagagcttcaagagaagcatgagcctgaaggtgcacagcctgcagcacagcggcgagaagcccttcagatgcgagaactgcaacgagagattccagtacaagtaccagctgagaagccacatgagcatccacatcggccacaagcagttcatgtgccagtggtgcggcaaggacttcaacatgaagcagtacttcgacgagcacatgaagacccacaccggcgagaagccctacatctgcgagatctgcggcaagagcttcaccagcagacccaacatgaagagacacagaagaacccacaccggcgagaagccctacccctgcgacgtgtgcggccagagattcagattcagcaacatgctgaaggcccacaaggagaagtgcttcagagtgagccacaccctggccggcgacggcgtgcccgccgcccccggcctgccccccacccagccccaggcccacgccctgcccctgctgcccggcctgccccagaccctgcccccccccccccacctgcccccccccccccccctgttccccaccaccgccagccccggcggcagaatgaacgccaacaactag

SEQ ID NO: 103742 - DNA, 483 bp, Artificial Sequence
  Description of Artificial Sequence: Synthetic coding sequence
atgaccgaccagcaggccgaggccagaagctacctgagcgaggagatgatcgccgagttcaaggccgccttcgacatgttcgacgccgacggcggcggcgacatcagcgtgaaggagctgggcaccgtgatgagaatgctgggccagacccccaccaaggaggagctggacgccatcatcgaggaggtggacgaggacggcagcggcaccatcgacttcgaggagttcctggtgatgatggtgagacagatgaaggaggacgccaagggcaagagcgaggaggagctggccgagtgcttcagaatcttcgacagaaacgccgacggctacatcgaccccgaggagctggccgagatcttcagagccagcggcgagcacgtgaccgacgaggagatcgagagcctgatgaaggacggcgacaagaacaacgacggcagaatcgacttcgacgagttcctgaagatgatggagggcgtgcagtag

SEQ ID NO: 103743 - DNA, 438 bp, Artificial Sequence
  Description of Artificial Sequence: Synthetic coding sequence
atgatcgccgagttcaaggccgccttcgacatgttcgacgccgacggcggcggcgacatcagcgtgaaggagctgggcaccgtgatgagaatgctgggccagacccccaccaaggaggagctggacgccatcatcgaggaggtggacgaggacggcagcggcaccatcgacttcgaggagttcctggtgatgatggtgagacagatgaaggaggacgccaagggcaagagcgaggaggagctggccgagtgcttcagaatcttcgacagaaacgccgacggctacatcgaccccgaggagctggccgagatcttcagagccagcggcgagcacgtgaccgacgaggagatcgagagcctgatgaaggacggcgacaagaacaacgacggcagaatcgacttcgacgagttcctgaagatgatggagggcgtgcagtag

SEQ ID NO: 103744 - DNA, 564 bp, Artificial Sequence
  Description of Artificial Sequence: Synthetic coding sequence
atgcccgaggtggagagaaagcccaagatcaccgccagcagaaagctgctgctgaagagcctgatgctggccaaggccaaggagtgctgggagcaggagcacgaggagagagaggccgagaaggtgagatacctggccgagagaatccccaccctgcagaccagaggcctgagcctgagcgccctgcaggacctgtgcagagagctgcacgccaaggtggaggtggtggacgaggagagatacgacatcgaggccaagtgcctgcacaacaccagagagatcaaggacctgaagctgaaggtgatggacctgagaggcaagttcaagagaccccccctgagaagagtgagagtgagcgccgacgccatgctgagagccctgctgggcagcaagcacaaggtgagcatggacctgagagccaacctgaagagcgtgaagaaggaggacaccgagaaggagagacccgtggaggtgggcgactggagaaagaacgtggaggccatgagcggcatggagggcagaaagaagatgttcgacgccgccaagagccccaccagccagtag

SEQ ID NO: 103745 - DNA, 564 bp, Artificial Sequence
  Description of Artificial Sequence: Synthetic coding sequence
atgcccgaggtgcagagaaagcccaagatcaccgccagcagaaagctgctgctgaagagcctgatgctggccaaggccaaggagtgctgggagcaggagcacgaggagagagaggccgagaaggtgagatacctggccgagagaatccccaccctgcagaccagaggcctgagcctgagcgccctgcaggacctgtgcagagagctgcacgccaaggtggaggtggtggacgaggagagatacgacatcgaggccaagtgcctgcacaacaccagagagatcaaggacctgaagctgaaggtgatggacctgagaggcaagttcaagagaccccccctgagaagagtgagagtgagcgccgacgccatgctgagagccctgctgggcagcaagcacaaggtgagcatggacctgagagccaacctgaagagcgtgaagaaggaggacaccgagaaggagagacccgtggaggtgggcgactggagaaagaacgtggaggccatgagcggcatggagggcagaaagaagatgttcgacgccgccaagagccccaccagccagtag

SEQ ID NO: 103746 - DNA, 564 bp, Artificial Sequence; identical to SEQ ID NO: 103744
  Description of Artificial Sequence: Synthetic coding sequence

SEQ ID NO: 103747 - DNA, 564 bp, Artificial Sequence; identical to SEQ ID NO: 103744
  Description of Artificial Sequence: Synthetic coding sequence

SEQ ID NO: 103748 - DNA, 564 bp, Artificial Sequence; identical to SEQ ID NO: 103745
  Description of Artificial Sequence: Synthetic coding sequence

SEQ ID NO: 103749 - DNA, 414 bp, Artificial Sequence
  Description of Artificial Sequence: Synthetic coding sequence
atgcccgaggtggagagaaagcccaagatcaccgccagcagaaagctgctgctgaagagcctgatgctggccaaggccaaggagtgctgggagcaggagcacgaggagagagaggccgagaaggtgagatacctggccgagagaatccccaccctgcagaccagaggcctgagcctgagcgccctgcaggacctgtgcagagagctgcacgccaaggtggaggtggtggacgaggagagatacgacatcgaggccaagtgcctgcacaacaccagagagatcaaggacctgaagctgaaggtgatggacctgagaggcaagttcaagagaccccccctgagaagagtgagagtgagcgccgacgccatgctgagagccctgctgggcagcaagcacaaggtgagcatggactag

SEQ ID NO: 103750 - DNA, 549 bp, Artificial Sequence
  Description of Artificial Sequence: Synthetic coding sequence
atgagccagtgcaagaagagaaacagagccatcaccgccagaagacagcacctgaagagcgtgatgctgcagatcgccgccaccgagctggagaaggaggagagcagaagagaggccgagaagcagaactacctggccgagcactgcccccccctgcacatccccggcagcatgagcgaggtgcaggagctgtgcaagcagctgcacgccaagatcgacgccgccgaggaggagaagtacgacatggaggtgagagtgcagaagaccagcaaggagctggaggacatgaaccagaagctgttcgacctgagaggcaagttcaagagaccccccctgagaagagtgagaatgagcgccgacgccatgctgaaggccctgctgggcagcaagcacaaggtgtgcatggacctgagagccaacctgaagcaggtgaagaaggaggacaccgagaaggagagagacctgagagacgtgggcgactggagaaagaacatcgaggagaagagcggcatggagggcagaaagaagatgttcgagagcgagagctag

SEQ ID NO: 103751 - DNA, 549 bp, Artificial Sequence
  Description of Artificial Sequence: Synthetic coding sequence
atgggcgacgaggagaagagaaacagagccatcaccgccagaagacagcacctgaagagcgtgatgctgcagatcgccgccaccgagctggagaaggaggagagcagaagagaggccgagaagcagaactacctggccgagcactgcccccccctgcacatccccggcagcatgagcgaggtgcaggagctgtgcaagcagctgcacgccaagatcgacgccgccgaggaggagaagtacgacatggaggtgagagtgcagaagaccagcaaggagctggaggacatgaaccagaagctgttcgacctgagaggcaagttcaagagaccccccctgagaagagtgagaatgagcgccgacgccatgctgaaggccctgctgggcagcaagcacaaggtgtgcatggacctgagagccaacctgaagcaggtgaagaaggaggacaccgagaaggagagagacctgagagacgtgggcgactggagaaagaacatcgaggagaagagcggcatggagggcagaaagaagatgttcgagagcgagagctag

SEQ ID NO: 103752 - DNA, 549 bp, Artificial Sequence; identical to SEQ ID NO: 103751
  Description of Artificial Sequence: Synthetic coding sequence

SEQ ID NO: 103753 - DNA, 549 bp, Artificial Sequence; identical to SEQ ID NO: 103751
  Description of Artificial Sequence: Synthetic coding sequence

SEQ ID NO: 103754 - DNA, 633 bp, Artificial Sequence
  Description of Artificial Sequence: Synthetic coding sequence
atggccgacggcagcagcgacgccgccagagagcccagacccgcccccgcccccatcagaagaagaagcagcaactacagagcctacgccaccgagccccacgccaagaagaagagcaagatcagcgccagcagaaagctgcagctgaagaccctgctgctgcagatcgccaagcaggagctggagagagaggccgaggagagaagaggcgagaagggcagagccctgagcaccagatgccagcccctggagctggccggcctgggcttcgccgagctgcaggacctgtgcagacagctgcacgccagagtggacaaggtggacgaggagagatacgacatcgaggccaaggtgaccaagaacatcaccgagatcgccgacctgacccagaagatcttcgacctgagaggcaagttcaagagacccaccctgagaagagtgagaatcagcgccgacgccatgatgcaggccctgctgggcgccagagccaaggagagcctggacctgagagcccacctgaagcaggtgaagaaggaggacaccgagaaggagaacagagaggtgggcgactggagaaagaacatcgacgccctgagcggcatggagggcagaaagaagaagttcgagagctag

SEQ ID NO: 103755 - DNA, 837 bp, Artificial Sequence
  Description of Artificial Sequence: Synthetic coding sequence
atgagcgacaccgaggagcaggagtacgaggaggagcagcccgaggaggaggccgccgaggaggaggaggaggcccccgaggagcccgagcccgtggccgagcccgaggaggagagacccaagcccagcagacccgtggtgccccccctgatcccccccaagatccccgagggcgagagagtggacttcgacgacatccacagaaagagaatggagaaggacctgctggagctgcagaccctgatcgacgtgcacttcgagcagagaaagaaggaggaggaggagctggtggccctgaaggagagaatcgagagaagaagaagcgagagagccgagcagcagagattcagaaccgagaaggagagagagagacaggccaagctggccgaggagaagatgagaaaggaggaggaggaggccaagaagagagccgaggacgacgccaagaagaagaaggtgctgagcaacatgggcgcccacttcggcggctacctggtgaaggccgagcagaagagaggcaagagacagaccggcagagagatgaaggtgagaatcctgagcgagagaaagaagcccctggacatcgactacatgggcgaggagcagctgagagccagaagcgcctggctgccccccagccagcccagctgccccgccagagagaaggcccaggagctgagcgactggatccaccagctggagagcgagaagttcgacctgatggccaagctgaagcagcagaagtacgagatcaacgtgctgtacaacagaatcagccacgcccagaagttcagaaagggcgccggcaagggcagagtgggcggcagatggaagtag

SEQ ID NO: 103756 - DNA, 837 bp, Artificial Sequence; identical to SEQ ID NO: 103755
  Description of Artificial Sequence: Synthetic coding sequence

SEQ ID NO: 103757 - DNA, 756 bp, Artificial Sequence
  Description of Artificial Sequence: Synthetic coding sequence
atgagcgacaccgaggagcaggagtacgaggaggagcagcccgaggaggaggccgccgaggaggaggaggaggaggaggagagacccaagcccagcagacccgtggtgccccccctgatcccccccaagatccccgagggcgagagagtggacttcgacgacatccacagaaagagaatggagaaggacctgctggagctgcagaccctgatcgacgtgcacttcgagcagagaaagaaggaggaggaggagctggtggccctgaaggagagaatcgagagaagaagaagcgagagagccgagcagcagagattcagaaccgagaaggagagagagagacaggccaagctggccgaggagaagatgagaaaggaggaggaggaggccaagaagagagccgaggacgacgccaagaagaagaaggtgctgagcaacatgggcgcccacttcggcggctacctggtgaaggccgagcagaagagaggcaagagacagaccggcagagagatgaaggtgagaatcctgagcgagagaaagaagcccctggacatcgactacatgggcgaggagcagctgagagagaaggcccaggagctgagcgactggatccaccagctggagagcgagaagttcgacctgatggccaagctgaagcagcagaagtacgagatcaacgtgctgtacaacagaatcagccacgcccagaagttcagaaagggcgccggcaagggcagagtgggcggcagatggaagtag

SEQ ID NO: 103758 - DNA, 522 bp, Artificial Sequence
  Description of Artificial Sequence: Synthetic coding sequence
agcaaggcccagccccaggacagccagcacctgagacacagcctgggcagaaccagaatgagcgacaccgaggagcaggagtacgaggaggagcagcccgaggaggaggccgccgaggaggaggaggagggcgaggtgcccgacagcgccgaggaggagagacccaagcccagcagacccgtggtgccccccctgatcccccccaagatccccgagggcgagagagtggacttcgacgacatccacagaaagagaatggagaaggacctgctggagctgcagaccctgatcgacgtgcacttcgagcagagaaagaaggaggaggaggagctggtggccctgaaggagagaatcgagagaagaagaagcgagagagccgagcagcagagattcagaaccgagaaggagagagagagacaggccaagctggccgaggagaagatgagaaaggaggaggaggaggccaagaagagagccgaggacgacgccaagaagaagaagaagaagaagaagaagaagtag

SEQ ID NO: 103759 - DNA, 756 bp, Artificial Sequence
  Description of Artificial Sequence: Synthetic coding sequence
atgagcgacaccgaggagcaggagtacgaggaggagcagcccgaggaggaggccgccgaggaggaggaggaggcccccgaggagcccgagcccgtgagacccgtggtgccccccctgatcccccccaagatccccgagggcgagagagtggacttcgacgacatccacagaaagagaatggagaaggacctgctggagctgcagaccctgatcgacgtgcacttcgagcagagaaagaaggaggaggaggagctggtggccctgaaggagagaatcgagagaagaagaagcgagagagccgagcagcagagattcagaaccgagaaggagagagagagacaggccaagctggccgaggagaagatgagaaaggaggaggaggaggccaagaagagagccgaggacgacgccaagaagaagaaggtgctgagcaacatgggcgcccacttcggcggctacctggtgaaggccgagcagaagagaggcaagagacagaccggcagagagatgaaggtgagaatcctgagcgagagaaagaagcccctggacatcgactacatgggcgaggagcagctgagagagaaggcccaggagctgagcgactggatccaccagctggagagcgagaagttcgacctgatggccaagctgaagcagcagaagtacgagatcaacgtgctgtacaacagaatcagccacgcccagaagttcagaaagggcgccggcaagggcagagtgggcggcagatggaagtag

SEQ ID NO: 103760 - DNA, 579 bp, Artificial Sequence
  Description of Artificial Sequence: Synthetic coding sequence
atggagaaggacctgctggagctgcagaccctgatcgacgtgcacttcgagcagagaaagaaggaggaggaggagctggtggccctgaaggagagaatcgagagaagaagaagcgagagagccgagcagcagagattcagaaccgagaaggagagagagagacaggccaagctggccgaggagaagatgagaaaggaggaggaggaggccaagaagagagccgaggacgacgccaagaagaagaaggtgctgagcaacatgggcgcccacttcggcggctacctggtgaaggccgagcagaagagaggcaagagacagaccggcagagagatgaaggtgagaatcctgagcgagagaaagaagcccctggacatcgactacatgggcgaggagcagctgagagagaaggcccaggagctgagcgactggatccaccagctggagagcgagaagttcgacctgatggccaagctgaagcagcagaagtacgagatcaacgtgctgtacaacagaatcagccacgcccagaagttcagaaagggcgccggcaagggcagagtgggcggcagatggaagtag

SEQ ID NO: 103761 - DNA, 882 bp, Artificial Sequence
  Description of Artificial Sequence: Synthetic coding sequence
atgagcgacatcgaggaggtggtggaggagtacgaggaggagcaccccgaggaggaggaggactggagagaggacgaggacgagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagcaggcccagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103762 - DNA, 600 bp, Artificial Sequence
  Description of Artificial Sequence: Synthetic coding sequence
atgagcgacatcgaggaggtggtggaggagtacgaggaggagatggccgccccccagcaccaggaggaggccgccgaggaggacgccgaggccgaggccgagaccgaggagaccagagccgaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagcacccccccgacagagccgagaagtgggaggaggccgactag

SEQ ID NO: 103763 - DNA, 852 bp, Artificial Sequence
  Description of Artificial Sequence: Synthetic coding sequence
atgagcgacatcgaggaggtggtggaggagtacgaggaggaggccaagctggagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagcaggcccagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103764 - DNA, 858 bp, Artificial Sequence
  Description of Artificial Sequence: Synthetic coding sequence
atgagcgacatcgaggaggtggtggaggagtacgaggaggaggagcaggaggaggccgccgtggaggagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103765 - DNA, 867 bp, Artificial Sequence
  Description of Artificial Sequence: Synthetic coding sequence
atgagcgacatcgaggaggtggtggaggagtacgaggaggaggagcaggaggaggccgccgtggaggagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagcaggcccagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103766 - DNA, 867 bp, Artificial Sequence; identical to SEQ ID NO: 103765
  Description of Artificial Sequence: Synthetic coding sequence

SEQ ID NO: 103767 - DNA, 681 bp, Artificial Sequence
  Description of Artificial Sequence: Synthetic coding sequence
atggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103768 - DNA, 858 bp, Artificial Sequence; identical to SEQ ID NO: 103764
  Description of Artificial Sequence: Synthetic coding sequence

SEQ ID NO: 103769 - DNA, 876 bp, Artificial Sequence
  Description of Artificial Sequence: Synthetic coding sequence
atgagcgacatcgaggaggtggtggaggagtacgaggaggagtacctggagcacgccgaggccgccgtggaggagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagcacaccctgcagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103770 - DNA, 894 bp, Artificial Sequence
  Description of Artificial Sequence: Synthetic coding sequence
atgagcgacatcgaggaggtggtggaggagtacgaggaggagtacctggagcacgccgaggccgccgtggaggaggaggaggactggagagaggacgaggacgagcaggaggaggccgccgaggaggacgccgaggccgaggccgagaccgaggagaccagagccgaggaggacgaggaggaggaggaggccaaggaggccgaggacggccccatggaggagagcaagcccaagcccagaagcttcatgcccaacctggtgccccccaagatccccgacggcgagagagtggacttcgacgacatccacagaaagagaatggagaaggacctgaacgagctgcaggccctgatcgaggcccacttcgagaacagaaagaaggaggaggaggagctggtgagcctgaaggacagaatcgagagaagaagagccgagagagccgagcagcagagaatcagaaacgagagagagaaggagagacagaacagactggccgaggagagagccagaagagaggaggaggagaacagaagaaaggccgaggacgaggccagaaagaagaaggccctgagcaacatgatgcacttcggcggctacatccagaagaccgagagaaagagcggcaagagacagaccgagagagagaagaagaagaagatcctggccgagagaagaaaggtgctggccatcgaccacctgaacgaggaccagctgagagagaaggccaaggagctgtggcagagcatctacaacctggaggccgagaagttcgacctgcaggagaagttcaagcagcagaagtacgagatcaacgtgctgagaaacagaatcaacgacaaccagaaggtgagcaagaccagaggcaaggccaaggtgaccggcagatggaagtag

SEQ ID NO: 103771 - DNA, 867 bp, Artificial Sequence; identical to SEQ ID NO: 103765
  Description of Artificial Sequence: Synthetic coding sequence

SEQ ID NO: 103772 - DNA, 771 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggtgcacgagcccgaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103773 - DNA, 777 bp, Artificial Sequence
  Description of Artificial Sequence: Synthetic coding sequence
atgagcgacgaggaggtggagcaggtggaggagcagtacgaggaggaggaggaggcccaggaggaggaggaggtgcaggaggacaccgccgaggaggacgccgaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103774 - DNA, 738 bp, Artificial Sequence
  Description of Artificial Sequence: Synthetic coding sequence
atgagcgacgaggaggtggagcaggtggaggagcagtacgaggaggaggaggaggcccaggaggaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103775 - DNA, 759 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcatgaacgtgagagccagagtgcagatgctggccaagttcagcaagaaggccggcacccccgccaagggcaaggtgggcggcagatggaagtag

SEQ ID NO: 103776 - DNA, 783 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggacaccgccgaggaggacgccgaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103777 - DNA, 753 bp, Artificial Sequence
  Description of Artificial Sequence: Synthetic coding sequence
atgagcgacgaggaggtggagcaggtggaggagcagtacgaggaggaggaggaggcccaggaggaggaggaggtgcaggaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103778 - DNA, 786 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggagggcatgagaacccaggacttcttccacgaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103779 - DNA, 786 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggtgcacgagcccgaggaggtgcaggaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103780 - DNA, 753 bp, Artificial Sequence
  Description of Artificial Sequence: Synthetic coding sequence
atgagcgacgaggaggtggagcaggtggaggagcagtacgaggaggaggaggaggcccaggaggaggaggaggtgcaggaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcatgaacgtgagagccagagtgcagatgctggccaagttcagcaagaaggccggcacccccgccaagggcaaggtgggcggcagatggaagtag

SEQ ID NO: 103781 - DNA, 810 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggtgcacgagcccgaggaggtgcaggaggacaccgccgaggaggacgccgaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103782 - DNA, 813 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggcccaccccggcgaggagagcgtgagagaggacaccgccgaggaggacgccgaggaggagaagcccagacccaagctgaccgcccccaagatccccgagggcgagaaggtggacttcgacgacatccagaagaagagacagaacaaggacctgatggagctgcaggccctgatcgacagccacttcgaggccagaaagaaggaggaggaggagctggtggccctgaaggagagaatcgagaagagaagagccgagagagccgagcagcagagaatcagagccgagaaggagagagagagacagaacagactggccgaggagaaggccagaagagaggaggaggacgccaagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagaccctgcaccagctggagatcgacaagttcgagttcggcgagaagctgaagagacagaagtacgacatcaccaccctgagaagcagaatcgaccaggcccagaagcacagcaagaaggccggcacccccgccaagggcaaggtgggcggcagatggaagtag

SEQ ID NO: 103783 - DNA, 435 bp, Artificial Sequence
  Description of Artificial Sequence: Synthetic coding sequence
atgagcgacgaggaggtggagcaggtggaggagcagtacgaggaggaggaggaggcccaggaggaggccgccgaggtgcacgaggaggagagaagagccgaggacgacctgaagaagaagaaggccctgagcagcatgggcgccaactacagcagctacctggccaaggccgaccagaagagaggcaagaagcagaccgccagagagatgaagaagaagatcctggccgagagaagaaagcccctgaacatcgaccacctgggcgaggacaagctgagagacaaggccaaggagctgtgggagcccccccagagctgccagggcctgcccgacagccccggcggcggcgaggccatccccggcagaccccccagactgtgcccctgctgcctgcaccccctgggccccgtgaacaaggccgccgagcccccctag

SEQ ID NO: 103784 - DNA, 1617 bp, Artificial Sequence
  Description of Artificial Sequence: Synthetic coding sequence
atggaggagagcgtgaaccagatgcagcccctgaacgagaagcagatcgccaacagccaggacggctacgtgtggcaggtgaccgacatgaacagactgcacagattcctgtgcttcggcagcgagggcggcacctactacatcaaggagcagaagctgggcctggagaacgccgaggccctgatcagactgatcgaggacggcagaggctgcgaggtgatccaggagatcaagagcttcagccaggagggcagaaccaccaagcaggagcccatgctgttcgccctggccatctgcagccagtgcagcgacatcagcaccaagcaggccgccttcaaggccgtgagcgaggtgtgcagaatccccacccacctgttcaccttcatccagttcaagaaggacctgaaggagagcatgaagtgcggcatgtggggcagagccctgagaaaggccatcgccgactggtacaacgagaagggcggcatggccctggccctggccgtgaccaagtacaagcagagaaacggctggagccacaaggacctgctgagactgagccacctgaagcccagcagcgagggcctggccatcgtgaccaagtacatcaccaagggctggaaggaggtgcacgagctgtacaaggagaaggccctgagcgtggagaccgagaagctgctgaagtacctggaggccgtggagaaggtgaagagaaccagagacgagctggaggtgatccacctgatcgaggagcacagactggtgagagagcacctgctgaccaaccacctgaagagcaaggaggtgtggaaggccctgctgcaggagatgcccctgaccgccctgctgagaaacctgggcaagatgaccgccaacagcgtgctggagcccggcaacagcgaggtgagcctggtgtgcgagaagctgtgcaacgagaagctgctgaagaaggccagaatccaccccttccacatcctgatcgccctggagacctacaagaccggccacggcctgagaggcaagctgaagtggagacccgacgaggagatcctgaaggccctggacgccgccttctacaagaccttcaagaccgtggagcccaccggcaagagattcctgctggccgtggacgtgagcgccagcatgaaccagagagtgctgggcagcatcctgaacgccagcaccgtggccgccgccatgtgcatggtggtgaccagaaccgagaaggacagctacgtggtggccttcagcgacgagatggtgccctgccccgtgaccaccgacatgaccctgcagcaggtgctgatggccatgagccagatccccgccggcggcaccgactgcagcctgcccatgatctgggcccagaagaccaacacccccgccgacgtgttcatcgtgttcaccgacaacgagaccttcgccggcggcgtgcaccccgccatcgccctgagagagtacagaaagaagatggacatccccgccaagctgatcgtgtgcggcatgaccagcaacggcttcaccatcgccgaccccgacgacagaggcatgctggacatgtgcggcttcgacaccggcgccctggacgtgatcagaaacttcaccctggacatgatctag

SEQ ID NO: 103785 - DNA, 1557 bp, Artificial Sequence
  Description of Artificial Sequence: Synthetic coding sequence
atggaggagagcgtgaaccagatgcagcccctgaacgagaagcagatcgccaacagccaggacggctacgtgtggcaggtgaccgacatgaacagactgcacagattcctgtgcttcggcagcgagggcggcacctactacatcaaggagcagaagctgggcctggagaacgccgaggccctgatcagactgatcgaggacggcagaggctgcgaggtgatccaggagatcaagagcttcagccaggagggcagaaccaccaagcaggagcccatgctgttcgccctggccatctgcagccagtgcagcgacatcagcaccaagcaggccgccttcaaggccgtgagcgaggtgtgcagaatccccacccacctgttcaccttcatccagttcaagaaggacctgaaggagagcatgaagtgcggcatgtggggcagagccctgagaaaggccatcgccgactggtacaacgagaagggcggcatggccctggccctggccgtgaccaagtacaagcagagaaacggctggagccacaaggacctgctgagactgagccacctgaagcccagcagcgagggcctggccatcgtgaccaagtacatcaccaagggctggaaggaggtgcacgagctgtacaaggagaaggccctgagcgtggagaccgagaagctgctgaagtacctggaggccgtggagaaggtgaagagaaccagagacgagctggaggtgatccacctgatcgaggagcacagactggtgagagagcacctgctgaccaaccacctgaagagcaaggaggtgtggaaggccctgctgcaggagatgcccctgaccgccctgctgagaaacctgggcaagatgaccgccaacagcgtgctggagcccggcaacagcgaggtgagcctggtgtgcgagaagctgtgcaacgagaagctgctgaagaaggccagaatccaccccttccacatcctgatcgccctggagacctacaagaccggccacggcctgagaggcaagctgaagtggagacccgacgaggagatcctgaaggccctggacgccgccttctacaagaccttcaagaccgtggagcccaccggcaagagattcctgctggccgtggacgtgagcgccagcatgaaccagagagtgctgggcagcatcctgaacgccagcaccgtggccgccgccatgtgcatggtggtgaccagaaccgagaaggacagctacgtggtggccttcagcgacgagatggtgccctgccccgtgaccaccgacatgaccctgcagcaggtgctgatggccatgagccagatccccgccggcggcaccgactgcagcctgcccatgatctgggcccagaagaccaacacccccgccgacgtgttcatcgtgttcaccgacaacgagaccttcgccggcggcgtgcaccccgccatcgccctgagagagtacagaaagaagatggacatccccgccaagctgatcgtgtgcggcatgaccagcaacggcttcaccatcgccgaccccgacgacagagacaccgtgaagtag

SEQ ID NO: 103786 - DNA, 1578 bp, Artificial Sequence
  Description of Artificial Sequence: Synthetic coding sequence
atggaggagagcgtgaaccagatgcagcccctgaacgagaagcagatcgccaacagccaggacggctacgtgtggcaggtgaccgacatgaacagactgcacagattcctgtgcttcggcagcgagggcggcacctactacatcaaggagcagaagctgggcctggagaacgccgaggccctgatcagactgatcgaggacggcagaggctgcgaggtgatccaggagatcaagagcttcagccaggagggcagaaccaccaagcaggagcccatgctgttcgccctggccatctgcagccagtgcagcgacatcagcaccaagcaggccgccttcaaggccgtgagcgaggtgtgcagaatccccacccacctgttcaccttcatccagttcaagaaggacctgaaggagagcatgaagtgcggcatgtggggcagagccctgagaaaggccatcgccgactggtacaacgagaagggcggcatggccctggccctggccgtgaccaagtacaagcagagaaacggctggagccacaaggacctgctgagactgagccacctgaagcccagcagcgagggcctggccatcgtgaccaagtacatcaccaagggctggaaggaggtgcacgagctgtacaaggagaaggccctgagcgtggagaccgagaagctgctgaagtacctggaggccgtggagaaggtgaagagaaccagagacgagctggaggtgatccacctgatcgaggagcacagactggtgagagagcacctgctgaccaaccacctgaagagcaaggaggtgtggaaggccctgctgcaggagatgcccctgaccgccctgctgagaaacctgggcaagatgaccgccaacagcgtgctggagcccggcaacagcgaggtgagcctggtgtgcgagaagctgtgcaacgagaagctgctgaagaaggccagaatccaccccttccacatcctgatcgccctggagacctacaagaccggccacggcctgagaggcaagctgaagtggagacccgacgaggagatcctgaaggccctggacgccgccttctacaagaccttcaagaccgtggagcccaccggcaagagattcctgctggccgtggacgtgagcgccagcatgaaccagagagtgctgggcagcatcctgaacgccagcaccgtggccgccgccatgtgcatggtggtgaccagaaccgagaaggacagctacgtggtggccttcagcgacgagatggtgccctgccccgtgaccaccgacatgaccctgcagcaggtgctgatggccatgagccagatccccgccggcggcaccgactgcagcctgcccatgatctgggcccagaagaccaacacccccgccgacgtgttcatcgtgttcaccgacaacgagaccttcgccggcggcgtgcaccccgccatcgccctgagagagtacagaaagaagatggacatccccgccaagctgatcgtgtgcggcatgaccagcaacggcttcaccatcgccgaccccgacgacagagccctgcagaacaccctgctgaacaagagcttctag

SEQ ID NO: 103787 - DNA, 1605 bp, Artificial Sequence
  Description of Artificial Sequence: Synthetic coding sequence
atggaggagagcgtgaaccagatgcagcccctgaacgagaagcagatcgccaacagccaggacggctacgtgtggcaggtgaccgacatgaacagactgcacagattcctgtgcttcggcagcgagggcggcacctactacatcaaggagcagaagctgggcctggagaacgccgaggccctgatcagactgatcgaggacggcagaggctgcgaggtgatccaggagatcaagagcttcagccaggagggcagaaccaccaagcaggagcccatgctgttcgccctggccatctgcagccagtgcagcgacatcagcaccaagcaggccgccttcaaggccgtgagcgaggtgtgcagaatccccacccacctgttcaccttcatccagttcaagaaggacctgaaggagagcatgaagtgcggcatgtggggcagagccctgagaaaggccatcgccgactggtacaacgagaagggcggcatggccctggccctggccgtgaccaagtacaagcagagaaacggctggagccacaaggacctgctgagactgagccacctgaagcccagcagcgagggcctggccatcgtgaccaagtacatcaccaagggctggaaggaggtgcacgagctgtacaaggagaaggccctgagcgtggagaccgagaagctgctgaagtacctggaggccgtggagaaggtgaagagaaccagagacgagctggaggtgatccacctgatcgaggagcacagactggtgagagagcacctgctgaccaaccacctgaagagcaaggaggtgtggaaggccctgctgcaggagatgcccctgaccgccctgctgagaaacctgggcaagatgaccgccaacagcgtgctggagcccggcaacagcgaggtgagcctggtgtgcgagaagctgtgcaacgagaagctgctgaagaaggccagaatccaccccttccacatcctgatcgccctggagacctacaagaccggccacggcctgagaggcaagctgaagtggagacccgacgaggagatcctgaaggccctggacgccgccttctacaagaccttcaagaccgtggagcccaccggcaagagattcctgctggccgtggacgtgagcgccagcatgaaccagagagtgctgggcagcatcctgaacgccagcaccgtggccgccgccatgtgcatggtggtgaccagaaccgagaaggacagctacgtggtggccttcagcgacgagatggtgccctgccccgtgaccaccgacatgaccctgcagcaggtgctgatggccatgagccagatccccgccggcggcaccgactgcagcctgcccatgatctgggcccagaagaccaacacccccgccgacgtgttcatcgtgttcaccgacaacgagaccttcgccggcggcgtgcaccccgccatcgccctgagagagtacagaaagaagatggacatccccgccaagctgatcgtgtgcggcatgaccagcaacggcttcaccatcgccgaccccgacgacagaggcatgctggacatgtgcggcttcgacaccggcgccctggacccctgcaagatcccctactag

SEQ ID NO: 103788 - DNA, 1617 bp, Artificial Sequence; identical to SEQ ID NO: 103784
  Description of Artificial Sequence: Synthetic coding sequence

SEQ ID NO: 103789 - DNA, 1617 bp, Artificial Sequence; identical to SEQ ID NO: 103784
  Description of Artificial Sequence: Synthetic coding sequence

SEQ ID NO: 103790 - DNA, 792 bp, Artificial Sequence
  Description of Artificial Sequence: Synthetic coding sequence
atgcccctgaccgccctgctgagaaacctgggcaagatgaccgccaacagcgtgctggagcccggcaacagcgaggtgagcctggtgtgcgagaagctgtgcaacgagaagctgctgaagaaggccagaatccaccccttccacatcctgatcgccctggagacctacaagaccggccacggcctgagaggcaagctgaagtggagacccgacgaggagatcctgaaggccctggacgccgccttctacaagaccttcaagaccgtggagcccaccggcaagagattcctgctggccgtggacgtgagcgccagcatgaaccagagagtgctgggcagcatcctgaacgccagcaccgtggccgccgccatgtgcatggtggtgaccagaaccgagaaggacagctacgtggtggccttcagcgacgagatggtgccctgccccgtgaccaccgacatgaccctgcagcaggtgctgatggccatgagccagatccccgccggcggcaccgactgcagcctgcccatgatctgggcccagaagaccaacacccccgccgacgtgttcatcgtgttcaccgacaacgagaccttcgccggcggcgtgcaccccgccatcgccctgagagagtacagaaagaagatggacatccccgccaagctgatcgtgtgcggcatgaccagcaacggcttcaccatcgccgaccccgacgacagaggcatgctggacatgtgcggcttcgacaccggcgccctggacgtgatcagaaacttcaccctggacatgatctag

SEQ ID NO: 103791 - DNA, 126 bp, Artificial Sequence
  Description of Artificial Sequence: Synthetic coding sequence
atggaggagagcgtgaaccagatgcagcccctgaacgagaagcagatcgccaacagccaggacggctacgtgtggcaggtgaccgacatgaacagactgcacagattcctgtgcttcggcagctag

SEQ ID NO: 103792 - DNA, 1050 bp, Artificial Sequence
  Description of Artificial Sequence: Synthetic coding sequence
atggccgccagcgaggccgccgtggtgagcagccccagcctgaagaccgacaccagccccgtgctggagaccgccggcaccgtggccgccatggccgccacccccagcgccagagccgccgccgccgtggtggccgccgccgccagaaccggcagcgaggccagagtgagcaaggccgccctggccaccaagctgctgagcctgagcggcgtgttcgccgtgcacaagcccaagggccccaccagcgccgagctgctgaacagactgaaggagaagctgctggccgaggccggcatgcccagccccgagtggaccaagagaaagaagcagaccctgaagatcggccacggcggcaccctggacagcgccgccagaggcgtgctggtggtgggcatcggcagcggcaccaagatgctgaccagcatgctgagcggcagcaagagatacaccgccatcggcgagctgggcaaggccaccgacaccctggacagcaccggcagagtgaccgaggagaagccctacgacaagatcacccaggaggacatcgagggcatcctgcagaagttcaccggcaacatcatgcaggtgccccccctgtacagcgccctgaagaaggacggccagagactgagcaccctgatgaagagaggcgaggtggtggaggccaagcccgccagacccgtgaccgtgtacagcatcagcctgcagaagttccagccccccttcttcaccctggacgtggagtgcggcggcggcttctacatcagaagcctggtgagcgacatcggcaaggagctgagcagctgcgccaacgtgctggagctgaccagaaccaagcagggccccttcaccctggaggagcacgccctgcccgaggacaagtggaccatcgacgacatcgcccagagcctggagcactgcagcagcctgttccccgccgagctggccctgaagaagagcaagcccgagagcaacgagcaggtgctgagctgcgagtacatcaccctgaacgagcccaagagagaggacgacgtgatcaagacctgctag

SEQ ID NO: 103793 - DNA, 996 bp, Artificial Sequence
  Description of Artificial Sequence: Synthetic coding sequence
atgggcagcgccggcctgagcagactgcacggcctgttcgccgtgtacaagccccccggcctgaagtggaagcacctgagagacaccgtggagctgcagctgctgaagggcctgaacgccagaaagccccccgcccccaagcagagagtgagattcctgctgggccccatggagggcagcgaggagaaggagctgaccctgaccgccaccagcgtgcccagcttcatcaaccaccccctggtgtgcggccccgccttcgcccacctgaaggtgggcgtgggccacagactggacgcccaggccagcggcgtgctggtgctgggcgtgggccacggctgcagactgctgaccgacatgtacaacgcccacctgaccaaggactacaccgtgagaggcctgctgggcaaggccaccgacgacttcagagaggacggcagactggtggagaagaccacctacgaccacgtgaccagagagaagctggacagaatcctggccgtgatccagggcagccaccagaaggccctggtgatgtacagcaacctggacctgaagacccaggaggcctacgagatggccgtgagaggcctgatcagacccatgaacaagagccccatgctgatcaccggcatcagatgcctgtacttcgccccccccgagttcctgctggaggtgcagtgcatgcacgagacccagaaggagctgagaaagctggtgcacgagatcggcctggagctgaagaccaccgccgtgtgcacccaggtgagaagaaccagagacggcttcttcaccctggacagcgccctgctgagaacccagtgggacctgaccaacatccaggacgccatcagagccgccaccccccaggtggccgccgagctggagaagagcctgagccccggcctggacaccaagcagctgcccagccccggctggagctgggacagccagggccccagcagcaccctgggcctggagagaggcgccggccagtag

SEQ ID NO: 103794 - DNA, 828 bp, Artificial Sequence
  Description of Artificial Sequence: Synthetic coding sequence
atggagggcagcgaggagaaggagctgaccctgaccgccaccagcgtgcccagcttcatcaaccaccccctggtgtgcggccccgccttcgcccacctgaaggtgggcgtgggccacagactggacgcccaggccagcggcgtgctggtgctgggcgtgggccacggctgcagactgctgaccgacatgtacaacgcccacctgaccaaggactacaccgtgagaggcctgctgggcaaggccaccgacgacttcagagaggacggcagactggtggagaagaccacctacgaccacgtgaccagagagaagctggacagaatcctggccgtgatccagggcagccaccagaaggccctggtgatgtacagcaacctggacctgaagacccaggaggcctacgagatggccgtgagaggcctgatcagacccatgaacaagagccccatgctgatcaccggcatcagatgcctgtacttcgccccccccgagttcctgctggaggtgcagtgcatgcacgagacccagaaggagctgagaaagctggtgcacgagatcggcctggagctgaagaccaccgccgtgtgcacccaggtgagaagaaccagagacggcttcttcaccctggacagcgccctgctgagaacccagtgggacctgaccaacatccaggacgccatcagagccgccaccccccaggtggccgccgagctggagaagagcctgagccccggcctggacaccaagcagctgcccagccccggctggagctgggacagccagggccccagcagcaccctgggcctggagagaggcgccggccagtag

SEQ ID NO: 103795 - DNA, 1701 bp, Artificial Sequence
  Description of Artificial Sequence: Synthetic coding sequence
atgagaagacagtggggcagcgccatgagagccgccgagcaggccggctgcatggtgagcgccagcagagccggccagcccgaggccggcccctggagctgcagcggcgtgatcctgagcagaagccccggcctggtgctgtgccacggcggcatcttcgtgcccttcctgagagccggcagcgaggtgctgaccgccgccggcgccgtgttcctgcccggcgacagctgcagagacgacctgagactgcacgtgcagtgggcccccaccgccgccggccccggcggcggcgccgagagaggcagacccggcctgtgcaccccccagtgcgccagcctggagcccggcccccccgcccccagcagaggcagacccctgcagcccagactgcccgccgagctgctgctgctgctgagctgccccgccttctgggcccacttcgccagactgttcggcgacgaggccgccgagcagtggagattcagcagcgccgccagagacgacgaggtgagcgaggacgaggaggccgaccagctgagagccctgggctggttcgccctgctgggcgtgagactgggccaggaggaggtggaggaggagagaggccccgccatggccgtgagccccctgggcgccgtgcccaagggcgcccccctgctggtgtgcggcagccccttcggcgccttctgccccgacatcttcctgaacaccctgagctgcggcgtgctgagcaacgtggccggccccctgctgctgaccgacgccagatgcctgcccggcaccgagggcggcggcgtgttcaccgccagacccgccggcgccctggtggccctggtggtggcccccctgtgctggaaggccggcgagtgggtgggcttcaccctgctgtgcgccgccgcccccctgttcagagccgccagagacgccctgcacagactgccccacagcaccgccgccctggccgccctgctgccccccgaggtgggcgtgccctggggcctgcccctgagagacagcggccccctgtgggccgccgccgccgtgctggtggagtgcggcaccgtgtggggcagcggcgtggccgtggcccccagactggtggtgacctgcagacacgtgagccccagagaggccgccagagtgctggtgagaagcaccacccccaagagcgtggccatctggggcagagtggtgttcgccacccaggagacctgcccctacgacatcgccgtggtgagcctggaggaggacctggacgacgtgcccatccccgtgcccgccgagcacttccacgagggcgaggccgtgagcgtggtgggcttcggcgtgttcggccagagctgcggccccagcgtgaccagcggcatcctgagcgccgtggtgcaggtgaacggcacccccgtgatgctgcagaccacctgcgccgtgcacagcggcagcagcggcggccccctgttcagcaaccacagcggcaacctgctgggcatcatcaccagcaacaccagagacaacaacaccggcgccacctacccccacctgaacttcagcatccccatcaccgtgctgcagcccgccctgcagcagtacagccagacccaggacctgggcggcctgagagagctggacagagccgccgagcccgtgagagtggtgtggagactgcagagacccctggccgaggcccccagaagcaagctgtag

SEQ ID NO: 103796 - DNA, 1197 bp, Artificial Sequence
  Description of Artificial Sequence: Synthetic coding sequence
atgagaagacagtggggcagcgccatgagagccgccgagcaggccggctgcatggtgagcgccagcagagccggccagcccgaggccggcccctggagctgcagcggcgtgatcctgagcagaagccccggcctggtgctgtgccacggcggcatcttcgtgcccttcctgagagccggcagcgaggtgctgaccgccgccggcgccgtgttcctgcccggcgacagctgcagagacgacctgagactgcacgtgcagtgggcccccaccgccgccggccccggcggcggcgccgagagaggcagacccggcctgtgcaccccccagtgcgccagcctggagcccggcccccccgcccccagcagaggcagacccctgcagcccagactgcccgccgagctgctgctgctgctgagctgccccgccttctgggcccacttcgccagactgttcggcgacgaggccgccgagcagtggagattcagcagcgccgccagagacgacgaggtgagcgaggacgaggaggccgaccagctgagagccctgggctggttcgccctgctgggcgtgagactgggccaggaggaggtggaggaggagagaggccccgccatggccgtgagccccctgggcgccgtgcccaagggcgcccccctgctggtgtgcggcagccccttcggcgccttctgccccgacatcttcctgaacaccctgagctgcggcgtgctgagcaacgtggccggccccctgctgctgaccgacgccagatgcctgcccggcaccgagggcggcggcgtgttcaccgccagacccgccggcgccctggtggccctggtggtggcccccctgtgctggaaggccggcgagtgggtgggcttcaccctgctgtgcgccgccgcccccctgttcagagccgccagagacgccctgcacagactgccccacagcaccgccgccctggccgccctgctgccccccgaggtgggcgtgccctggggcctgcccctgagagacagcggccccctgtgggccgccgccgccgtgctggtggagtgcggcaccgtgtggggcagcggcgtggccgtggcccccagactggtggtgacctgcagacacgtgagccccagagaggccgccagagtgctggtgagaagcaccacccccaagcacaaccaccagcagcaccccggccagtag

SEQ ID NO: 103797 - DNA, 828 bp, Artificial Sequence
  Description of Artificial Sequence: Synthetic coding sequence
atgctgaacctgctgctgctggccctgcccgtgctggccagcagagcctacgccgcccccgcccccggccaggccctgcagagagtgggcatcgtgggcggccaggaggcccccagaagcaagtggccctggcaggtgagcctgagagtgcacggcccctactggatgcacttctgcggcggcagcctgatccacccccagtgggtgctgaccgccgcccactgcgtgggccccgacgtgaaggacctggccgccctgagagtgcagctgagagagcagcacctgtactaccaggaccagctgctgcccgtgagcagaatcatcgtgcacccccagttctacaccgcccagatcggcgccgacatcgccctgctggagctggaggagcccgtgaacgtgagcagccacgtgcacaccgtgaccctgccccccgccagcgagaccttcccccccggcatgccctgctgggtgaccggctggggcgacgtggacaacgacgagagactgcccccccccttccccctgaagcaggtgaaggtgcccatcatggagaaccacatctgcgacgccaagtaccacctgggcgcctacaccggcgacgacgtgagaatcgtgagagacgacatgctgtgcgccggcaacaccagaagagacagctgccagggcgacagcggcggccccctggtgtgcaaggtgaacggcacctggctgcaggccggcgtggtgagctggggcgagggctgcgcccagcccaacagacccggcatctacaccagagtgacctactacctggactggatccaccactacgtgcccaagaagccctag

SEQ ID NO: 103798 - DNA, 849 bp, Artificial Sequence
  Description of Artificial Sequence: Synthetic coding sequence
atgctgctgctggccccccagatgctgaacctgctgctgctggccctgcccgtgctggccagcagagcctacgccgcccccgcccccggccaggccctgcagagagtgggcatcgtgggcggccaggaggcccccagaagcaagtggccctggcaggtgagcctgagagtgcacggcccctactggatgcacttctgcggcggcagcctgatccacccccagtgggtgctgaccgccgcccactgcgtgggccccgacgtgaaggacctggccgccctgagagtgcagctgagagagcagcacctgtactaccaggaccagctgctgcccgtgagcagaatcatcgtgcacccccagttctacaccgcccagatcggcgccgacatcgccctgctggagctggaggagcccgtgaacgtgagcagccacgtgcacaccgtgaccctgccccccgccagcgagaccttcccccccggcatgccctgctgggtgaccggctggggcgacgtggacaacgacgagagactgcccccccccttccccctgaagcaggtgaaggtgcccatcatggagaaccacatctgcgacgccaagtaccacctgggcgcctacaccggcgacgacgtgagaatcgtgagagacgacatgctgtgcgccggcaacaccagaagagacagctgccagggcgacagcggcggccccctggtgtgcaaggtgaacggcacctggctgcaggccggcgtggtgagctggggcgagggctgcgcccagcccaacagacccggcatctacaccagagtgacctactacctggactggatccaccactacgtgcccaagaagccctag

SEQ ID NO: 103799 - DNA, 2532 bp, Artificial Sequence
  Description of Artificial Sequence: Synthetic coding sequence
atgtggggcagactgtggcccctgctgctgagcatcctgaccgccaccgccgtgcccggccccagcctgagaagacccagcagagagctggacgccacccccagaatgaccatcccctacgaggagctgagcggcaccagacacttcaagggccaggcccagaactacagcaccctgctgctggaggaggccagcgccagactgctggtgggcgccagaggcgccctgttcagcctgagcgccaacgacatcggcgacggcgcccacaaggagatccactgggaggccagccccgagatgcagagcaagtgccaccagaagggcaagaacaaccagaccgagtgcttcaaccacgtgagattcctgcagagactgaacagcacccacctgtacgcctgcggcacccacgccttccagcccctgtgcgccgccatcgacgccgaggccttcaccctgcccaccagcttcgaggagggcaaggagaagtgcccctacgaccccgccagaggcttcaccggcctgatcatcgacggcggcctgtacaccgccaccagatacgagttcagaagcatccccgacatcagaagaagcagacacccccacagcctgagaaccgaggagacccccatgcactggctgaacgacgccgagttcgtgttcagcgtgctggtgagagagagcaaggccagcgccgtgggcgacgacgacaaggtgtactacttcttcaccgagagagccaccgaggagggcagcggcagcttcacccagagcagaagcagccacagagtggccagagtggccagagtgtgcaagggcgacctgggcggcaagaagatcctgcagaagaagtggaccagcttcctgaaggccagactgatctgccacatccccctgtacgagaccctgagaggcgtgtgcagcctggacgccgagaccagcagcagaacccacttctacgccgccttcaccctgagcacccagtggaagaccctggaggccagcgccatctgcagatacgacctggccgagatccaggccgtgttcgccggcccctacatggagtaccaggacggcagcagaagatggggcagatacgagggcggcgtgcccgagcccagacccggcagctgcatcaccgacagcctgagaagccagggctacaacagcagccaggacctgcccagcctggtgctggacttcgtgaagctgcaccccctgatggccagacccgtggtgcccaccagaggcagacccctgctgctgaagagaaacatcagatacacccacctgaccggcacccccgtgaccacccccgccggccccacctacgacctgctgttcctgggcaccgccgacggctggatccacaaggccgtggtgctgggcagcggcatgcacatcatcgaggagacccaggtgttcagagagagccagagcgtggagaacctggtgatcagcctgctgcagcacagcctgtacgtgggcgcccccagcggcgtgatccagctgcccctgagcagctgcagcagatacagaagctgctacgactgcatcctggccagagacccctactgcggctgggaccccggcacccacgcctgcgccgccgccaccaccatcgccaacagaagccagggcagcagaaccgccctgatccaggacatcgagagaggcaacagaggctgcgagagcagcagagacaccggcccccccccccccctgaagaccagaagcgtgctgagaggcgacgacgtgctgctgccctgcgaccagcccagcaacctggccagagccctgtggctgctgaacggcagcatgggcctgagcgacggccagggcggctacagagtgggcgtggacggcctgctggtgaccgacgcccagcccgagcacagcggcaactacggctgctacgccgaggagaacggcctgagaaccctgctggccagctacagcctgaccgtgagacccgccacccccgcccccgcccccaaggcccccgccacccccggcgcccagctggcccccgacgtgagactgctgtacgtgctggccatcgccgccctgggcggcctgtgcctgatcctggccagcagcctgctgtacgtggcctgcctgagagagggcagaagaggcagaagaagaaagtacagcctgggcagagccagcagagccggcggcagcgccgtgcagctgcagaccgtgagcggccagtgccccggcgaggaggacgagggcgacgacgagggcgccggcggcctggagggcagctgcctgcagatcatccccggcgagggcgcccccgccccccccccccccccccccccccccccccccgccgagctgaccaacggcctggtggccctgcccagcagactgagaagaatgaacggcaacagctacgtgctgctgagacagagcaacaacggcgtgcccgccggcccctgcagcttcgccgaggagctgagcagaatcctggagaagagaaagcacacccagctggtggagcagctggacgagagcagcgtgtag

SEQ ID NO: 103800 - DNA, 708 bp, Artificial Sequence
  Description of Artificial Sequence: Synthetic coding sequence
atgctgagcctgctgctgctggccctgcccgtgctggccagccccgcctacgtggcccccgcccccggccaggccctgcagcagaccggcatcgtgggcggccaggaggcccccagaagcaagtggccctggcaggtgagcctgagagtgagaggcccctactggatgcacttctgcggcggcagcctgatccacccccagtgggtgctgaccgccgcccactgcgtggagcccgacatcaaggacctggccgccctgagagtgcagctgagagagcagcacctgtactaccaggaccagctgctgcccgtgagcagaatcatcgtgcacccccagttctacatcatccagaccggcgccgacatcgccctgctggagctggaggagcccgtgaacatcagcagccacatccacaccgtgaccctgccccccgccagcgagaccttcccccccggcatgccctgctgggtgaccggctggggcgacgtggacaacaacgtgcacctgccccccccctaccccctgaaggaggtggaggtgcccgtggtggagaaccacctgtgcaacgccgagtaccacaccggcctgcacaccggccacagcttccagatcgtgagagacgacatgctgtgcgccggcagcgagaaccacgacagctgccagggcgacagcggcggccccctggtgtgcaaggtgaacggcacctag

SEQ ID NO: 103801 - DNA, 4281 bp, Artificial Sequence
  Description of Artificial Sequence: Synthetic coding sequence
atgcacagcagcaaccccaaggtgagaagcagccccagcggcaacacccagagcagccccaagagcaagcaggaggtgatggtgagaccccccaccgtgatgagccccagcggcaacccccagctggacagcaagttcagcaaccagggcaagcagggcggcagcgccagccagagccagcccagcccctgcgacagcaagagcggcggccacacccccaaggccctgcccggccccggcggcagcatgggcctgaagaacggcgccggcaacggcgccaagggcaagggcaagagagagagaagcatcagcgccgacagcttcgaccagagagaccccggcacccccaacgacgacagcgacatcaaggagtgcaacagcgccgaccacatcaagagccaggacagccagcacaccccccacagcatgacccccagcaacgccaccgcccccagaagcagcacccccagccacggccagaccaccgccaccgagcccacccccgcccagaagacccccgccaaggtggtgtacgtgttcagcaccgagatggccaacaaggccgccgaggccgtgctgaagggccaggtggagaccatcgtgagcttccacatccagaacatcagcaacaacaagaccgagagaagcaccgcccccctgaacacccagatcagcgccctgagaaacgaccccaagcccctgccccagcagccccccgcccccgccaaccaggaccagaacagcagccagaacaccagactgcagcccaccccccccatccccgcccccgcccccaagcccgccgccccccccagacccctggacagagagagccccggcgtggagaacaagctgatccccagcgtgggcagccccgccagcagcacccccctgccccccgacggcaccggccccaacagcacccccaacaacagagccgtgacccccgtgagccagggcagcaacagcagcagcgccgaccccaaggcccccccccccccccccgtgagcagcggcgagccccccaccctgggcgagaaccccgacggcctgagccaggagcagctggagcacagagagagaagcctgcagaccctgagagacatccagagaatgctgttccccgacgagaaggagttcaccggcgcccagagcggcggcccccagcagaaccccggcgtgctggacggcccccagaagaagcccgagggccccatccaggccatgatggcccagagccagagcctgggcaagggccccggccccagaaccgacgtgggcgcccccttcggcccccagggccacagagacgtgcccttcagccccgacgagatggtgccccccagcatgaacagccagagcggcaccatcggccccgaccacctggaccacatgacccccgagcagatcgcctggctgaagctgcagcaggagttctacgaggagaagagaagaaagcaggagcaggtggtggtgcagcagtgcagcctgcaggacatgatggtgcaccagcacggccccagaggcgtggtgagaggccccccccccccctaccagatgacccccagcgagggctgggcccccggcggcaccgagcccttcagcgacggcatcaacatgccccacagcctgccccccagaggcatggccccccaccccaacatgcccggcagccagatgagactgcccggcttcgccggcatgatcaacagcgagatggagggccccaacgtgcccaaccccgccagcagacccggcctgagcggcgtgagctggcccgacgacgtgcccaagatccccgacggcagaaacttcccccccggccagggcatcttcagcggccccggcagaggcgagagattccccaacccccagggcctgagcgaggagatgttccagcagcagctggccgagaagcagctgggcctgccccccggcatggccatggagggcatcagacccagcatggagatgaacagaatgatccccggcagccagagacacatggagcccggcaacaaccccatcttccccagaatccccgtggagggccccctgagccccagcagaggcgacttccccaagggcatccccccccagatgggccccggcagagagctggagttcggcatggtgcccagcggcatgaagggcgacgtgaacctgaacgtgaacatgggcagcaacagccagatgatcccccagaagatgagagaggccggcgccggccccgaggagatgctgaagctgagacccggcggcagcgacatgctgcccgcccagcagaagatggtgcccctgcccttcggcgagcacccccagcaggagtacggcatgggccccagacccttcctgcccatgagccagggccccggcagcaacagcggcctgagaaacctgagagagcccatcggccccgaccagagaaccaacagcagactgagccacatgccccccctgcccctgaaccccagcagcaaccccaccagcctgaacaccgccccccccgtgcagagaggcctgggcagaaagcccctggacatcagcgtggccggcagccaggtgcacagccccggcatcaaccccctgaagagccccaccatgcaccaggtgcagagccccatgctgggcagccccagcggcaacctgaagagcccccagacccccagccagctggccggcatgctggccggccccgccgccgccgccagcatcaagagcccccccgtgctgggcagcgccgccgccagccccgtgcacctgaagagccccagcctgcccgcccccagccccggctggaccagcagccccaagccccccctgcagagccccggcatcccccccaaccacaaggcccccctgaccatggccagccccgccatgctgggcaacgtggagagcggcggcccccccccccccaccgccagccagcccgccagcgtgaacatccccggcagcctgcccagcagcaccccctacaccatgccccccgagcccaccctgagccagaaccccctgagcatcatgatgagcagaatgagcaagttcgccatgcccagcagcacccccctgtaccacgacgccatcaagaccgtggccagcagcgacgacgacagcccccccgccagaagccccaacctgcccagcatgaacaacatgcccggcatgggcatcaacacccagaaccccagaatcagcggccccaaccccgtggtgcccatgcccaccctgagccccatgggcatgacccagcccctgagccacagcaaccagatgcccagccccaacgccgtgggccccaacatccccccccacggcgtgcccatgggccccggcctgatgagccacaaccccatcatgggccacggcagccaggagccccccatggtgccccagggcagaatgggcttcccccagggcttcccccccgtgcagagccccccccagcaggtgcccttcccccacaacggccccagcggcggccagggcagcttccccggcggcatgggcttccccggcgagggccccctgggcagacccagcaacctgccccagagcagcgccgacgccgccctgtgcaagcccggcggccccggcggccccgacagcttcaccgtgctgggcaacagcatgcccagcgtgttcaccgaccccgacctgcaggaggtgatcagacccggcgccaccggcatccccgagttcgacctgagcagaatcatccccagcgagaagcccagccagaccctgcagtacttccccagaggcgaggtgcccggcagaaagcagccccagggccccggccccggcttcagccacatgcagggcatgatgggcgagcaggcccccagaatgggcctggccctgcccggcatgggcggccccggccccgtgggcacccccgacatccccctgggcaccgcccccagcatgcccggccacaaccccatgagaccccccgccttcctgcagcagggcatgatgggcccccaccacagaatgatgagccccgcccagagcaccatgcccggccagcccaccctgatgagcaaccccgccgccgccgtgggcatgatccccggcaaggacagaggccccgccggcctgtacacccaccccggccccgtgggcagccccggcatgatgatgagcatgcagggcatgatgggcccccagcagaacatcatgatccccccccagatgagacccagaggcatggccgccgacgtgggcatgggcggcttcagccagggccccggcaaccccggcaacatgatgttctag

SEQ ID NO: 103802 - DNA, 1221 bp, Artificial Sequence
  Description of Artificial Sequence: Synthetic coding sequence
atgagcggctgccccttcctgggcaacaacttcggctacaccttcaagaagctgcccgtggagggcagcgaggaggacaagagccagaccggcgtgaacagagccagcaagggcggcctgatctacggcaactacctgcacctggagaaggtgctgaacgcccaggagctgcagagcgagaccaagggcaacaagatccacgacgagcacctgttcatcatcacccaccaggcctacgagctgtggttcaagcagatcctgtgggagctggacagcgtgagagagatcttccagaacggccacgtgagagacgagagaaacatgctgaaggtggtgagcagaatgcacagagtgagcgtgatcctgaagctgctggtgcagcagttcagcatcctggagaccatgaccgccctggacttcaacgacttcagagagtacctgagccccgccagcggcttccagagcctgcagttcagactgctggagaacaagatcggcgtgctgcagaacatgagagtgccctacaacagaagacactacagagacaacttcaagggcgaggagaacgagctgctgctgaagagcgagcaggagaagaccctgctggagctggtggaggcctggctggagagaacccccggcctggagccccacggcttcaacttctggggcaagctggagaagaacatcaccagaggcctggaggaggagttcatcagaatccaggccaaggaggagagcgaggagaaggaggagcaggtggccgagttccagaagcagaaggaggtgctgctgagcctgttcgacgagaagagacacgagcacctgctgagcaagggcgagagaagactgagctacagagccctgcagggcgccctgatgatctacttctacagagaggagcccagattccaggtgcccttccagctgctgaccagcctgatggacatcgacagcctgatgaccaagtggagatacaaccacgtgtgcatggtgcacagaatgctgggcagcaaggccggcaccggcggcagcagcggctaccactacctgagaagcaccgtgagcgacagatacaaggtgttcgtggacctgttcaacctgagcacctacctgatccccagacactggatccccaagatgaaccccaccatccacaagttcctgtacaccgccgagtactgcgacagcagctacttcagcagcgacgagagcgactag

SEQ ID NO: 103803 - DNA, 1335 bp, Artificial Sequence
  Description of Artificial Sequence: Synthetic coding sequence
atgatcgaggacaacaaggagaacaaggaccacagcctggagagaggcagagccagcctgatcttcagcctgaagaacgaggtgggcggcctgatcaaggccctgaagatcttccaggagaagcacgtgaacctgctgcacatcgagagcagaaagagcaagagaagaaacagcgagttcgagatcttcgtggactgcgacatcaacagagagcagctgaacgacatcttccacctgctgaagagccacaccaacgtgctgagcgtgaacctgcccgacaacttcaccctgaaggaggacggcatggagaccgtgccctggttccccaagaagatcagcgacctggaccactgcgccaacagagtgctgatgtacggcagcgagctggacgccgaccaccccggcttcaaggacaacgtgtacagaaagagaagaaagtacttcgccgacctggccatgaactacaagcacggcgaccccatccccaaggtggagttcaccgaggaggagatcaagacctggggcaccgtgttccaggagctgaacaagctgtaccccacccacgcctgcagagagtacctgaagaacctgcccctgctgagcaagtactgcggctacagagaggacaacatcccccagctggaggacgtgagcaacttcctgaaggagagaaccggcttcagcatcagacccgtggccggctacctgagccccagagacttcctgagcggcctggccttcagagtgttccactgcacccagtacgtgagacacagcagcgaccccttctacacccccgagcccgacacctgccacgagctgctgggccacgtgcccctgctggccgagcccagcttcgcccagttcagccaggagatcggcctggccagcctgggcgccagcgaggaggccgtgcagaagctggccacctgctacttcttcaccgtggagttcggcctgtgcaagcaggacggccagctgagagtgttcggcgccggcctgctgagcagcatcagcgagctgaagcacgccctgagcggccacgccaaggtgaagcccttcgaccccaagatcacctgcaagcaggagtgcctgatcaccaccttccaggacgtgtacttcgtgagcgagagcttcgaggacgccaaggagaagatgagagagttcaccaagaccatcaagagacccttcggcgtgaagtacaacccctacaccagaagcatccagatcctgaaggacaccaagagcatcaccagcgccatgaacgagctgcagcacgacctggacgtggtgagcgacgccctggccaaggtgagcagaaagcccagcatctag

SEQ ID NO: 103804 - DNA, 1401 bp, Artificial Sequence
  Description of Artificial Sequence: Synthetic coding sequence
atgatcgaggacaacaaggagaacaaggaccacagcctggagagaggcagagccagcctgatcttcagcctgaagaacgaggtgggcggcctgatcaaggccctgaagatcttccaggagaagcacgtgaacctgctgcacatcgagagcagaaagagcaagagaagaaacagcgagttcgagatcttcgtggactgcgacatcaacagagagcagctgaacgacatcttccacctgctgaagagccacaccaacgtgctgagcgtgaacctgcccgacaacttcaccctgaaggaggacggcatggagaccgtgccctggttccccaagaagatcagcgacctggaccactgcgccaacagagtgctgatgtacggcagcgagctggacgccgaccaccccggcttcaaggacaacgtgtacagaaagagaagaaagtacttcgccgacctggccatgaactacaagcacggcgaccccatccccaaggtggagttcaccgaggaggagatcaagacctggggcaccgtgttccaggagctgaacaagctgtaccccacccacgcctgcagagagtacctgaagaacctgcccctgctgagcaagtactgcggctacagagaggacaacatcccccagctggaggacgtgagcaacttcctgaaggagagaaccggcttcagcatcagacccgtggccggctacctgagccccagagacttcctgagcggcctggccttcagagtgttccactgcacccagtacgtgagacacagcagcgaccccttctacacccccgagcccgacacctgccacgagctgctgggccacgtgcccctgctggccgagcccagcttcgcccagttcagccaggagatcggcctggccagcctgggcgccagcgaggaggccgtgcagaagctggccacctgctacttcttcaccgtggagttcggcctgtgcaagcaggacggccagctgagagtgttcggcgccggcctgctgagcagcatcagcgagctgaagcacgccctgagcggccacgccaaggtgaagcccttcgaccccaagatcacctgcaagcaggagtgcctgatcaccaccttccaggacgtgtacttcgtgagcgagagcttcgaggacgccaaggagaagatgagagagttcaccaagaccatcaagagacccttcggcgtgaagtacaacccctacaccagaagcatccagatcctgaaggacaccaagagcatcaccagcgccatgaacgagctgcagcacgacctggacgtggtgagcgacgccctggccaagagcctgaacgaggacgtgctgcaggtgagcgtgttcgccctgctgctgttcctgcccagcctgcacggcgagtgccaccccgacacctag

SEQ ID NO: 103805 - DNA, 753 bp, Artificial Sequence
  Description of Artificial Sequence: Synthetic coding sequence
atgcagcccgccatgatgatgttcagcagcaagtactgggccagaagaggcttcagcctggacagcgccgtgcccgaggagcaccagctgctgggcagcagcaccctgaacaagcccaacagcggcaagaacgacgacaagggcaacaagggcagcagcaagagagaggccgccaccgagagcggcaagaccgccgtggtgttcagcctgaagaacgaggtgggcggcctggtgaaggccctgagactgttccaggagaagagagtgaacatggtgcacatcgagagcagaaagagcagaagaagaagcagcgaggtggagatcttcgtggactgcgagtgcggcaagaccgagttcaacgagctgatccagctgctgaagttccagaccaccatcgtgaccctgaacccccccgagaacatctggaccgaggaggaggagctggaggacgtgccctggttccccagaaagatcagcgagctggacaagtgcagccacagagtgctgatgtacggcagcgagctggacgccgaccaccccggcttcaaggacaacgtgtacagacagagaagaaagtacttcgtggacgtggccatgggctacaagtacggccccagactgctggccgccatcggcgactgggagttccagctgttcagcgtgagcagcagcctgagcagcagcagcctgtgcatgctgagcgtgcacatcctgatggacgtgagaagcatcgtggtggccgtggacatctag

SEQ ID NO: 103806 - DNA, 1473 bp, Artificial Sequence
  Description of Artificial Sequence: Synthetic coding sequence
atgcagcccgccatgatgatgttcagcagcaagtactgggccagaagaggcttcagcctggacagcgccgtgcccgaggagcaccagctgctgggcagcagcaccctgaacaagcccaacagcggcaagaacgacgacaagggcaacaagggcagcagcaagagagaggccgccaccgagagcggcaagaccgccgtggtgttcagcctgaagaacgaggtgggcggcctggtgaaggccctgagactgttccaggagaagagagtgaacatggtgcacatcgagagcagaaagagcagaagaagaagcagcgaggtggagatcttcgtggactgcgagtgcggcaagaccgagttcaacgagctgatccagctgctgaagttccagaccaccatcgtgaccctgaacccccccgagaacatctggaccgaggaggaggagctggaggacgtgccctggttccccagaaagatcagcgagctggacaagtgcagccacagagtgctgatgtacggcagcgagctggacgccgaccaccccggcttcaaggacaacgtgtacagacagagaagaaagtacttcgtggacgtggccatgggctacaagtacggccagcccatccccagagtggagtacaccgaggaggagaccaagacctggggcgtggtgttcagagagctgagcaagctgtaccccacccacgcctgcagagagtacctgaagaacttccccctgctgaccaagtactgcggctacagagaggacaacgtgccccagctggaggacgtgagcatgttcctgaaggagagaagcggcttcaccgtgagacccgtggccggctacctgagccccagagacttcctggccggcctggcctacagagtgttccactgcacccagtacatcagacacggcagcgaccccctgtacacccccgagcccgacacctgccacgagctgctgggccacgtgcccctgctggccgaccccaagttcgcccagttcagccaggagatcggcctggccagcctgggcgccagcgacgaggacgtgcagaagctggccacctgctacttcttcaccatcgagttcggcctgtgcaagcaggagggccagctgagagcctacggcgccggcctgctgagcagcatcggcgagctgaagcacgccctgagcgacaaggcctgcgtgaaggccttcgaccccaagaccacctgcctgcaggagtgcctgatcaccaccttccaggaggcctacttcgtgagcgagagcttcgaggaggccaaggagaagatgagagacttcgccaagagcatcaccagacccttcagcgtgtacttcaacccctacacccagagcatcgagatcctgaaggacaccagaagcatcgagaacgtggtgcaggacctgagaagcgacctgaacaccgtgtgcgacgccctgaacaagatgaaccagtacctgggcatctag

SEQ ID NO: 103807 - DNA, 525 bp, Artificial Sequence
  Description of Artificial Sequence: Synthetic coding sequence
atgagcagcgccgccgccgaccactgggcctggctgctggtgctgagcttcgtgttcggctgcaacgtgctgagaatcctgctgcccagcttcagcagcttcatgagcagagtgctgcagaaggacgccgagcaggagagccagatgagagccgagatccaggacatgaagcaggagctgagcaccgtgaacatgatggacgagttcgccagatacgccagactggagagaaagatcaacaagatgaccgacaagctgaagacccacgtgaaggccagaaccgcccagctggccaagatcaagtgggtgatcagcgtggccttctacgtgctgcaggccgccctgatgatcagcctgatctggaagtactacagcgtgcccgtggccgtggtgcccagcaagtggatcacccccctggacagactggtggccttccccaccagagtggccggcggcgtgggcatcacctgctggatcctggtgtgcaacaaggtggtggccatcgtgctgcaccccttcagctag

SEQ ID NO: 103808 - DNA, 423 bp, Artificial Sequence
  Description of Artificial Sequence: Synthetic coding sequence
atgagcagagtgctgcagaaggacgccgagcaggagagccagatgagagccgagatccaggacatgaagcaggagctgagcaccgtgaacatgatggacgagttcgccagatacgccagactggagagaaagatcaacaagatgaccgacaagctgaagacccacgtgaaggccagaaccgcccagctggccaagatcaagtgggtgatcagcgtggccttctacgtgctgcaggccgccctgatgatcagcctgatctggaagtactacagcgtgcccgtggccgtggtgcccagcaagtggatcacccccctggacagactggtggccttccccaccagagtggccggcggcgtgggcatcacctgctggatcctggtgtgcaacaaggtggtggccatcgtgctgcaccccttcagctag

SEQ ID NO: 103809 - DNA, 423 bp, Artificial Sequence; identical to SEQ ID NO: 103808
  Description of Artificial Sequence: Synthetic coding sequence

SEQ ID NO: 103810 - DNA, 519 bp, Artificial Sequence
  Description of Artificial Sequence: Synthetic coding sequence
atgagcagcgccgccgccgaccactgggcctggctgctggtgctgagcttcgtgttcggctgcaacgtgctgagaatcctgctgcccagcttcagcagcttcatgagcagagtgctgcagaaggacgccgagcaggagagccagatgagagccgagatccaggacatgaagcaggagctgagcaccgtgaacatgatggacgagttcgccagatacgccagactggagagaaagatcaacaagatgaccgacaagctgaagacccacgtgaaggccagaaccgcccagctggccaagatcaagtgggtgatcagcgtggccttctacgtgctgcaggccgccctgatgatcagcctgatctggaagtactacagcgtgcccgtggccgtggtgcccagcaagtggatcacccccctggacagactggtggccttccccaccagagtggccgtgttcagcagcagcatctggaccagcaagtgcttcagcagccccgacaagagcatcctggagaagtag

SEQ ID NO: 103811 - DNA, 1083 bp, Artificial Sequence
  Description of Artificial Sequence: Synthetic coding sequence
atggccctgcacagcatgagaaaggccagagagagatggagcttcatcagagccctgcacaagggcagcgccgccgcccccgccctgcagaaggacagcaagaagagagtgttcagcggcatccagcccaccggcatcctgcacctgggcaactacctgggcgccatcgagagctgggtgagactgcaggacgagtacgacagcgtgctgtacagcatcgtggacctgcacagcatcaccgtgccccaggaccccgccgtgctgagacagagcatcctggacatgaccgccgtgctgctggcctgcggcatcaaccccgagaagagcatcctgttccagcagagccaggtgagcgagcacacccagctgagctggatcctgagctgcatggtgagactgcccagactgcagcacctgcaccagtggaaggccaagaccaccaagcagaagcacgacggcaccgtgggcctgctgacctaccccgtgctgcaggccgccgacatcctgctgtacaagagcacccacgtgcccgtgggcgaggaccaggtgcagcacatggagctggtgcaggacctggcccagggcttcaacaagaagtacggcgagttcttccccgtgcccgagagcatcctgaccagcatgaagaaggtgaagagcctgagagaccccagcgccaagatgagcaagagcgaccccgacaagctggccaccgtgagaatcaccgacagccccgaggagatcgtgcagaagttcagaaaggccgtgaccgacttcaccagcgaggtgacctacgaccccgccggcagagccggcgtgagcaacatcgtggccgtgcacgccgccgtgaccggcctgagcgtggaggaggtggtgagaagaagcgccggcatgaacaccgccagatacaagctggccgtggccgacgccgtgatcgagaagttcgcccccatcaagagagagatcgagaagctgaagctggacaaggaccacctggagaaggtgctgcagatcggcagcgccaaggccaaggagctggcctacaccgtgtgccaggaggtgaagaagctggtgggcttcctgtag

SEQ ID NO: 103812 - DNA, 663 bp, Artificial Sequence
  Description of Artificial Sequence: Synthetic coding sequence
atggccctgcacagcatgagaaaggccagagagagatggagcttcatcagagccctgcacaagggcagcgccgccgcccccgccctgcagaaggacagcaagaagagagtgttcagcggcatccagcccaccggcatcctgcacctgggcaactacctgggcgccatcgagagctgggtgagactgcaggacgagtacgacagcgtgctgtacagcatcgtggacctgcacagcatcaccgtgccccaggaccccgccgtgctgagacagagcatcctggacatgaccgccgtgctgctggcctgcggcatcaaccccgagaagagcatcctgttccagcagagccaggtgagcgagcacacccagctgagctggatcctgagctgcatggtgagactgcccagactgcagcacctgcaccagtggaaggccaagaccaccaagcagaagcacgacggcaccgtgggcctgctgacctaccccgtgctgcaggccgccgacatcctgctgtacaagagcacccacgtgcccgtgggcgaggaccaggtgcagcacatggagctggtgcaggacctggcccagggcttcaacaagaagtacggcgagttcttccccgtgcccgagagcatcctgagcatgtgcgtgctggtgttcctgacctag

SEQ ID NO: 103813 - DNA, 801 bp, Artificial Sequence
  Description of Artificial Sequence: Synthetic coding sequence
atgaccgccgtgctgctggcctgcggcatcaaccccgagaagagcatcctgttccagcagagccaggtgagcgagcacacccagctgagctggatcctgagctgcatggtgagactgcccagactgcagcacctgcaccagtggaaggccaagaccaccaagcagaagcacgacggcaccgtgggcctgctgacctaccccgtgctgcaggccgccgacatcctgctgtacaagagcacccacgtgcccgtgggcgaggaccaggtgcagcacatggagctggtgcaggacctggcccagggcttcaacaagaagtacggcgagttcttccccgtgcccgagagcatcctgaccagcatgaagaaggtgaagagcctgagagaccccagcgccaagatgagcaagagcgaccccgacaagctggccaccgtgagaatcaccgacagccccgaggagatcgtgcagaagttcagaaaggccgtgaccgacttcaccagcgaggtgacctacgaccccgccggcagagccggcgtgagcaacatcgtggccgtgcacgccgccgtgaccggcctgagcgtggaggaggtggtgagaagaagcgccggcatgaacaccgccagatacaagctggccgtggccgacgccgtgatcgagaagttcgcccccatcaagagagagatcgagaagctgaagctggacaaggaccacctggagaaggtgctgcagatcggcagcgccaaggccaaggagctggcctacaccgtgtgccaggaggtgaagaagctggtgggcttcctgtag

SEQ ID NO: 103814 - DNA, 1293 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgaccgacgacgagaagtacctgtggaaggacctgaccctggaccaggcctacagctacgccgtggagaacgccaaggacatcatcgcctgcggcttcgacatcaacaagaccttcatcttcagcgacctggactacatgggcatgagcagcggcttctacaagaacgtggtgaagatccagaagcacgtgaccttcaaccaggtgaagggcatcttcggcttcaccgacagcgactgcatcggcaagatcagcttccccgccatccaggccgcccccagcttcagcaacagcttcccccagatcttcagagacagaaccgacatccagtgcctgatcccctgcgccatcgaccaggacccctacttcagaatgaccagagacgtggcccccagaatcggctaccccaagcccgccctgctgcacagcaccttcttccccgccctgcagggcgcccagaccaagatgagcgccagcgaccccaacagcagcatcttcctgaccgacaccgccaagcagatcaagaccaaggtgaacaagcacgccttcagcggcggcagagacaccatcgaggagcacagacagttcggcggcaactgcgacgtggacgtgagcttcatgtacctgaccttcttcctggaggacgacgacaagctggagcagatcagaaaggactacaccagcggcgccatgctgaccggcgagctgaagaaggccctgatcgaggtgctgcagcccctgatcgccgagcaccaggccagaagaaaggaggtgaccgacgagatcgtgaaggagttcatgacccccagaaagctgagcttcgacttccagtag

SEQ ID NO: 103815 - DNA, 1416 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgaccgacgacgagaagtacctgtggaaggacctgaccctggaccaggcctacagctacgccgtggagaacgccaaggacatcatcgcctgcggcttcgacatcaacaagaccttcatcttcagcgacctggactacatgggcatgagcagcggcttctacaagaacgtggtgaagatccagaagcacgtgaccttcaaccaggtgaagggcatcttcggcttcaccgacagcgactgcatcggcaagatcagcttccccgccatccaggccgcccccagcttcagcaacagcttcccccagatcttcagagacagaaccgacatccagtgcctgatcccctgcgccatcgaccaggacccctacttcagaatgaccagagacgtggcccccagaatcggctaccccaagcccgccctgctgcacagcaccttcttccccgccctgcagggcgcccagaccaagatgagcgccagcgaccccaacagcagcatcttcctgaccgacaccgccaagcagatcaagaccaaggtgaacaagcacgccttcagcggcggcagagacaccatcgaggagcacagacagttcggcggcaactgcgacgtggacgtgagcttcatgtacctgaccttcttcctggaggacgacgacaagctggagcagatcagaaaggactacaccagcggcgccatgctgaccggcgagctgaagaaggccctgatcgaggtgctgcagcccctgatcgccgagcaccaggccagaagaaaggaggtgaccgacgagatcgtgaaggagttcatgacccccagaaagctgagcttcgacttccagtag

SEQ ID NO: 103816 - DNA, 1293 bp, Artificial Sequence; identical to SEQ ID NO: 103814
  Description of Artificial Sequence: Synthetic coding sequence

SEQ ID NO: 103817 - DNA, 1416 bp, Artificial Sequence; identical to SEQ ID NO: 103815
  Description of Artificial Sequence: Synthetic coding sequence

SEQ ID NO: 103818 - DNA, 684 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgaccgacgacgagaagtacctgtggaaggacctgaccctggaccaggcctacagctacgccgtggagaacgccaaggacatcatcgcctgcggcttcgacatcaacaagaccttcatcttcagcgacctggactacatgggcatgagcagcggcttctacaagaacgtggtgaagatccagaagcacgtgaccttcaaccaggtgaagggcatcttcggctag

SEQ ID NO: 103819 - DNA, 324 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattctag

SEQ ID NO: 103820 - DNA, 453 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctactag

SEQ ID NO: 103821 - DNA, 294 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggctag

SEQ ID NO: 103822 - DNA, 81 bp, Artificial Sequence
  Description of Artificial Sequence: Synthetic coding sequence
atgcccaacagcgagcccgccagcctgctggagctgttcaacagcatcgccacccagggcgagctggtgagaagcctgtag

SEQ ID NO: 103823 - DNA, 318 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgtag

SEQ ID NO: 103824 - DNA, 102 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaagtag

SEQ ID NO: 103825 - DNA, 207 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcctag

SEQ ID NO: 103826 - DNA, 375 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccacctag

SEQ ID NO: 103827 - DNA, 261 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggactag

SEQ ID NO: 103828 - DNA, 168 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggctag

SEQ ID NO: 103829 - DNA, 192 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccctag

SEQ ID NO: 103830 - DNA, 213 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccacctag

SEQ ID NO: 103831 - DNA, 177 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactactag

SEQ ID NO: 103832 - DNA, 423 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtag

SEQ ID NO: 103833 - DNA, 462 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagtag

SEQ ID NO: 103834 - DNA, 675 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgaccgacgacgagaagtacctgtggaaggacctgaccctggaccaggcctacagctacgccgtggagaacgccaaggacatcatcgcctgcggcttcgacatcaacaagaccttcatcttcagcgacctggactacatgggcatgagcagcggcttctacaagaacgtggtgaagatccagaagcacgtgaccttcaaccaggtgaagggctag

SEQ ID NO: 103835 - DNA, 1293 bp, Artificial Sequence; identical to SEQ ID NO: 103814
  Description of Artificial Sequence: Synthetic coding sequence

SEQ ID NO: 103836 - DNA, 345 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaagtag

SEQ ID NO: 103837 - DNA, 177 bp, Artificial Sequence; identical to SEQ ID NO: 103831
  Description of Artificial Sequence: Synthetic coding sequence

SEQ ID NO: 103838 - DNA, 459 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaactag

SEQ ID NO: 103839 - DNA, 1416 bp, Artificial Sequence; identical to SEQ ID NO: 103815
  Description of Artificial Sequence: Synthetic coding sequence

SEQ ID NO: 103840 - DNA, 465 bp, Artificial Sequence
  Description of Artificial Sequence: Synthetic coding sequence
atgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgtag

SEQ ID NO: 103841 - DNA, 639 bp, Artificial Sequence
  Description of Artificial Sequence: Synthetic coding sequence
atgcccaacagcgagcccgccagcctgctggagctgttcaacagcatcgccacccagggcgagctggtgagaagcctgaaggccggcaacgccagcaaggacgagatcgacagcgccgtgaagatgctggtgagcctgaagatgagctacaaggccgccgccggcgaggactacaaggccgactgcccccccggcaaccccgcccccaccagcaaccacggccccgacgccaccgaggccgaggaggacttcgtggacccctggaccgtgcagaccagcagcgccaagggcatcgactacgacaagctgatcgtgagattcggcagcagcaagatcgacaaggagctgatcaacagaatcgagagagccaccggccagagaccccaccacttcctgagaagaggcatcttcttcagccacagagacatgaaccaggtgctggacgcctacgagaacaagaagcccttctacctgtacaccggcagaggccccagcagcgaggccatgcacgtgggccacctgatccccttcatcttcaccaagtggctgcaggacgtgttcaacgtgcccctggtgatccagatgaccgacgacgagaagtacctgtggaaggacctgaccctggaccaggcctactag

SEQ ID NO: 103842 - DNA, 1041 bp, Artificial Sequence
  Description of Artificial Sequence: Synthetic coding sequence
atgagcctgctgagaagcctgagagtgttcctggtggccagaaccggcagctaccccgccggcagcctgctgagacagagcccccagcccagacacaccttctacgccggccccagactgagcgccagcgccagcagcaaggagctgctgatgaagctgagaagaaagaccggctacagcttcgtgaactgcaagaaggccctggagacctgcggcggcgacctgaagcaggccgagatctggctgcacaaggaggcccagaaggagggctggagcaaggccgccaagctgcagggcagaaagaccaaggagggcctgatcggcctgctgcaggagggcaacaccaccgtgctggtggaggtgaactgcgagaccgacttcgtgagcagaaacctgaagttccagctgctggtgcagcaggtggccctgggcaccatgatgcactgccagaccctgaaggaccagcccagcgcctacagcaaggtgcagtggctgacccccgtgaacctggccctgtgggaggccgaggccggcggcagcctggagggcttcctgaacagcagcgagctgagcggcctgcccgccggccccgacagagagggcagcctgaaggaccagctggccctggccatcggcaagctgggcgagaacatgatcctgaagagagccgcctgggtgaaggtgcccagcggcttctacgtgggcagctacgtgcacggcgccatgcagagccccagcctgcacaagctggtgctgggcaagtacggcgccctggtgatctgcgagaccagcgagcagaagaccaacctggaggacgtgggcagaagactgggccagcacgtggtgggcatggcccccctgagcgtgggcagcctggacgacgagcccggcggcgaggccgagaccaagatgctgagccagccctacctgctggaccccagcatcaccctgggccagtacgtgcagccccagggcgtgagcgtggtggacttcgtgagattcgagtgcggcgagggcgaggaggccgccgagaccgagtag

SEQ ID NO: 103843 - DNA, 858 bp, Artificial Sequence
  Description of Artificial Sequence: Synthetic coding sequence
atggtgtactgcaccaccacctgggccatctggaactgccagctgctgctgggctacaagcccctgcagaacgtgaccggcctgaacaccgtgggcagctgcaacaccgtggccgagatctggctgcacaaggaggcccagaaggagggctggagcaaggccgccaagctgcagggcagaaagaccaaggagggcctgatcggcctgctgcaggagggcaacaccaccgtgctggtggaggtgaactgcgagaccgacttcgtgagcagaaacctgaagttccagctgctggtgcagcaggtggccctgggcaccatgatgcactgccagaccctgaaggaccagcccagcgcctacagcaagggcttcctgaacagcagcgagctgagcggcctgcccgccggccccgacagagagggcagcctgaaggaccagctggccctggccatcggcaagctgggcgagaacatgatcctgaagagagccgcctgggtgaaggtgcccagcggcttctacgtgggcagctacgtgcacggcgccatgcagagccccagcctgcacaagctggtgctgggcaagtacggcgccctggtgatctgcgagaccagcgagcagaagaccaacctggaggacgtgggcagaagactgggccagcacgtggtgggcatggcccccctgagcgtgggcagcctggacgacgagcccggcggcgaggccgagaccaagatgctgagccagccctacctgctggaccccagcatcaccctgggccagtacgtgcagccccagggcgtgagcgtggtggacttcgtgagattcgagtgcggcgagggcgaggaggccgccgagaccgagtag

SEQ ID NO: 103844 - DNA, 978 bp, Artificial Sequence
  Description of Artificial Sequence: Synthetic coding sequence
atgagcctgctgagaagcctgagagtgttcctggtggccagaaccggcagctaccccgccggcagcctgctgagacagagcccccagcccagacacaccttctacgccggccccagactgagcgccagcgccagcagcaaggagctgctgatgaagctgagaagaaagaccggctacagcttcgtgaactgcaagaaggccctggagacctgcggcggcgacctgaagcaggccgagatctggctgcacaaggaggcccagaaggagggctggagcaaggccgccaagctgcagggcagaaagaccaaggagggcctgatcggcctgctgcaggagggcaacaccaccgtgctggtggaggtgaactgcgagaccgacttcgtgagcagaaacctgaagttccagctgctggtgcagcaggtggccctgggcaccatgatgcactgccagaccctgaaggaccagcccagcgcctacagcaagggcttcctgaacagcagcgagctgagcggcctgcccgccggccccgacagagagggcagcctgaaggaccagctggccctggccatcggcaagctgggcgagaacatgatcctgaagagagccgcctgggtgaaggtgcccagcggcttctacgtgggcagctacgtgcacggcgccatgcagagccccagcctgcacaagctggtgctgggcaagtacggcgccctggtgatctgcgagaccagcgagcagaagaccaacctggaggacgtgggcagaagactgggccagcacgtggtgggcatggcccccctgagcgtgggcagcctggacgacgagcccggcggcgaggccgagaccaagatgctgagccagccctacctgctggaccccagcatcaccctgggccagtacgtgcagccccagggcgtgagcgtggtggacttcgtgagattcgagtgcggcgagggcgaggaggccgccgagaccgagtag

SEQ ID NO: 103845 - DNA, 504 bp, Artificial Sequence
  Description of Artificial Sequence: Synthetic coding sequence
atgagcctgctgagaagcctgagagtgttcctggtggccagaaccggcagctaccccgccggcagcctgctgagacagagcccccagcccagacacaccttctacgccggccccagactgagcgccagcgccagcagcaaggagctgctgatgaagctgagaagaaagaccggctacagcttcgtgaactgcaagaaggccctggagacctgcggcggcgacctgaagcaggccgagatctggctgcacaaggaggcccagaaggagggctggagcaaggccgccaagctgcagggcagaaagaccaaggagggcctgatcggcctgctgcaggagggcaacaccaccgtgctggtggaggtgaactgcgagaccgacttcgtgagcagaaacctgaagttccagctgctggtgcagcaggtggccctgggcaccatgatgcactgccagaccctgaaggaccagcccagcgcctacagcaaggagaactgggagaagacctag

SEQ ID NO: 103846 - DNA, 648 bp, Artificial Sequence
  Description of Artificial Sequence: Synthetic coding sequence
atgagcctgctgagaagcctgagagtgttcctggtggccagaaccggcagctaccccgccggcagcctgctgagacagagcccccagcccagacacaccttctacgccggccccagactgagcgccagcgccagcagcaaggagctgctgatgaagctgagaagaaagaccggctacagcttcgtgaactgcaagaaggccctggagacctgcggcggcgacctgaagcaggccgagatctggctgcacaaggaggcccagaaggagggctggagcaaggccgccaagctgcagggcagaaagaccaaggagggcctgatcggcctgctgcaggagggcaacaccaccgtgctggtggaggtgaactgcgagaccgacttcgtgagcagaaacctgaagttccagctgctggtgcagcaggtggccctgggcaccatgatgcactgccagaccctgaaggaccagcccagcgcctacagcaagggcttcctgaacagcagcgagctgagcggcctgcccgccggccccgacagagagggcagcctgaaggaccagctggccctggccatcggcctgcccttccagatcggcgccgtgagcgagctgcagctgcccgagagcaacttcctgcagaacaccagcagctag

SEQ ID NO: 103847 - DNA, 435 bp, Artificial Sequence
  Description of Artificial Sequence: Synthetic coding sequence
atgaagagccagtggtgcagacccgtggccatggacctgggcgtgtaccagctgagacacttcagcatcagcttcctgagcagcctgctgggcaccgagaacgccagcgtgagactggacaacagcagcagcggcgccagcgtggtggccatcgacaacaagatcgagcaggccatggacctggtgaagagccacctgatgtacgccgtgagagaggaggtggaggtgctgaaggagcagatcaaggagctgatcgagaagaacagccagctggagcaggagaacaacctgctgaagaccctggccagccccgagcagctggcccagttccaggcccagctgcagaccggcagcccccccgccaccacccagccccagggcaccacccagccccccgcccagcccgccagccagggcagcggccccaccgcctag

SEQ ID NO: 103848 - DNA, 3222 bp, Artificial Sequence
  Description of Artificial Sequence: Synthetic coding sequence
atgcaccagccccccgagagcaccgccgccgccgccgccgccgccgacatcagcgccagaaagatggcccaccccgccatgttccccagaagaggcagcggcagcggcagcgccagcgccctgaacgccgccggcaccggcgtgggcagcaacgccaccagcagcgaggacttccccccccccagcctgctgcagccccccccccccgccgccagcagcaccagcggcccccagcccccccccccccagagcctgaacctgctgagccaggcccagctgcaggcccagcccctggcccccggcggcacccagatgaagaagaagagcggcttccagatcaccagcgtgacccccgcccagatcagcgccagcatcagcagcaacaacagcatcgccgaggacaccgagagctacgacgacctggacgagagccacaccgaggacctgagcagcagcgagatcctggacgtgagcctgagcagagccaccgacctgggcgagcccgagagaagcagcagcgaggagaccctgaacaacttccaggaggccgagacccccggcgccgtgagccccaaccagccccacctgccccagccccacctgccccacctgccccagcagaacgtggtgatcaacggcaacgcccacccccaccacctgcaccaccaccaccagatccaccacggccaccacctgcagcacggccaccaccaccccagccacgtggccgtggccagcgccagcatcaccggcggcccccccagcagccccgtgagcagaaagctgagcaccaccggcagcagcgacagcatcacccccgtggcccccaccagcgccgtgagcagcagcggcagccccgccagcgtgatgaccaacatgagagcccccagcaccaccggcggcatcggcatcaacagcgtgaccggcaccagcaccgtgaacaacgtgaacatcaccgccgtgggcagcttcaaccccaacgtgaccagcagcatgctgggcaacgtgaacatcagcaccagcaacatccccagcgccgccggcgtgagcgtgggccccggcgtgaccagcggcgtgaacgtgaacatcctgagcggcatgggcaacggcaccatcagcagcagcgccgccgtgagcagcgtgcccaacgccgccgccggcatgaccggcggcagcgtgagcagccagcagcagcagcccaccgtgaacaccagcagattcagagtggtgaagctggacagcagcagcgagcccttcaagaagggcagatggacctgcaccgagttctacgagaaggagaacgccgtgcccgccaccgagggcgtgctgatcaacaaggtggtggagaccgtgaagcagaaccccatcgaggtgaccagcgagagagagagcaccagcggcagcagcgtgagcagcagcgtgagcaccctgagccactacaccgagagcgtgggcagcggcgagatgggcgcccccaccgtggtggtgcagcagcagcagcagcagcagcagcagcagcagcagcagcccgccctgcagggcgtgaccctgcagcagatggacttcggcagcaccggcccccagagcatccccgccgtgagcatcccccagagcatcagccagagccagatcagccaggtgcagctgcagagccaggagctgagctaccagcagaagcagggcctgcagcccgtgcccctgcaggccaccatgagcgccgccaccggcatccagcccagccccgtgaacgtggtgggcgtgaccagcgccctgggccagcagcccagcatcagcagcctggcccagccccagctgccctacagccaggccgccccccccgtgcagacccccctgcccggcgccccccccccccagcagctgcagtacggccagcagcagcccatggtgagcacccagatggcccccggccacgtgaagagcgtgacccagaaccccgccagcgagtacgtgcagcagcagcccatcctgcagaccgccatgagcagcggccagcccagcagcgccggcgtgggcgccggcaccaccgtgatccccgtggcccagccccagggcatccagctgcccgtgcagcccaccgccgtgcccgcccagcccgccggcgccagcgtgcagcccgtgggccaggcccccgccgccgtgagcgccgtgcccaccggcagccagatcgccaacatcggccagcaggccaacatccccaccgccgtgcagcagcccagcacccaggtgccccccagcgtgatccagcagggcgccccccccagcagccaggtggtgccccccgcccagaccggcatcatccaccagggcgtgcagaccagcgcccccagcctgccccagcagctggtgatcgccagccagagcagcctgctgaccgtgcccccccagccccagggcgtggagcccgtggcccagggcatcgtgagccagcagctgcccgccgtgagcagcctgcccagcgccagcagcatcagcgtgaccagccaggtgagcagcaccggccccagcggcatgcccagcgcccccaccaacctggtgcccccccagaacatcgcccagacccccgccacccagaacggcaacctggtgcagagcgtgagccagccccccctgatcgccaccaacaccaacctgcccctggcccagcagatccccctgagcagcacccagttcagcgcccagagcctggcccaggccatcggcagccagatcgaggacgccagaagagccgccgagcccagcctggtgggcctgccccagaccatcagcggcgacagcggcggcatgagcgccgtgagcgacggcagcagcagcagcctggccgccagcgccagcctgttccccctgaaggtgctgcccctgaccacccccctggtggacggcgaggacgagagcagcagcggcgccagcgtggtggccatcgacaacaagatcgagcaggccatggacctggtgaagagccacctgatgtacgccgtgagagaggaggtggaggtgctgaaggagcagatcaaggagctgatcgagaagaacagccagctggagcaggagaacaacctgctgaagaccctggccagccccgagcagctggcccagttccaggcccagctgcagaccggcagcccccccgccaccacccagccccagggcaccacccagccccccgcccagcccgccagccagggcagcggccccaccgcctag

SEQ ID NO: 103849 - DNA, 126 bp, Artificial Sequence
  Description of Artificial Sequence: Synthetic coding sequence
atgaagagccagtggtgcagacccgtggccatggacctgggcgtgtaccagctgagacacttcagcatcagcttcctgagcagcctgctgggcaccgagaacgccagcgtgagactggacaactag

SEQ ID NO: 103850 - DNA, 429 bp, Artificial Sequence
  Description of Artificial Sequence: Synthetic coding sequence
atgcaccagccccccgagagcaccgccgccgccgccgccgccgccgacatcagcgccagaaagatggcccaccccgccatgttccccagaagaggcagcggcagcggcagcgccagcgccctgaacgccgccggcaccggcgtgggcagcaacgccaccagcagcgaggacttccccccccccagcctgctgcagccccccccccccgccgccagcagcaccagcggcccccagcccccccccccccagagcctgaacctgctgagccaggcccagctgcaggcccagcccctggcccccggcggcacccagatgaagaagaagagcggcttccagatcaccagcgtgacccccgcccagatcagcgccagcatcagcagcaacaacagcatcgccgaggacaccgagagctacgacgacctggactag

SEQ ID NO: 103851 - DNA, 1713 bp, Artificial Sequence
  Description of Artificial Sequence: Synthetic coding sequence
atgcaccagccccccgagagcaccgccgccgccgccgccgccgccgacatcagcgccagaaagatggcccaccccgccatgttccccagaagaggcagcggcagcggcagcgccagcgccctgaacgccgccggcaccggcgtgggcagcaacgccaccagcagcgaggacttccccccccccagcctgctgcagccccccccccccgccgccagcagcaccagcggcccccagcccccccccccccagagcctgaacctgctgagccaggcccagctgcaggcccagcccctggcccccggcggcacccagatgaagaagaagagcggcttccagatcaccagcgtgacccccgcccagatcagcgccagcatcagcagcaacaacagcatcgccgaggacaccgagagctacgacgacctggacgagagccacaccgaggacctgagcagcagcgagatcctggacgtgagcctgagcagagccaccgacctgggcgagcccgagagaagcagcagcgaggagaccctgaacaacttccaggaggccgagacccccggcgccgtgagccccaaccagccccacctgccccagccccacctgccccacctgccccagcagaacgtggtgatcaacggcaacgcccacccccaccacctgcaccaccaccaccagatccaccacggccaccacctgcagcacggccaccaccaccccagccacgtggccgtggccagcgccagcatcaccggcggcccccccagcagccccgtgagcagaaagctgagcaccaccggcagcagcgacagcatcacccccgtggcccccaccagcgccgtgagcagcagcggcagccccgccagcgtgatgaccaacatgagagcccccagcaccaccggcggcatcggcatcaacagcgtgaccggcaccagcaccgtgaacaacgtgaacatcaccgccgtgggcagcttcaaccccaacgtgaccagcagcatgctgggcaacgtgaacatcagcaccagcaacatccccagcgccgccggcgtgagcgtgggccccggcgtgaccagcggcgtgaacgtgaacatcctgagcggcatgggcaacggcaccatcagcagcagcgccgccgtgagcagcgtgcccaacgccgccgccggcatgaccggcggcagcgtgagcagccagcagcagcagcccaccgtgaacaccagcagattcagagtggtgaagctggacagcagcagcgagcccttcaagaagggcagatggacctgcaccgagttctacgagaaggagaacgccgtgcccgccaccgagggcgtgctgatcaacaaggtggtggagaccgtgaagcagaaccccatcgaggtgaccagcgagagagagagcaccagcggcagcagcgtgagcagcagcgtgagcaccctgagccactacaccgagagcgtgggcagcggcgagatgggcgcccccaccgtggtggtgcagcagcagcagcagcagcagcagcagcagcagcagcagcccgccctgcagggcgtgaccctgcagcagatggacttcggcagcaccggcccccagagcatccccgccgtgagcatcccccagagcatcagccagagccagatcagccaggtgcagctgcagagccaggagctgagctacctgaccatgaaggtggtgctgctgatcgtgtacctgtgcatgtag

SEQ ID NO: 103852 - DNA, 603 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagatcgagcaggccatggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103853 - DNA, 333 bp, Artificial Sequence
  Description of Artificial Sequence: Synthetic coding sequence
atggccttccagcccccctacagcagcagcctgttcagaaagagagacaacgccagcggcgccagcgtggtggccatcgacaacaagatcgagcaggccatggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103854 - DNA, 603 bp, Artificial Sequence; identical to SEQ ID NO: 103852
  Description of Artificial Sequence: Synthetic coding sequence

SEQ ID NO: 103855 - DNA, 603 bp, Artificial Sequence; identical to SEQ ID NO: 103852
  Description of Artificial Sequence: Synthetic coding sequence

SEQ ID NO: 103856 - DNA, 234 bp, Artificial Sequence
  Description of Artificial Sequence: Synthetic coding sequence
atggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103857 - DNA, 405 bp, Artificial Sequence
  Description of Artificial Sequence: Synthetic coding sequence
atgaacaccgagatgtaccagacccccatggaggtggccgtgtaccagctgcacaacttcagcatcagcttcttcagcagcctgctgggcggcgacgtggtgagcgtgaagctggacaacagcgccagcggcgccagcgtggtggccatcgacaacaagatcgagcaggccatggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103858 - DNA, 540 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagatcgagcaggccatggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103859 - DNA, 372 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagatcgagcaggcctag

SEQ ID NO: 103860 - DNA, 78 bp, Artificial Sequence
  Description of Artificial Sequence: Synthetic coding sequence
atggacctggtgaagaaccacctgatgtacgccgtgagagaggaggtggagatcctgaaggagcagatcagagagtag

SEQ ID NO: 103861 - DNA, 351 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatctag

SEQ ID NO: 103862 - DNA, 177 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagtag

SEQ ID NO: 103863 - DNA, 255 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgtag

SEQ ID NO: 103864 - DNA, 603 bp, Artificial Sequence; identical to SEQ ID NO: 103852
  Description of Artificial Sequence: Synthetic coding sequence

SEQ ID NO: 103865 - DNA, 303 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagctag

SEQ ID NO: 103866 - DNA, 360 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagtag

SEQ ID NO: 103867 - DNA, 399 bp, Artificial Sequence
  Description of Artificial Sequence: Synthetic coding sequence
atgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagatcgagcaggccatggacctggtgaagaaccacctgatgtacgccgtgagagaggaggtggagatcctgaaggagcagatcagagagctggtggagaagaacagccagctggagagagagaacaccctgctgaagaccctggccagccccgagcagctggagaagttccagagctgcctgagccccgaggagcccgcccccgagagcccccaggtgcccgaggcccccggcggcagcgccgtgtag

SEQ ID NO: 103868 - DNA, 375 bp, Artificial Sequence
  Description of Artificial Sequence: Synthetic coding sequence
atggcccagagcaagctggactgcagaagccccgtgggcctggactgctgcaactgctgcctggacctggcccacagaagcggcctgcagagaggcagcagcggcgagaacaacaaccccggcagccccaccgtgagcaacttcagacagctgcaggagaagctggtgttcgagaacctgaacaccgacaagctgaacagcatcatgagacaggacagcctggagcccgtgctgagagacccctgctacctgatcaacgagggcatctgcaacagaaacatcgaccagaccatgctgagcatcctgctgttcttccacagcgccagcggcgccagcgtggtggccatcgacaacaagatcgagcaggccatgtag

SEQ ID NO: 103869 - DNA, 1188 bp, Artificial Sequence
  Description of Artificial Sequence: Synthetic coding sequence
atgagcggcggcaagaagaagagcagcttccagatcaccagcgtgaccaccgactacgagggccccggcagccccggcgccagcgacccccccaccccccagccccccaccggccccccccccagactgcccaacggcgagcccagccccgaccccggcggcaagggcacccccagaaacggcagccccccccccggcgcccccagcagcagattcagagtggtgaagctgccccacggcctgggcgagccctacagaagaggcagatggacctgcgtggacgtgtacgagagagacctggagccccacagcttcggcggcctgctggagggcatcagaggcgccagcggcggcgccggcggcagaagcctggacagcagactggagctggccagcctgggcctgggcgcccccaccccccccagcggcctgagccagggccccaccagctggctgagacccccccccaccagccccggcccccaggccagaagcttcaccggcggcctgggccagctggtggtgcccagcaaggccaaggccgagaagccccccctgagcgccagcagcccccagcagagaccccccgagcccgagaccggcgagagcgccggcaccagcagagccgccacccccctgcccagcctgagagtggaggccgaggccggcggcagcggcgccagaaccccccccctgagcagaagaaaggccgtggacatgagactgagaatggagctgggcgcccccgaggagatgggccaggtgccccccctggacagcagacccagcagccccgccctgtacttcacccacgacgccagcctggtgcacaagagccccgaccccttcggcgccgtggccgcccagaagttcagcctggcccacagcatgctggccatcagcggccacctggacagcgacgacgacagcggcagcggcagcctggtgggcatcgacaacaagatcgagcaggccatggacctggtgaagagccacctgatgttcgccgtgagagaggaggtggaggtgctgaaggagcagatcagagagctggccgagagaaacgccgccctggagcaggagaacggcctgctgagagccctggccagccccgagcagctggcccagctgcccagcagcggcgtgcccagactgggcccccccgcccccaacggccccagcgtgtag

SEQ ID NO: 103870 - DNA, 1314 bp, Artificial Sequence
  Description of Artificial Sequence: Synthetic coding sequence
atgagcggcctggacggcgtgaagagaaccacccccctgcagacccacagcatcatcatcagcgaccaggtgcccagcgaccaggacgcccaccagtacctgagactgagagaccagagcgaggccacccaggtgatggccgagcccggcgagggcggcagcgagaccgtggccctgcccccccccccccccagcgaggagggcggcgtgccccaggacgccgccggcagaggcggcaccccccagatcagagtggtgggcggcagaggccacgtggccatcaaggccggccaggaggagggccagccccccgccgagggcctggccgccgccagcgtggtgatggccgccgacagaagcctgaagaagggcgtgcagggcggcgagaaggccctggagatctgcggcgcccagagaagcgccagcgagctgaccgccggcgccgaggccgaggccgaggaggtgaagaccggcaagtgcgccaccgtgagcgccgccgtggccgagagagagagcgccgaggtggtgaaggagggcctggccgagaaggaggtgatggaggagcagatggaggtggaggagcagccccccgagggcgaggagatcgaggtggccgaggaggacagactggaggaggaggccagagaggaggagggcccctggcccctgcacgaggccctgagaatggaccccctggaggccatccagctggagctggacaccgtgaacgcccaggccgacagagccttccagcagctggagcacaagttcggcagaatgagaagacactacctggagagaagaaactacatcatccagaacatccccggcttctggatgaccgccttcagaaaccacccccagctgagcgccatgatcagaggccaggacgccgagatgctgagatacatcaccaacctggaggtgaaggagctgagacaccccagaaccggctgcaagttcaagttcttcttcagaagaaacccctacttcagaaacaagctgatcgtgaaggagtacgaggtgagaagcagcggcagagtggtgagcctgagcacccccatcatctggagaagaggccacgagccccagagcttcatcagaagaaaccaggacctgatctgcagcttcttcacctggttcagcgaccacagcctgcccgagagcgacaagatcgccgagatcatcaaggaggacctgtggcccaaccccctgcagtactacctgctgagagagggcgtgagaagagccagaagaagacccctgagagagcccgtggagatccccagacccttcggcttccagagcggctag

SEQ ID NO: 103871 - DNA, 522 bp, Artificial Sequence
  Description of Artificial Sequence: Synthetic coding sequence
atgagcggcctggacggcgtgaagagaaccacccccctgcagacccacagcatcatcatcagcgaccaggtgcccagcgaccaggacgcccaccagtacctgagactgagagaccagagcgaggccacccaggtgatggccgagcccggcgagggcggcagcgagaccgtggccctgcccccccccccccccagcgaggagggcggcgtgccccaggacgccgccggcagaggcggcaccccccagatcagagtggtgggcggcagaggccacgtggccatcaaggccggccaggaggagggccagccccccgccgagggcctggccgccgccagcgtggtgatggccgccgacagaagcctgaagaagggcgtgcagggcggcgagaaggccctggagatctgcggcgcccagagaagcgccagcgagctgaccgccggcgccgaggccgaggccgaggaggtgaagaccggcaagtgcgccaccgtgagcgccgccgtggccaagatgcagagatgctag

SEQ ID NO: 103872 - DNA, 2082 bp, Artificial Sequence
  Description of Artificial Sequence: Synthetic coding sequence
atggacagacccgacgagggcccccccgccaagaccagaagactgagcagcagcgagagcccccagagagaccccccccccccccccccccccccccccctgctgagactgcccctgccccccccccagcagagacccagactgcaggaggagaccgaggccgcccaggtgctggccgacatgagaggcgtgggcctgggccccgccctgccccccccccccccctacgtgatcctggaggagggcggcatcagagcctacttcaccctgggcgccgagtgccccggctgggacagcaccatcgagagcggctacggcgaggcccccccccccaccgagagcctggaggccctgcccacccccgaggccagcggcggcagcctggagatcgacttccaggtggtgcagagcagcagcttcggcggcgagggcgccctggagacctgcagcgccgtgggctgggccccccagagactggtggaccccaagagcaaggaggaggccatcatcatcgtggaggacgaggacgaggacgagagagagagcatgagaagcagcagaagaagaagaagaagaagaagaagaaagcagagaaaggtgaagagagagagcagagagagaaacgccgagagaatggagagcatcctgcaggccctggaggacatccagctggacctggaggccgtgaacatcaaggccggcaaggccttcctgagactgaagagaaagttcatccagatgagaagacccttcctggagagaagagacctgatcatccagcacatccccggcttctgggtgaaggccttcctgaaccaccccagaatcagcatcctgatcaacagaagagacgaggacatcttcagatacctgaccaacctgcaggtgcaggacctgagacacatcagcatgggctacaagatgaagctgtacttccagaccaacccctacttcaccaacatggtgatcgtgaaggagttccagagaaacagaagcggcagactggtgagccacagcacccccatcagatggcacagaggccaggagccccaggccagaagacacggcaaccaggacgccagccacagcttcttcagctggttcagcaaccacagcctgcccgaggccgacagaatcgccgagatcatcaagaacgacctgtgggtgaaccccctgagatactacctgagagagagaggcagcagaatcaagagaaagaagcaggagatgaagaagagaaagaccagaggcagatgcgaggtggtgatcatggaggacgcccccgactactacgccgtggaggacatcttcagcgagatcagcgacatcgacgagaccatccacgacatcaagatcagcgacttcatggagaccaccgactacttcgagaccaccgacaacgagatcaccgacatcaacgagaacatctgcgacagcgagaaccccgaccacaacgaggtgcccaacaacgagaccaccgacaacaacgagagcgccgacgaccacgagaccaccgacaacaacgagagcgccgacgacaacaacgagaaccccgaggacaacaacaagaacaccgacgacaacgaggagaaccccaacaacaacgagaacacctacggcaacaacttcttcaagggcggcttctggggcagccacggcaacaaccaggacagcagcgacagcgacaacgaggccgacgaggccagcgacgacgaggacaacgacggcaacgagggcgacaacgagggcagcgacgacgacggcaacgagggcgacaacgagggcagcgacgacgacgacagagacatcgagtactacgagaaggtgatcgaggacttcgacaaggaccaggccgactacgaggacgtgatcgagatcatcagcgacgagagcgtggaggaggagggcatcgaggagggcatccagcaggacgaggacatctacgaggagggcaactacgaggaggagggcagcgaggacgtgtgggaggagggcgaggacagcgacgacagcgacctggaggacgtgctgcaggtgcccaacggctgggccaaccccggcaagagaggcaagaccggctag

SEQ ID NO: 103873 - DNA, 1062 bp, Artificial Sequence
  Description of Artificial Sequence: Synthetic coding sequence
atgccctggcccctgctgctgctgctggccgtgagcggcgcccagaccaccagaccctgcttccccggctgccagtgcgaggtggagaccttcggcctgttcgacagcttcagcctgaccagagtggactgcagcggcctgggcccccacatcatgcccgtgcccatccccctggacaccgcccacctggacctgagcagcaacagactggagatggtgaacgagagcgtgctggccggccccggctacaccaccctggccggcctggacctgagccacaacctgctgaccagcatcagccccaccgccttcagcagactgagatacctggagagcctggacctgagccacaacggcctgaccgccctgcccgccgagagcttcaccagcagccccctgagcgacgtgaacctgagccacaaccagctgagagaggtgagcgtgagcgccttcaccacccacagccagggcagagccctgcacgtggacctgagccacaacctgatccacagactggtgccccaccccaccagagccggcctgcccgcccccaccatccagagcctgaacctggcctggaacagactgcacgccgtgcccaacctgagagacctgcccctgagatacctgagcctggacggcaaccccctggccgtgatcggccccggcgccttcgccggcctgggcggcctgacccacctgagcctggccagcctgcagagactgcccgagctggcccccagcggcttcagagagctgcccggcctgcaggtgctggacctgagcggcaaccccaagctgaactgggccggcgccgaggtgttcagcggcctgagcagcctgcaggagctggacctgagcggcaccaacctggtgcccctgcccgaggccctgctgctgcacctgcccgccctgcagagcgtgagcgtgggccaggacgtgagatgcagaagactggtgagagagggcacctaccccagaagacccggcagcagccccaaggtggccctgcactgcgtggacaccagagacagcgccgccagaggccccaccatcctgtag

SEQ ID NO: 103874 - DNA, 966 bp, Artificial Sequence
  Description of Artificial Sequence: Synthetic coding sequence
atgccctggcccctgctgctgctgctggccgtgagcggcgcccagaccaccagaccctgcttccccggctgccagtgcgaggtggagaccttcggcctgttcgacagcttcagcctgaccagagtggactgcagcggcctgggcccccacatcatgcccgtgcccatccccctggacaccgcccacctggacctgagcagcaacagactggagatggtgaacgagagcgtgctggccggccccggctacaccaccctggccggcctggacctgagccacaacctgctgaccagcagccccctgagcgacgtgaacctgagccacaaccagctgagagaggtgagcgtgagcgccttcaccacccacagccagggcagagccctgcacgtggacctgagccacaacctgatccacagactggtgccccaccccaccagagccggcctgcccgcccccaccatccagagcctgaacctggcctggaacagactgcacgccgtgcccaacctgagagacctgcccctgagatacctgagcctggacggcaaccccctggccgtgatcggccccggcgccttcgccggcctgggcggcctgacccacctgagcctggccagcctgcagagactgcccgagctggcccccagcggcttcagagagctgcccggcctgcaggtgctggacctgagcggcaaccccaagctgaactgggccggcgccgaggtgttcagcggcctgagcagcctgcaggagctggacctgagcggcaccaacctggtgcccctgcccgaggccctgctgctgcacctgcccgccctgcagagcgtgagcgtgggccaggacgtgagatgcagaagactggtgagagagggcacctaccccagaagacccggcagcagccccaaggtggccctgcactgcgtggacaccagagacagcgccgccagaggccccaccatcctgtag

SEQ ID NO: 103875 - DNA, 318 bp, Artificial Sequence
  Description of Artificial Sequence: Synthetic coding sequence
atgccctggcccctgctgctgctgctggccgtgagcggcgcccagaccaccagaccctgcttccccggctgccagtgcgaggtggagaccttcggcctgttcgacagcttcagcctgaccagagtggactgcagcggcctgggcccccacatcatgcccgtgcccatccccctggacaccgcccacctggacctgagcagcaacagactggagatggtgaacgagagcgtgctggccggccccggctacaccaccctggccggcctggacctgagccacaacctgctgaccagcatcagccccaccgccttcagctag

SEQ ID NO: 103876 - DNA, 1062 bp, Artificial Sequence; identical to SEQ ID NO: 103873
  Description of Artificial Sequence: Synthetic coding sequence

SEQ ID NO: 103877 - DNA, 453 bp, Artificial Sequence
  Description of Artificial Sequence: Synthetic coding sequence
atgccctggcccctgctgctgctgctggccgtgagcggcgcccagaccaccagaccctgcttccccggctgccagtgcgaggtggagaccttcggcctgttcgacagcttcagcctgaccagagtggactgcagcggcctgggcccccacatcatgcccgtgcccatccccctggacaccgcccacctggacctgagcagcaacagactggagatggtgaacgagagcgtgctggccggccccggctacaccaccctggccggcctggacctgagccacaacctgctgaccagcatcagccccaccgccttcagcagactgagatacctggagagcctggacctgagccacaacggcctgaccgccctgcccgccgagagcttcaccagcagccccctgagcgacgtgaacctgagccacaaccagctgagagaggtgagcgtgagcgcctag

SEQ ID NO: 103878 - DNA, 2574 bp, Artificial Sequence
  Description of Artificial Sequence: Synthetic coding sequence
atggagagcgaggacctgagcggcagagagctgaccatcgacagcatcatgaacaaggtgagagacatcaagaacaagttcaagaacgaggacctgaccgacgagctgagcctgaacaagatcagcgccgacaccaccgacaacagcggcaccgtgaaccagatcatgatgatggccaacaaccccgaggactggctgagcctgctgctgaagctggagaagaacagcgtgcccctgagcgacgccctgctgaacaagctgatcggcagatacagccaggccatcgaggccctgccccccgacaagtacggccagaacgagagcttcgccagaatccaggtgagattcgccgagctgaaggccatccaggagcccgacgacgccagagactacttccagatggccagagccaactgcaagaagttcgccttcgtgcacatcagcttcgcccagttcgagctgagccagggcaacgtgaagaagagcaagcagctgctgcagaaggccgtggagagaggcgccgtgcccctggagatgctggagatcgccctgagaaacctgaacctgcagaagaagcagctgctgagcgaggaggagaagaagaacctgagcgccagcaccgtgctgaccgcccaggagagcttcagcggcagcctgggccacctgcagaacagaaacaacagctgcgacagcagaggccagaccaccaaggccagattcctgtacggcgagaacatgcccccccaggacgccgagatcggctacagaaacagcctgagacagaccaacaagaccaagcagagctgccccttcggcagagtgcccgtgaacctgctgaacagccccgactgcgacgtgaagaccgacgacagcgtggtgccctgcttcatgaagagacagaccagcagaagcgagtgcagagacctggtggtgcccggcagcaagcccagcggcaacgacagctgcgagctgagaaacctgaagagcgtgcagaacagccacttcaaggagcccctggtgagcgacgagaagagcagcgagctgatcatcaccgacagcatcaccctgaagaacaagaccgagagcagcctgctggccaagctggaggagaccaaggagtaccaggagcccgaggtgcccgagagcaaccagaagcagtggcagagcaagagaaagagcgagtgcatcaaccagaaccccgccgccagcagcaaccactggcagatccccgagctggccagaaaggtgaacaccgagcagaagcacaccaccttcgagcagcccgtgttcagcgtgagcaagcagagcccccccatcagcaccagcaagtggttcgaccccaagagcatctgcaagacccccagcagcaacaccctggacgactacatgagctgcttcagaacccccgtggtgaagaacgacttcccccccgcctgccagctgagcaccccctacggccagcccgcctgcttccagcagcagcagcaccagatcctggccacccccctgcagaacctgcaggtgctggccagcagcagcgccaacgagtgcatcagcgtgaagggcagaatctacagcatcctgaagcagatcggcagcggcggcagcagcaaggtgttccaggtgctgaacgagaagaagcagatctacgccatcaagtacgtgaacctggaggaggccgacaaccagaccctggacagctacagaaacgagatcgcctacctgaacaagctgcagcagcacagcgacaagatcatcagactgtacgactacgagatcaccgaccagtacatctacatggtgatggagtgcggcaacatcgacctgaacagctggctgaagaagaagaagagcatcgacccctgggagagaaagagctactggaagaacatgctggaggccgtgcacaccatccaccagcacggcatcgtgcacagcgacctgaagcccgccaacttcctgatcgtggacggcatgctgaagctgatcgacttcggcatcgccaaccagatgcagcccgacaccaccagcgtggtgaaggacagccaggtgggcaccgtgaactacatgccccccgaggccatcaaggacatgagcagcagcagagagaacggcaagagcaagagcaagatcagccccaagagcgacgtgtggagcctgggctgcatcctgtactacatgacctacggcaagacccccttccagcagatcatcaaccagatcagcaagctgcacgccatcatcgaccccaaccacgagatcgagttccccgacatccccgagaaggacctgcaggacgtgctgaagtgctgcctgaagagagaccccaagcagagaatcagcatccccgagctgctggcccacccctacgtgcagatccagacccaccccgtgaaccagatggccaagggcaccaccgaggagatgaagtacgtgctgggccagctggtgggcctgaacagccccaacagcatcctgaaggccgccaagaccctgtacgagcactacagcggcggcgagagccacaacagcagcagcagcaagaccttcgagaagaagagaggcaagaagtag

SEQ ID NO: 103879 - DNA, 420 bp, Artificial Sequence
  Description of Artificial Sequence: Synthetic coding sequence
atggagagcgaggacctgagcggcagagagctgaccatcgacagcatcatgaacaaggtgagagacatcaagaacaagttcaagaacgaggacctgaccgacgagctgagcctgaacaagatcagcgccgacaccaccgacaacagcggcaccgtgaaccagatcatgatgatggccaacaaccccgaggactggctgagcctgctgctgaagctggagaagaacagcgtgcccctgagcgacgccctgctgaacaagctgatcggcagatacagccaggccatcgaggccctgccccccgacaagtacggccagaacgagagcttcgccagaatccaggtgagattcgccgagctgaaggccatccaggagcccgacgacgccagagactacttccagatggccagagccaactgctag

SEQ ID NO: 103880 - DNA, 531 bp, Artificial Sequence
  Description of Artificial Sequence: Synthetic coding sequence
atggagagcgaggacctgagcggcagagagctgaccatcgacagcatcatgaacaaggtgagagacatcaagaacaagttcaagaacgaggacctgaccgacgagctgagcctgaacaagatcagcgccgacaccaccgacaacagcggcaccgtgaaccagatcatgatgatggccaacaaccccgaggactggctgagcctgctgctgaagctggagaagaacagcgtgcccctgagcgacgccctgctgaacaagctgatcggcagatacagccaggccatcgaggccctgccccccgacaagtacggccagaacgagagcttcgccagaatccaggtgagattcgccgagctgaaggccatccaggagcccgacgacgccagagactacttccagatggccagagccaactgcaagaagttcgccttcgtgcacatcagcttcgcccagttcgagctgagccagggcaacgtgaagaagagcaagcagctgctgcagaaggccgtggagagaggcgccgtgccctag

SEQ ID NO: 103881 - DNA, 453 bp, Artificial Sequence
  Description of Artificial Sequence: Synthetic coding sequence
atggagagcgaggacctgagcggcagagagctgaccatcgacagcatcatgaacaaggtgagagacatcaagaacaagttcaagaacgaggacctgaccgacgagctgagcctgaacaagatcagcgccgacaccaccgacaacagcggcaccgtgaaccagatcatgatgatggccaacaaccccgaggactggctgagcctgctgctgaagctggagaagaacagcgtgcccctgagcgacgccctgctgaacaagctgatcggcagatacagccaggccatcgaggccctgccccccgacaagtacggccagaacgagagcttcgccagaatccaggtgagattcgccgagctgaaggccatccaggagcccgacgacgccagagactacttccagatggccagagccaactgcaagaagttcgccttcgtgcacatcagcttcgcctag

SEQ ID NO: 103882 - DNA, 492 bp, Artificial Sequence
  Description of Artificial Sequence: Synthetic coding sequence
atggccgagggcggcggccagaaccaccacgaggtggtgaagttcatggacgtgtaccagagaagctactgccaccccatcgagaccctggtggacatcttccaggagtaccccgacgagatcgagtacatcttcaagcccagctgcgtgcccctgatgagatgcggcggctgctgcaacgacgagggcctggagtgcgtgcccaccgaggagagcaacatcaccatgcagatcatgagaatcaagccccaccagggccagcacatcggcgagatgagcttcctgcagcacaacaagtgcgagtgcagacccaagaaggacagagccagacaggagaacccctgcggcccctgcagcgagagaagaaagcacctgttcgtgcaggacccccagacctgcaagtgcagctgcaagaacaccgacagcagatgcaaggccagacagctggagctgaacgagagaacctgcagatgcgacaagcccagaagatag

SEQ ID NO: 103883 - DNA, 1368 bp, Artificial Sequence
  Description of Artificial Sequence: Synthetic coding sequence
atgaccaccatggccgccgccaccctgctgagagccaccccccacttcagcggcctggccgccggcagaaccttcctgctgcagggcctgctgagactgctgaaggcccccgccctgcccctgctgtgcagaggcctggccgtggaggccaagaagacctacgtgagagacaagccccacgtgaacgtgggcaccatcggccacgtggaccacggcaagaccaccctgaccgccgccatcaccaagatcctggccgagggcggcggcgccaagttcaagaagtacgaggagatcgacaacgcccccgaggagagagccagaggcatcaccatcaacgccgcccacgtggagtacagcaccgccgccagacactacgcccacaccgactgccccggccacgccgactacgtgaagaacatgatcaccggcaccgcccccctggacggctgcatcctggtggtggccgccaacgacggccccatgccccagaccagagagcacctgctgctggccagacagatcggcgtggagcacgtggtggtgtacgtgaacaaggccgacgccgtgcaggacagcgagatggtggagctggtggagctggagatcagagagctgctgaccgagttcggctacaagggcgaggagacccccgtgatcgtgggcagcgccctgtgcgccctggagggcagagaccccgagctgggcctgaagagcgtgcagaagctgctggacgccgtggacacctacatccccgtgcccgccagagacctggagaagcccttcctgctgcccgtggaggccgtgtacagcgtgcccggcagaggcaccgtggtgaccggcaccctggagagaggcatcctgaagaagggcgacgagtgcgagctgctgggccacagcaagaacatcagaaccgtggtgaccggcatcgagatgttccacaagagcctggagagagccgaggccggcgacaacctgggcgccctggtgagaggcctgaagagagaggacctgagaagaggcctggtgatggtgaagcccggcagcatcaagccccaccagaaggtggaggcccaggtgtacatcctgagcaaggaggagggcggcagacacaagcccttcgtgagccacttcatgcccgtgatgttcagcctgacctgggacatggcctgcagaatcatcctgccccccgagaaggagctggccatgcccggcgaggacctgaagttcaacctgatcctgagacagcccatgatcctggagaagggccagagattcaccctgagagacggcaacagaaccatcggcaccggcctggtgaccaacaccctggccatgaccgaggaggagaagaacatcaagtggggctag

SEQ ID NO: 103884 - DNA, 1611 bp, Artificial Sequence
  Description of Artificial Sequence: Synthetic coding sequence
atggccacccccgacgccggcctgcccggcgccgagggcgtggagcccgccccctgggcccagctggaggcccccgccagactgctgctgcaggccctgcaggccggccccgagggcgccagaagaggcctgggcgtgctgagagccctgggcagcagaggctgggagcccttcgactggggcagactgctggaggccctgtgcagagaggagcccgtggtgcagggccccgacggcagactggagctgaagcccctgctgctgagactgcccagaatctgccagagaaacctgatgagcctgctgatggccgtgagacccagcctgcccgagagcggcctgctgagcgtgctgcagatcgcccagcaggacctggcccccgaccccgacgcctggctgagagccctgggcgagctgctgagaagagacctgggcgtgggcaccagcatggagggcgccagccccctgagcgagagatgccagagacagctgcagagcctgtgcagaggcctgggcctgggcggcagaagactgaagagcccccaggcccccgaccccgaggaggaggagaacagagacagccagcagcccggcaagagaagaaaggacagcgaggaggaggccgccagccccgagggcaagagagtgcccaagagactgagatgctgggaggaggaggaggaccacgagaaggagagacccgagcacaagagcctggagagcctggccgacggcggcagcgccagccccatcaaggaccagcccgtgatggccgtgaagaccggcgaggacggcagcaacctggacgacgccaagggcctggccgagagcctggagctgcccaaggccatccaggaccagctgcccagactgcagcagctgctgaagaccctggaggagggcctggagggcctggaggacgccccccccgtggagctgcagctgctgcacgagtgcagccccagccagatggacctgctgtgcgcccagctgcagctgccccagctgagcgacctgggcctgctgagactgtgcacctggctgctggccctgagccccgacctgagcctgagcaacgccaccgtgctgaccagaagcctgttcctgggcagaatcctgagcctgaccagcagcgccagcagactgctgaccaccgccctgaccagcttctgcgccaagtacacctaccccgtgtgcagcgccctgctggaccccgtgctgcaggcccccggcaccggccccgcccagaccgagctgctgtgctgcctggtgaagatggagagcctggagcccgacgcccaggtgctgatgctgggccagatcctggagctgccctggaaggaggagaccttcctggtgctgcagagcctgctggagagacaggtggagatgacccccgagaagttcagcgtgctgatggagaagctgtgcaagaagggcctggccgccaccaccagcatggcctacgccaagctgatgctgaccgtgatgaccaagtaccaggccaacatcaccgagacccagagactgggcctggccatggccctggagcccaacaccaccttcctgagaaagagcctgaaggccgccctgaagcacctgggcccctag

SEQ ID NO: 103885 - DNA, 1470 bp, Artificial Sequence
  Description of Artificial Sequence: Synthetic coding sequence
atgcccctgagagacgagaccctgagagaggtgtgggccagcgacagcggccacgaggaggagagcctgagccccgaggcccccagaagacccaagcagagacccgcccccgcccagagactgagaaagaagagaaccgaggcccccgagagcccctgccccaccggcagcaagcccagaaagcccggcgaggaggaggaggaggaggaggacgaggaggacgaggaggaggaggccgaggagaagaaggagaagatcctgctgccccccaagaagcccctgagagagaagagcagcgccgacctgaaggagagaagagccaaggcccagggccccagaggcgacctgggcagccccgaccccccccccaagcccctgagagtgagaaacaaggaggcccccgccggcgagggcaccaagatgagaaagaccaagaagaagggcagcggcgaggccgacaaggaccccagcggcagccccgccagcgccagaaagagccccgccgccatgttcctggtgggcgagggcagccccgacaagaaggccctgaagaagaagggcacccccaagggcgccagaaaggaggaggaggaggaggaggaggccgccaccgtgatcaagaagagcaaccagaagggcaaggccaagggcaagggcaagaagaaggccaaggaggagagagcccccagcccccccgtggaggtggacgagcccagagagttcgtgctgagacccgccccccagggcagaaccgtgagatgcagactgaccagagacaagaagggcatggacagaggcatgtaccccagctacttcctgcacctggacaccgagaagaaggtgttcctgctggccggcagaaagagaaagagaagcaagaccgccaactacctgatcagcatcgaccccaccaacctgagcagaggcggcgagaacttcatcggcaagctgagaagcaacctgctgggcaacagattcaccgtgttcgacaacggccagaacccccagagaggctacagcaccaacgtggccagcctgagacaggagctggccgccgtgatctacgagaccaacgtgctgggcttcagaggccccagaagaatgaccgtgatcatccccggcatgagcgccgagaacgagagagtgcccatcagacccagaaacgccagcgacggcctgctggtgagatggcagaacaagaccctggagagcctgatcgagctgcacaacaagccccccgtgtggaacgacgacagcggcagctacaccctgaacttccagggcagagtgacccaggccagcgtgaagaacttccagatcgtgcacgccgacgaccccgactacatcgtgctgcagttcggcagagtggccgaggacgccttcaccctggactacagataccccctgtgcgccctgcaggccttcgccatcgccctgagcagcttcgacggcaagctggcctgcgagtag

SEQ ID NO: 103886 - DNA, 561 bp, Artificial Sequence
  Description of Artificial Sequence: Synthetic coding sequence
atgcccctgagagacgagaccctgagagaggtgtgggccagcgacagcggccacgaggaggagagcctgagccccgaggcccccagaagacccaagcagagacccgcccccgcccagagactgagaaagaagagaaccgaggcccccgagagcccctgccccaccggcagcaagcccagaaagcccggcgaggaggaggaggaggaggaggacgaggaggacgaggaggaggaggccgaggagaagaaggagaagatcctgctgccccccaagaagcccctgagagagaagagcagcgccgacctgaaggagagaagagccaaggcccagggccccagaggcgacctgggcagccccgaccccccccccaagcccctgagagtgagaaacaaggaggcccccgccggcgagggcaccaagatgagaaagaccaagaagaagggcagcggcgaggccgacaaggaccccagcggcagccccgccagcgccagaaagagccccgccgccatgttcctggtgggcgagggcagccccgacaagaaggccctgaagaagaagtag

SEQ ID NO: 103887 - DNA, 3033 bp, Artificial Sequence
  Description of Artificial Sequence: Synthetic coding sequence
atgggcgcctacgccagagccagcggcgtgtgcgccagaggctgcctggacagcgccggcccctggaccatgagcagagccctgagaccccccctgccccccctgtgcttcttcctgctgctgctggccgccgccggcgccagagccggcggctacgagacctgccccaccgtgcagcccaacatgctgaacgtgcacctgctgccccacacccacgacgacgtgggctggctgaagaccgtggaccagtacttctacggcatcaagaacgacatccagcacgccggcgtgcagtacatcctggacagcgtgatcagcgccctgctggccgaccccaccagaagattcatctacgtggagatcgccttcttcagcagatggtggcaccagcagaccaacgccacccaggaggtggtgagagacctggtgagacagggcagactggagttcgccaacggcggctgggtgatgaacgacgaggccgccacccactacggcgccatcgtggaccagatgaccctgggcctgagattcctggaggacaccttcggcaacgacggcagacccagagtggcctggcacatcgaccccttcggccacagcagagagcaggccagcctgttcgcccagatgggcttcgacggcttcttcttcggcagactggactaccaggacaagtgggtgagaatgcagaagctggagatggagcaggtgtggagagccagcaccagcctgaagccccccaccgccgacctgttcaccggcgtgctgcccaacggctacaacccccccagaaacctgtgctgggacgtgctgtgcgtggaccagcccctggtggaggaccccagaagccccgagtacaacgccaaggagctggtggactacttcctgaacgtggccaccgcccagggcagatactacagaaccaaccacaccgtgatgaccatgggcagcgacttccagtacgagaacgccaacatgtggttcaagaacctggacaagctgatcagactggtgaacgcccaggccaagggcagcagcgtgcacgtgctgtacagcacccccgcctgctacctgtgggagctgaacaaggccaacctgacctggagcgtgaagcacgacgacttcttcccctacgccgacggcccccaccagttctggaccggctacttcagcagcagacccgccctgaagagatacgagagactgagctacaacttcctgcaggtgtgcaaccagctggaggccctggtgggcctggccgccaacgtgggcccctacggcagcggcgacagcgcccccctgaacgaggccatggccgtgctgcagcaccacgacgccgtgagcggcaccagcagacagcacgtggccaacgactacgccagacagctggccgccggctggggcccctgcgaggtgctgctgagcaacgccctggccagactgagaggcttcaaggaccacttcaccttctgccagcagctgaacatcagcatctgccccctgagccagaccgccgccagattccaggtgatcgtgtacaaccccctgggcagaaaggtgaactggatggtgagactgcccgtgagcgagggcgtgttcgtggtgaaggaccccaacggcagaaccgtgcccagcgacgtggtgatcttccccagcagcgacagccaggcccacccccccgagctgctgttcagcgccagcctgcccgccctgggcttcagcacctacagcgtggcccaggtgcccagatggaagccccaggccagagccccccagcccatccccagaagaagctggagccccgccctgaccatcgagaacgagcacatcagagccaccttcgaccccgacaccggcctgctgatggagatcatgaacatgaaccagcagctgctgctgcccgtgagacagaccttcttctggtacaacgccagcatcggcgacaacgagagcgaccaggccagcggcgcctacatcttcagacccaaccagcagaagcccctgcccgtgagcagatgggcccagatccacctggtgaagacccccctggtgcaggaggtgcaccagaacttcagcgcctggtgcagccaggtggtgagactgtaccccggccagagacacctggagctggagtggagcgtgggccccatccccgtgggcgacacctggggcaaggaggtgatcagcagattcgacacccccctggagaccaagggcagattctacaccgacagcaacggcagagagatcctggagagaagaagagactacagacccacctggaagctgaaccagaccgagcccgtggccggcaactactaccccgtgaacaccagaatctacatcaccgacggcaacatgcagctgaccgtgctgaccgacagaagccagggcggcagcagcctgagagacggcagcctggagctgatggtgcacagaagactgctgaaggacgacggcagaggcgtgagcgagcccctgatggagaacggcagcggcgcctgggtgagaggcagacacctggtgctgctggacaccgcccaggccgccgccgccggccacagactgctggccgagcaggaggtgctggccccccaggtggtgctggcccccggcggcggcgccgcctacaacctgggcgccccccccagaacccagttcagcggcctgagaagagacctgccccccagcgtgcacctgctgaccctggccagctggggccccgagatggtgctgctgagactggagcaccagttcgccgtgggcgaggacagcggcagaaacctgagcgcccccgtgaccctgaacctgagagacctgttcagcaccttcaccatcaccagactgcaggagaccaccctggtggccaaccagctgagagaggccgccagcagactgaagtggaccaccaacaccggccccaccccccaccagaccccctaccagctggaccccgccaacatcaccctggagcccatggagatcagaaccttcctggccagcgtgcagtggaaggaggtggacggctag

SEQ ID NO: 103888 - DNA, 1158 bp, Artificial Sequence
  Description of Artificial Sequence: Synthetic coding sequence
atgcacgtgtgcgtgtgcgtgtgcgtgtgcgtgtacatgcccgtgtgcgtggacgcctgcatgtgctgcgaggccggcagacccgccttcagaagcttcctgttcagcctgtgcagcgacctgggcgccgtgatcagcctgctgctgtggggcagacagctgttcgccctgtacagcggcaacgacgtgaccgacatcagcgacgacagattccccaagccccccgagatcgccaacggctacgtggagcacctgttcagataccagtgcaagaactactacagactgagaaccgagggcgacggcgtgtacaccctgaacgacaagaagcagtggatcaacaaggccgtgggcgacaagctgcccgagtgcgaggccgtgtgcggcaagcccaagaaccccgccaaccccgtgcagagaatcctgggcggccacctggacgccaagggcagcttcccctggcaggccaagatggtgagccaccacaacctgaccaccggcgccaccctgatcaacgagcagtggctgctgaccaccgccaagaacctgttcctgaaccacagcgagaacgccaccgccaaggacatcgcccccaccctgaccctgtacgtgggcaagaagcagctggtggagatcgagaaggtggtgctgcaccccaactaccaccaggtggacatcggcctgatcaagctgaagcagaaggtgctggtgaacgagagagtgatgcccatctgcctgcccagcaagaactacgccgaggtgggcagagtgggctacgtgagcggctggggccagagcgacaacttcaagctgaccgaccacctgaagtacgtgatgctgcccgtggccgaccagtacgactgcatcacccactacgagggcagcacctgccccaagtggaaggcccccaagagccccgtgggcgtgcagcccatcctgaacgagcacaccttctgcgtgggcatgagcaagtaccaggaggacacctgctacggcgacgccggcagcgccttcgccgtgcacgacctggaggaggacacctggtacgccgccggcatcctgagcttcgacaagagctgcgccgtggccgagtacggcgtgtacgtgaaggtgaccagcatccagcactgggtgcagaagaccatcgccgagaactag

SEQ ID NO: 103889 - DNA, 1329 bp, Artificial Sequence; identical to SEQ ID NO: 77265
  Description of Artificial Sequence: Synthetic coding sequence

SEQ ID NO: 103890 - DNA, 513 bp, Artificial Sequence
  Description of Artificial Sequence: Synthetic coding sequence
atgatgaagatgagacaggccaagctggactaccagagactgctgctggagaagagacagagaaagaagagactggagcccttcatggtgcagcccaaccccgaggccagactgagaagagccaagcccagagccagcgacgagcagacccccctggtgaactgccacaccccccacagcaacgtgatcctgcacggcatcgacggccccgccgccgtgctgaagcccgacgaggtgcacgcccccagcgtgagcagcagcgtggtggaggaggacgccgagaacaccgtggacaccgccagcaagcccggcctgcaggagagactgcagaagcacgacatcagcgagagcgtgaacttcgacgaggagaccgacggcatcagccagagcgcctgcctggagagacccaacagcgccagcagccagaacagcaccttcagcagcttctgccagaagaccgaggacaccggctacagacacttcagattctgctactgcagacccaccagctag

SEQ ID NO: 103891 - DNA, 801 bp, Artificial Sequence
  Description of Artificial Sequence: Synthetic coding sequence
atgctgaagaccccctggatcctgctgcccagccaggacttcagaagcgtgagcaagagcatggacaccggcaccagcggcagcgccaccgccgcccagcccgccgacaacctgctgggcgacatcgacgacctggaggacttcgtgtacagccccgccccccagggcgtgaccgtgagatgcagaatcatcagagacaagagaggcatggacagaggcctgttccccacctactacatgtacctggagaaggaggagaaccagaagatcttcctgctggccgccagaaagagaaagaagagcaagaccgccaactacctgatcagcatcgaccccgtggacctgagcagagagggcgagagctacgtgggcaagctgagaagcaacctgatgggcaccaagttcaccgtgtacgacagaggcatctgccccatgaagggcagaggcctggtgggcgccgcccacaccagacaggagctggccgccatcagctacaaccacgacagcctgctgagcagatggcagaacagaaccatggagaacctggtggagctgcacaacaaggcccccgtgtggaacagcgacacccagagctacgtgctgaacttcagaggcagagtgacccaggccagcgtgaagaacttccagatcgtgcacaagaacgaccccgactacatcgtgatgcagttcggcagagtggccgacgacgtgttcaccctggactacaactaccccctgtgcgccgtgcaggccttcggcatcggcctgagcagcttcgacagcaagctggcctgcgagtag

SEQ ID NO: 103892 - DNA, 1506 bp, Artificial Sequence
  Description of Artificial Sequence: Synthetic coding sequence
atggaggccagcagatgcagactgagccccagcggcgacagcgtgttccacgaggagatgatgaagatgagacaggccaagctggactaccagagactgctgctggagaagagacagagaaagaagagactggagcccttcatggtgcagcccaaccccgaggccagactgagaagagccaagcccagagccagcgacgagcagacccccctggtgaactgccacaccccccacagcaacgtgatcctgcacggcatcgacggccccgccgccgtgctgaagcccgacgaggtgcacgcccccagcgtgagcagcagcgtggtggaggaggacgccgagaacaccgtggacaccgccagcaagcccggcctgcaggagagactgcagaagcacgacatcagcgagagcgtgaacttcgacgaggagaccgacggcatcagccagagcgcctgcctggagagacccaacagcgccagcagccagaacagcaccgacaccggcaccagcggcagcgccaccgccgcccagcccgccgacaacctgctgggcgacatcgacgacctggaggacttcgtgtacagccccgccccccagggcgtgaccgtgagatgcagaatcatcagagacaagagaggcatggacagaggcctgttccccacctactacatgtacctggagaaggaggagaaccagaagatcttcctgctggccgccagaaagagaaagaagagcaagaccgccaactacctgatcagcatcgaccccgtggacctgagcagagagggcgagagctacgtgggcaagctgagaagcaacctgatgggcaccaagttcaccgtgtacgacagaggcatctgccccatgaagggcagaggcctggtgggcgccgcccacaccagacaggagctggccgccatcagctacgagaccaacgtgctgggcttcaagggccccagaaagatgagcgtgatcatccccggcatgaccctgaaccacaagcagatcccctaccagccccagaacaaccacgacagcctgctgagcagatggcagaacagaaccatggagaacctggtggagctgcacaacaaggcccccgtgtggaacagcgacacccagagctacgtgctgaacttcagaggcagagtgacccaggccagcgtgaagaacttccagatcgtgcacaagaacgaccccgactacatcgtgatgcagttcggcagagtggccgacgacgtgttcaccctggactacaactaccccctgtgcgccgtgcaggccttcggcatcggcctgagcagcttcgacaagtgcatccagaccctgagaatgcaggagctgtgcgagctgcacagacagcaccacagcgccgccagcctggtgcacagaaccgtgtgccagagatgggtgggccacccctggagactgctgccccagaccagcctgctgtggaccgacctgagccccccccccgtggtgcccgccccccaccagatcagcatgtag

SEQ ID NO: 103893 - DNA, 1269 bp, Artificial Sequence
  Description of Artificial Sequence: Synthetic coding sequence
atggccctgagcgacgagcccgccgccggcggccccgaggaggaggccgaggacgagaccctggccttcggcgccgccctggaggccttcggcgagagcgccgagaccagagccctgctgggcagactgagagaggtgcacggcggcggcgccgagagagaggtggccctggagagattcagagagtggatgatgaacctgctgctggacatcgtgcaggaccagaccagccccgccagcctggtgcacctggccttcaagttcctgtacatcatcaccaaggtgagaggctacaagaccttcctgagactgttcccccacgaggtggccgacgtggagcccgtgctggacctggtgaccatccagaaccccaaggaccacgaggcctgggagaccagatacatgctgctgctgtggctgagcgtgacctgcctgatccccttcgacttcagcagactggacggcaacctgctgacccagcccggccaggccagaatgagcatcatggacagaatcctgcagatcgccgagagctacctgatcgtgagcgacaaggccagagacgccgccgccgtgctggtgagcagattcatcaccagacccgacgtgaagcagagcaagatggccgagttcctggactggagcctgtgcaacctggccagaagcagcttccagaccatgcagggcgtgatcaccatggacggcaccctgcaggccctggcccagatcttcaagcacggcaagagagaggactgcctgccctacgccgccaccgtgctgagatgcctggacggctgcagactgcccgagagcaaccagaccctgctgagaaagctgggcgtgaagctggtgcagagactgggcctgaccttcctgaagcccaaggtggccgcctggagataccagagaggctgcagaagcctggccgccaacctgcagctgctgacccagggccagagcgagcagaagcccctgatcctgaccgaggacgacgacgaggacgacgacgtgcccgagggcgtggagagagtgatcgagcagctgctggtgggcctgaaggacaaggacaccgtggtgagatggagcgccgccaagggcatcggcagaatggccggcagactgcccagagccctggccgacgacgtggtgggcagcgtgctggactgcttcagcttccaggagaccgacaaggcctggcacggcggctgcctggccctggccgagctgggcagaagaggcctgctgctgcccagcagactggtggactag

SEQ ID NO: 103894 - DNA, 2997 bp, Artificial Sequence
  Description of Artificial Sequence: Synthetic coding sequence
atggacggcaccctgcaggccctggcccagatcttcaagcacggcaagagagaggactgcctgccctacgccgccaccgtgctgagatgcctggacggctgcagactgcccgagagcaaccagaccctgctgagaaagctgggcgtgaagctggtgcagagactgggcctgaccttcctgaagcccaaggtggccgcctggagataccagagaggctgcagaagcctggccgccaacctgcagctgctgacccagggccagagcgagcagaagcccctgatcctgaccgaggacgacgacgaggacgacgacgtgcccgagggcgtggagagagtgatcgagcagctgctggtgggcctgaaggacaaggacaccgtggtgagatggagcgccgccaagggcatcggcagaatggccggcagactgcccagagccctggccgacgacgtggtgggcagcgtgctggactgcttcagcttccaggagaccgacaaggcctggcacggcggctgcctggccctggccgagctgggcagaagaggcctgctgctgcccagcagactggtggacgtggtggccgtgatcctgaaggccctgacctacgacgagaagagaggcgcctgcagcgtgggcaccaacgtgagagacgccgcctgctacgtgtgctgggccttcgccagagcctacgagccccaggagctgaagcccttcgtgaccgccatcagcagcgccctggtgatcgccgccgtgttcgacagagacatcaactgcagaagagccgccagcgccgccttccaggagaacgtgggcagacagggcaccttcccccacggcatcgacatcctgaccaccgccgactacttcgccgtgggcaacagaagcaactgcttcctggtgatcagcgtgttcatcgccggcttccccgagtacacccagcccatgatcgaccacctggtgaccatgaagatcagccactgggacggcgtgatcagagagctggccgccagagccctgcacaacctggcccagcaggcccccgagttcagcgccacccaggtgttccccagactgctgagcatgaccctgagccccgacctgcacatgagacacggcagcatcctggcctgcgccgaggtggcctacgccctgtacaagctggccgcccaggagaacagacccgtgaccgaccacctggacgagcaggccgtgcagggcctgaagcagatccaccagcagctgtacgacagacagctgtacagaggcctgggcggccagctgatgagacaggccgtgtgcgtgctgatcgagaagctgagcctgagcaagatgcccttcagaggcgacaccgtgatcgacggctggcagtggctgatcaacgacaccctgagacacctgcacctgatcagcagccacagcagacagcagatgaaggacgccgccgtgagcgccctggccgccctgtgcagcgagtactacatgaaggagcccggcgaggccgaccccgccatccaggaggagctgatcacccagtacctggccgagctgagaaaccccgaggagatgaccagatgcggcttcagcctggccctgggcgccctgcccggcttcctgctgaagggcagactgcagcaggtgctgaccggcctgagagccgtgacccacaccagccccgaggacgtgagcttcgccgagagcagaagagacggcctgaaggccatcgccagaatctgccagaccgtgggcgtgaaggccggcgcccccgacgaggccgtgtgcggcgagaacgtgagccagatctactgcgccctgctgggctgcatggacgactacaccaccgacagcagaggcgacgtgggcacctgggtgagaaaggccgccatgaccagcctgatggacctgaccctgctgctggccagaagccagcccgagctgatcgaggcccacacctgcgagagaatcatgtgctgcgtggcccagcaggccagcgagaagatcgacagattcagagcccacgccgccagcgtgttcctgaccctgctgcacttcgacagcccccccatcccccacgtgccccacagaggcgagctggagaagctgttccccagaagcgacgtggccagcgtgaactggagcgcccccagccaggccttccccagaatcacccagctgctgggcctgcccacctacagataccacgtgctgctgggcctggtggtgagcctgggcggcctgaccgagagcaccatcagacacagcacccagagcctgttcgagtacatgaagggcatccagagcgacccccaggccctgggcagcttcagcggcaccctgctgcagatcttcgaggacaacctgctgaacgagagagtgagcgtgcccctgctgaagaccctggaccacgtgctgacccacggctgcttcgacatcttcaccaccgaggaggaccaccccttcgccgtgaagctgctggccctgtgcaagaaggagatcaagaacagcaaggacatccagaagctgctgagcggcatcgccgtggacttccccagcgccaccctggtgtgcgtgggcaccgtgcagatgtacgcccacacccacctgagactgggcgcccccggcccccactgcgcccacggcagcgccctgcccagattctgcgagatggtgcagttccccggcgacgtgagaagacaggccctgctgcagctgtgcctgctgctgtgccacagattccccctgatcagaaagaccaccgccagccaggtgtacgagaccctgctgacctacagcgacgtggtgggcgccgacgtgctggacgaggtggtgaccgtgctgagcgacaccgcctgggacgccgagctggccgtggtgagagagcagagaaacagactgtgcgacctgctgggcgtgccccccagctggtgccccacctggtgcctgctgaagcccgtgctggagcccatcccccacccctgcctggtgagaatgagctgcagctag

SEQ ID NO: 103895 - DNA, 3579 bp, Artificial Sequence
  Description of Artificial Sequence: Synthetic coding sequence
atggccctgagcgacgagcccgccgccggcggccccgaggaggaggccgaggacgagaccctggccttcggcgccgccctggaggccttcggcgagagcgccgagaccagagccctgctgggcagactgagagaggtgcacggcggcggcgccgagagagaggtggccctggagagattcagagtgatcatggacaagtaccaggagcagccccacctgctggacccccacctggagtggatgatgaacctgctgctggacatcgtgcaggaccagaccagccccgccagcctggtgcacctggccttcaagttcctgtacatcatcaccaaggtgagaggctacaagaccttcctgagactgttcccccacgaggtggccgacgtggagcccgtgctggacctggtgaccatccagaaccccaaggaccacgaggcctgggagaccagatacatgctgctgctgtggctgagcgtgacctgcctgatccccttcgacttcagcagactggacggcaacctgctgacccagcccggccaggccagaatgagcatcatggacagaatcctgcagatcgccgagagctacctgatcgtgagcgacaaggccagagacgccgccgccgtgctggtgagcagattcatcaccagacccgacgtgaagcagagcaagatggccgagttcctggactggagcctgtgcaacctggccagaagcagcttccagaccatgcagggcgtgatcaccatggacggcaccctgcaggccctggcccagatcttcaagcacggcaagagagaggactgcctgccctacgccgccaccgtgctgagatgcctggacggctgcagactgcccgagagcaaccagaccctgctgagaaagctgggcgtgaagctggtgcagagactgggcctgaccttcctgaagcccaaggtggccgcctggagataccagagaggctgcagaagcctggccgccaacctgcagctgctgacccagggccagagcgagcagaagcccctgatcctgaccgaggacgacgacgaggacgacgacgtgcccgagggcgtggagagagtgatcgagcagctgctggtgggcctgaaggacaaggacaccgtggtgagatggagcgccgccaagggcatcggcagaatggccggcagactgcccagagccctggccgacgacgtggtgggcagcgtgctggactgcttcagcttccaggagaccgacaaggcctggcacggcggctgcctggccctggccgagctgggcagaagaggcctgctgctgcccagcagactggtggacgtggtggccgtgatcctgaaggccctgacctacgacgagaagagaggcgcctgcagcgtgggcaccaacgtgagagacgccgcctgctacgtgtgctgggccttcgccagagcctacgagccccaggagctgaagcccttcgtgaccgccatcagcagcgccctggtgatcgccgccgtgttcgacagagacatcaactgcagaagagccgccagcgccgccttccaggagaacgtgggcagacagggcaccttcccccacggcatcgacatcctgaccaccgccgactacttcgccgtgggcaacagaagcaactgcttcctggtgatcagcgtgttcatcgccggcttccccgagtacacccagcccatgatcgaccacctggtgaccatgaagatcagccactgggacggcgtgatcagagagctggccgccagagccctgcacaacctggcccagcaggcccccgagttcagcgccacccaggtgttccccagactgctgagcatgaccctgagccccgacctgcacatgagacacggcagcatcctggcctgcgccgaggtggcctacgccctgtacaagctggccgcccaggagaacagacccgtgaccgaccacctggacgagcaggccgtgcagggcctgaagcagatccaccagcagctgtacgacagacagctgtacagaggcctgggcggccagctgatgagacaggccgtgtgcgtgctgatcgagaagctgagcctgagcaagatgcccttcagaggcgacaccgtgatcgacggctggcagtggctgatcaacgacaccctgagacacctgcacctgatcagcagccacagcagacagcagatgaaggacgccgccgtgagcgccctggccgccctgtgcagcgagtactacatgaaggagcccggcgaggccgaccccgccatccaggaggagctgatcacccagtacctggccgagctgagaaaccccgaggagatgaccagatgcggcttcagcctggccctgggcgccctgcccggcttcctgctgaagggcagactgcagcaggtgctgaccggcctgagagccgtgacccacaccagccccgaggacgtgagcttcgccgagagcagaagagacggcctgaaggccatcgccagaatctgccagaccgtgggcgtgaaggccggcgcccccgacgaggccgtgtgcggcgagaacgtgagccagatctactgcgccctgctgggctgcatggacgactacaccaccgacagcagaggcgacgtgggcacctgggtgagaaaggccgccatgaccagcctgatggacctgaccctgctgctggccagaagccagcccgagctgatcgaggcccacacctgcgagagaatcatgtgctgcgtggcccagcaggccagcgagaagatcgacagattcagagcccacgccgccagcgtgttcctgaccctgctgcacttcgacagcccccccatcccccacgtgccccacagaggcgagctggagaagctgttccccagaagcgacgtggccagcgtgaactggagcgcccccagccaggccttccccagaatcacccagctgctgggcctgcccacctacagataccacgtgctgctgggcctggtggtgagcctgggcggcctgaccgagagcaccatcagacacagcacccagagcctgttcgagtacatgaagggcatccagagcgacccccaggccctgggcagcttcagcggcaccctgctgcagatcttcgaggacaacctgctgaacgagagagtgagcgtgcccctgctgaagaccctggaccacgtgctgacccacggctgcttcgacatcttcaccaccgaggaggaccaccccttcgccgtgaagctgctggccctgtgcaagaaggagatcaagaacagcaaggacatccagaagctgctgagcggcatcgccgtgttctgcgagatggtgcagttccccggcgacgtgagaagacaggccctgctgcagctgtgcctgctgctgtgccacagattccccctgatcagaaagaccaccgccagccaggtgtacgagaccctgctgacctacagcgacgtggtgggcgccgacgtgctggacgaggtggtgaccgtgctgagcgacaccgcctgggacgccgagctggccgtggtgagagagcagagaaacagactgtgcgacctgctgggcgtgcccagaccccagctggtgccccagcccggcgcctgctag

SEQ ID NO: 103896 - DNA, 936 bp, Artificial Sequence
  Description of Artificial Sequence: Synthetic coding sequence
atggccggcagactgcccagagccctggccgacgacgtggtgggcagcgtgctggactgcttcagcttccaggagaccgacaaggcctggcacggcggctgcctggccctggccgagctgggcagaagaggcctgctgctgcccagcagactggtggacgtggtggccgtgatcctgaaggccctgacctacgacgagaagagaggcgcctgcagcgtgggcaccaacgtgagagacgccgcctgctacgtgtgctgggccttcgccagagcctacgagccccaggagctgaagcccttcgtgaccgccatcagcagcgccctggtgatcgccgccgtgttcgacagagacatcaactgcagaagagccgccagcgccgccttccaggagaacgtgggcagacagggcaccttcccccacggcatcgacatcctgaccaccgccgactacttcgccgtgggcaacagaagcaactgcttcctggtgatcagcgtgttcatcgccggcttccccgagtacacccagcccatgatcgaccacctggtgaccatgaagatcagccactgggacggcgtgatcagagagctggccgccagagccctgcacaacctggcccagcaggcccccgagttcagcgccacccaggtgttccccagactgctgagcatgaccctgagccccgacctgcacatgagacacggcagcatcctggcctgcgccgaggtggcctacgccctgtacaagctggccgcccaggagaacagacccgtgaccgaccacctggacgagcaggccgtgcagggcctgaagcagatccaccagcagccctgcatctgcagctggggcctgatgagccccgagagcaaggccgagttctgcgtgtgcgtgtgcagaatcagcctgggcagacagtgcgtgcacctgagcggcctgtag

SEQ ID NO: 103897 - DNA, 2253 bp, Artificial Sequence
  Description of Artificial Sequence: Synthetic coding sequence
atggccctgagcgacgagcccgccgccggcggccccgaggaggaggccgaggacgagaccctggccttcggcgccgccctggaggccttcggcgagagcgccgagaccagagccctgctgggcagactgagagaggtgcacggcggcggcgccgagagagaggtggccctggagagattcagagtgatcatggacaagtaccaggagcagccccacctgctggacccccacctggagtggatgatgaacctgctgctggacatcgtgcaggaccagaccagccccgccagcctggtgcacctggccttcaagttcctgtacatcatcaccaaggtgagaggctacaagaccttcctgagactgttcccccacgaggtggccgacgtggagcccgtgctggacctggtgaccatccagaaccccaaggaccacgaggcctgggagaccagatacatgctgctgctgtggctgagcgtgacctgcctgatccccttcgacttcagcagactggacggcaacctgctgacccagcccggccaggccagaatgagcatcatggacagaatcctgcagatcgccgagagctacctgatcgtgagcgacaaggccagagacgccgccgccgtgctggtgagcagattcatcaccagacccgacgtgaagcagagcaagatggccgagttcctggactggagcctgtgcaacctggccagaagcagcttccagaccatgcagggcgtgatcaccatggacggcaccctgcaggccctggcccagatcttcaagcacggcaagagagaggactgcctgccctacgccgccaccgtgctgagatgcctggacggctgcagactgcccgagagcaaccagaccctgctgagaaagctgggcgtgaagctggtgcagagactgggcctgaccttcctgaagcccaaggtggccgcctggagataccagagaggctgcagaagcctggccgccaacctgcagctgctgacccagggccagagcgagcagaagcccctgatcctgaccgaggacgacgacgaggacgacgacgtgcccgagggcgtggagagagtgatcgagcagctgctggtgggcctgaaggacaaggacaccgtggtgagatggagcgccgccaagggcatcggcagaatggccggcagactgcccagagccctggccgacgacgtggtgggcagcgtgctggactgcttcagcttccaggagaccgacaaggcctggcacggcggctgcctggccctggccgagctgggcagaagaggcctgctgctgcccagcagactggtggacgtggtggccgtgatcctgaaggccctgacctacgacgagaagagaggcgcctgcagcgtgggcaccaacgtgagagacgccgcctgctacgtgtgctgggccttcgccagagcctacgagccccaggagctgaagcccttcgtgaccgccatcagcagcgccctggtgatcgccgccgtgttcgacagagacatcaactgcagaagagccgccagcgccgccttccaggagaacgtgggcagacagggcaccttcccccacggcatcgacatcctgaccaccgccgactacttcgccgtgggcaacagaagcaactgcttcctggtgatcagcgtgttcatcgccggcttccccgagtacacccagcccatgatcgaccacctggtgaccatgaagatcagccactgggacggcgtgatcagagagctggccgccagagccctgcacaacctggcccagcaggcccccgagttcagcgccacccaggtgttccccagactgctgagcatgaccctgagccccgacctgcacatgagacacggcagcatcctggcctgcgccgaggtggcctacgccctgtacaagctggccgcccaggagaacagacccgtgaccgaccacctggacgagcaggccgtgcagggcctgaagcagatccaccagcagctgtacgacagacagctgtacagaggcctgggcggccagctgatgagacaggccgtgtgcgtgctgatcgagaagctgagcctgagcaagatgcccttcagaggcgacaccgtgatcgacggctggcagtggctgatcaacgacagcctgtggctgctggtgggcctgggcagacccagcagactgcccagcgagagacccgcccccgccggcagccacagattcaagagcagctacccccacttccccagaggcagaaagttctgctag

SEQ ID NO: 103898 - DNA, 555 bp, Artificial Sequence
  Description of Artificial Sequence: Synthetic coding sequence
atgaagggcatccagagcgacccccaggccctgggcagcttcagcggcaccctgctgcagatcttcgaggacaacctgctgaacgagagagtgagcgtgcccctgctgaagaccctggaccacgtgctgacccacggctgcttcgacatcttcaccaccgaggaggaccaccccttcgccgtgaagctgctggccctgtgcaagaaggagatcaagaacagcaaggacatccagaagctgctgagcggcatcgccgtgttctgcgagatggtgcagttccccggcgacgtgagaagacaggccctgctgcagctgtgcctgctgctgtgccacagattccccctgatcagaaagaccaccgccagccaggtgtacgagaccctgctgacctacagcgacgtggtgggcgccgacgtgctggacgaggtggtgaccgtgctgagcgacaccgcctgggacgccgagctggccgtggtgagagagcagagaaacagactgtgcgacctgctgggcgtgcccagaccccagctggtgccccagcccggcgcctgctag

SEQ ID NO: 103899 - DNA, 1584 bp, Artificial Sequence
  Description of Artificial Sequence: Synthetic coding sequence
atgagcgacaccctgaccgccgacgtgatcggcagaagagtggaggtgaacggcgagcacgccaccgtgagattcgccggcgtggtgccccccgtggccggcccctggctgggcgtggagtgggacaaccccgagagaggcaagcacgacggcagccacgagggcaccgtgtacttcaagtgcagacaccccaccggcggcagcttcatcagacccaacaaggtgaacttcggcaccgacttcctgaccgccatcaagaacagatacgtgctggaggacggccccgaggaggacagaaaggagcagatcgtgaccatcggcaacaagcccgtggagaccatcggcttcgacagcatcatgaagcagcagagccagctgagcaagctgcaggaggtgagcctgagaaactgcgccgtgagctgcgccggcgagaagggcggcgtggccgaggcctgccccaacatcagaaaggtggacctgagcaagaacctgctgagcagctgggacgaggtgatccacatcgccgaccagctgagacacctggaggtgctgaacgtgagcgagaacaagctgaagttccccagcggcagcgtgctgaccggcaccctgagcgtgctgaaggtgctggtgctgaaccagaccggcatcacctgggccgaggtgctgagatgcgtggccggctgccccggcctggaggagctgtacctggagagcaacaacatcttcatcagcgagagacccaccgacgtgctgcagaccgtgaagctgctggacctgagcagcaaccagctgatcgacgagaaccagctgtacctgatcgcccacctgcccagactggagcagctgatcctgagcgacaccggcatcagcagcctgcacttccccgacgccggcatcggctgcaagaccagcatgttccccagcctgaagtacctggtggtgaacgacaaccagatcagccagtggagcttcttcaacgagctggagaagctgcccagcctgagagccctgagctgcctgagaaaccccctgaccaaggaggacaaggaggccgagaccgccagactgctgatcatcgccagcatcggccagctgaagaccctgaacaagtgcgagatcctgcccgaggagagaagaagagccgagctggactacagaaaggccttcggcaacgagtggaagcaggccggcggccacaaggaccccgagaagaacagactgagcgaggagttcctgaccgcccaccccagataccagttcctgtgcctgaagtacggcgcccccgaggactgggagctgaagacccagcagcccctgatgctgaagaaccagctgctgaccctgaagatcaagtacccccaccagctggaccagaaggtgctggagaagcagctgcccggcagcatgaccatccagaaggtgaagggcctgctgagcagactgctgaaggtgcccgtgagcgacctgctgctgagctacgagagccccaagaagcccggcagagagatcgagctggagaacgacctgaagagcctgcagttctacagcgtggagaacggcgactgcctgctggtgagatggtag

SEQ ID NO: 103900 - DNA, 1584 bp, Artificial Sequence; identical to SEQ ID NO: 103899
  Description of Artificial Sequence: Synthetic coding sequence

SEQ ID NO: 103901 - DNA, 1737 bp, Artificial Sequence
  Description of Artificial Sequence: Synthetic coding sequence
atgagcgacaccctgaccgccgacgtgatcggcagaagagtggaggtgaacggcgagcacgccaccgtgagattcgccggcgtggtgccccccgtggccggcccctggctgggcgtggagtgggacaaccccgagagaggcaagcacgacggcagccacgagggcaccgtgtacttcaagtgcagacaccccaccggcggcagcttcatcagacccaacaaggtgaacttcggcaccgacttcctgaccgccatcaagaacagatacgtgctggaggacggccccgaggaggacagaaaggagcagatcgtgaccatcggcaacaagcccgtggagaccatcggcttcgacagcatcatgaagcagcagagccagctgagcaagctgcaggaggtgagcctgagaaactgcgccgtgagctgcgccggcgagaagggcggcgtggccgaggcctgccccaacatcagaaaggtggacctgagcaagaacctgctgagcagctgggacgaggtgatccacatcgccgaccagctgagacacctggaggtgctgaacgtgagcgagaacaagctgaagttccccagcggcagcgtgctgaccggcaccctgagcgtgctgaaggtgctggtgctgaaccagaccggcatcacctgggccgaggcccacgcccagtgcggcggcagcagacacggcctggacatgcagaaggacgccagcaagttcgtggacctgtgcgtgctgcagaagtgcagcaccagcaactgcatcatcagcgccaaggaccacaccagcatgagaatgaacgtggccaaggtgctgagatgcgtggccggctgccccggcctggaggagctgtacctggagagcaacaacatcttcatcagcgagagacccaccgacgtgctgcagaccgtgaagctgctggacctgagcagcaaccagctgatcgacgagaaccagctgtacctgatcgcccacctgcccagactggagcagctgatcctgagcgacaccggcatcagcagcctgcacttccccgacgccggcatcggctgcaagaccagcatgttccccagcctgaagtacctggtggtgaacgacaaccagatcagccagtggagcttcttcaacgagctggagaagctgcccagcctgagagccctgagctgcctgagaaaccccctgaccaaggaggacaaggaggccgagaccgccagactgctgatcatcgccagcatcggccagctgaagaccctgaacaagtgcgagatcctgcccgaggagagaagaagagccgagctggactacagaaaggccttcggcaacgagtggaagcaggccggcggccacaaggaccccgagaagaacagactgagcgaggagttcctgaccgcccaccccagataccagttcctgtgcctgaagtacggcgcccccgaggactgggagctgaagacccagcagcccctgatgctgaagaaccagctgctgaccctgaagatcaagtacccccaccagctggaccagaaggtgctggagaagcagctgcccggcagcatgaccatccagaaggtgaagggcctgctgagcagactgctgaaggtgcccgtgagcgacctgctgctgagctacgagagccccaagaagcccggcagagagatcgagctggagaacgacctgaagagcctgcagttctacagcgtggagaacggcgactgcctgctggtgagatggtag

SEQ ID NO: 103902 - DNA, 2001 bp, Artificial Sequence
  Description of Artificial Sequence: Synthetic coding sequence
atgatccacgagctgctgctggccctgagcggctaccccggcagcatcttcacctggaacaagagaagcggcctgcaggtgagccaggacttccccttcctgcaccccagcgagaccagcgtgctgaacagactgtgcagactgggcaccgactacatcagattcaccgagttcatcgagcagtacaccggccacgtgcagcagcaggaccaccaccccagccagcagggccagggcggcctgcacggcatctacctgagagccttctgcaccggcctggacagcgtgctgcagccctacagacaggccctgctggacctggagcaggagttcctgggcgacccccacctgagcatcagccacgtgaactacttcctggaccagttccagctgctgttccccagcgtgatggtggtggtggagcagatcaagagccagaagatccacggctgccagatcctggagaccgtgtacaagcacagctgcggcggcctgccccccgtgagaagcgccctggagaagatcctggccgtgtgccacggcgtgatgtacaagcagctgagcgcctggatgctgcacggcctgctgctggaccagcacgaggagttcttcatcaagcagggccccagcagcggcaacgtgagcgcccagcccgaggaggacgaggaggacctgggcatcggcggcctgaccggcaagcagctgagagagctgcaggacctgagactgatcgaggaggagaacatgctggcccccagcctgaagcagttcagcctgagagtggagatcctgcccagctacatccccgtgagagtggccgagaagatcctgttcgtgggcgagagcgtgcagatgttcgagaaccagaacgtgaacctgaccagaaagggcagcatcctgaagaaccaggaggacaccttcgccgccgagctgcacagactgaagcagcagcccctgttcagcctggtggacttcgagcaggtggtggacagaatcagaagcaccgtggccgagcacctgtggaagctgatggtggaggagagcgacctgctgggccagctgaagatcatcaaggacttctacctgctgggcagaggcgagctgttccaggccttcatcgacaccgcccagcacatgctgaagaccccccccaccgccgtgaccgagcacgacgtgaacgtggccttccagcagagcgcccacaaggtgctgctggacgacgacaacctgctgcccctgctgcacctgaccatcgagtaccacggcaaggagcacaaggacgccacccaggccagagagggccccagcagagagaccagccccagagaggcccccgccagcggctgggccgccctgggcctgagctacaaggtgcagtggcccctgcacatcctgttcacccccgccgtgctggagaagtacaacgtggtgttcaagtacctgctgagcgtgagaagagtgcaggccgagctgcagcactgctgggccctgcagatgcagagaaagcacctgaagagcaaccagaccgacgccatcaagtggagactgagaaaccacatggccttcctggtggacaacctgcagtactacctgcaggtggacgtgctggagagccagttcagccagctgctgcaccagatcaacagcaccagagacttcgagagcatcagactggcccacgaccacttcctgagcaacctgctggcccagagcttcatcctgctgaagcccgtgttccactgcctgaacgagatcctggacctgtgccacagcttctgcagcctggtgagccagaacctgggccccctggacgagagaggcgccgcccagctgagcatcctggtgaagggcttcagcagacagagcagcctgctgttcaagatcctgagcagcgtgagaaaccaccagatcaacagcgacctggcccagctgctgctgagactggactacaacaagtactacacccaggccggcggcaccctgggcagcttcggcatgtag

SEQ ID NO: 103903 - DNA, 660 bp, Artificial Sequence
  Description of Artificial Sequence: Synthetic coding sequence
atggccgacaaggccaagcccgccaaggccgccaacagaaccccccccaagagccccggcgaccccagcaaggacagagccgccaagagactgagcctggagagcgagggcgccggcgagggcgccgccgccagccccgagctgagcgccctggaggaggccttcagaagattcgccgtgcacggcgacgccagagccaccggcagagagatgcacggcaagaactggagcaagctgtgcaaggactgccaggtgatcgacggcagaaacgtgaccgtgaccgacgtggacatcgtgttcagcaagatcaagggcaagagctgcagaaccatcaccttcgagcagttccaggaggccctggaggagctggccaagaagagattcaaggacaagagcagcgaggaggccgtgagagaggtgcacagactgatcgagggcaaggcccccatcatcagcggcgtgaccaaggccatcagcagccccaccgtgagcagactgaccgacaccaccaagttcaccggcagccacaaggagagattcgaccccagcggcaagggcaagggcaaggccggcagagtggacctggtggacgagagcggctacgtgagcggctacaagcacgccggcacctacgaccagaaggtgcagggcggcaagtag

SEQ ID NO: 103904 - DNA, 1071 bp, Artificial Sequence
  Description of Artificial Sequence: Synthetic coding sequence
atgagcaagctgtggagaagaggcagcaccagcggcgccatggaggcccccgagcccggcgaggccctggagctgagcctggccggcgcccacggccacggcgtgcacaagaagaagcacaagaagcacaagaagaagcacaagaagaagcaccaccaggaggaggacgccggccccacccagcccagccccgccaagccccagctgaagctgaagatcaagctgggcggccaggtgctgggcaccaagagcgtgcccaccttcaccgtgatccccgagggccccagaagccccagccccctgatggtggtggacaacgaggaggagcccatggagggcgtgcccctggagcagtacagagcctggctggacgaggacagcaacctgagccccagccccctgagagacctgagcggcggcctgggcggccaggaggaggaggaggagcagagatggctggacgccctggagaagggcgagctggacgacaacggcgacctgaagaaggagatcaacgagagactgctgaccgccagacagagagccctgctgcagaaggccagaagccagcccagccccatgctgcccctgcccgtggccgagggctgccccccccccgccctgaccgaggagatgctgctgaagagagaggagagagccagaaagagaagactgcaggccgccagaagagccgaggagcacaagaaccagaccatcgagagactgaccaagaccgccgccaccagcggcagaggcggcagaggcggcgccagaggcgagagaagaggcggcagagccgccgcccccgcccccatggtgagatactgcagcggcgcccagggcagcaccctgagcttcccccccggcgtgcccgcccccaccgccgtgagccagagacccagccccagcggccccccccccagatgcagcgtgcccggctgcccccaccccagaagatacgcctgcagcagaaccggccaggccctgtgcagcctgcagtgctacagaatcaacctgcagatgagactgggcggccccgagggccccggcagccccctgctggccacctag

SEQ ID NO: 103905 - DNA, 1272 bp, Artificial Sequence
  Description of Artificial Sequence: Synthetic coding sequence
atggccggcaaggtgaagtgggtgaccgacatcgagaagagcgtgctgatcaacaacttcgagaagagaggctgggtgcaggtgaccgagaacgaggactggaacttctactggatgagcgtgcagaccatcagaaacgtgttcagcgtggaggccggctacagactgagcgacgaccagatcgtgaaccacttccccaaccactacgagctgaccagaaaggacctgatggtgaagaacatcaagagatacagaaaggagctggagaaggagggcagccccctggccgagaaggacgagaacggcaagtacctgtacctggacttcgtgcccgtgacctacatgctgcccgccgactacaacctgttcgtggaggagttcagaaagagccccagcagcacctggatcatgaagccctgcggcaaggcccagggcaagggcatcttcctgatcaacaagctgagccagatcaagaagtggagcagagacagcaagaccagcagcttcgtgagccagagcaacaaggaggcctacgtgatcagcctgtacatcaacaaccccctgctgatcggcggcagaaagttcgacctgagactgtacgtgctggtgagcacctacagacccctgagatgctacatgtacaagctgggcttctgcagattctgcaccgtgaagtacacccccagcaccagcgagctggacaacatgttcgtgcacctgaccaacgtggccatccagaagcacggcgaggactacaaccacatccacggcggcaagtggaccgtgagcaacctgagactgtacctggagagcaccagaggcaaggaggtgaccagcaagctgttcgacgagatccactggatcatcgtgcagagcctgaaggccgtggcccccgtgatgaacaacgacaagcactgcttcgagtgctacggctacgacatcatcatcgacgacaagctgaagccctggctgatcgaggtgaacgccagccccagcctgaccagcagcaccgccaacgacagaatcctgaagtacaacctgatcaacgacaccctgaacatcgccgtgcccaacggcgagatccccgactgcaagtggaacaagagcccccccaaggaggtgctgggcaactacgagatcctgtacgacgaggagctggcccagggcgacggcgccgacagagagctgagaagcagacagggccagagcctgggccccagagccggcagaagcagagacagcggcagagccgtgctgaccacctggaagtag

SEQ ID NO: 103906 - DNA, 1185 bp, Artificial Sequence
  Description of Artificial Sequence: Synthetic coding sequence
atggccggcaaggtgaagtgggtgaccgacatcgagaagagcgtgctgatcaacaacttcgagaagagaggctgggtgcaggtgaccgagaacgaggactggaacttctactggatgagcgtgcagaccatcagaaacgtgttcagcgtggaggccggctacagactgagcgacgaccagatcgtgaaccacttccccaaccactacgagctgaccagaaaggacctgatggtgaagaacatcaagagatacagaaaggagctggagaaggagggcagccccctggccgagaaggacgagaacggcaagtacctgtacctggacttcgtgcccgtgacctacatgctgcccgccgactacaacctgttcgtggaggagttcagaaagagccccagcagcacctggatcatgaagccctgcggcaaggcccagggcaagggcatcttcctgatcaacaagctgagccagatcaagaagtggagcagagacagcaagaccagcagcttcgtgagccagagcaacaaggaggcctacgtgatcagcctgtacatcaacaaccccctgctgatcggcggcagaaagttcgacctgagactgtacgtgctggtgagcacctacagacccctgagatgctacatgtacaagctgggcttctgcagattctgcaccgtgaagtacacccccagcaccagcgagctggacaacatgttcgtgcacctgaccaacgtggccatccagaagcacggcgaggactacaaccacatccacggcggcaagtggaccgtgagcaacctgagactgtacctggagagcaccagaggcaaggaggtgaccagcaagctgttcgacgagatccactggatcatcgtgcagagcctgaaggccgtggccgtgaacgccagccccagcctgaccagcagcaccgccaacgacagaatcctgaagtacaacctgatcaacgacaccctgaacatcgccgtgcccaacggcgagatccccgactgcaagtggaacaagagcccccccaaggaggtgctgggcaactacgagatcctgtacgacgaggagctggcccagggcgacggcgccgacagagagctgagaagcagacagggccagagcctgggccccagagccggcagaagcagagacagcggcagagccgtgctgaccacctggaagtag

SEQ ID NO: 103907 - DNA, 180 bp, Artificial Sequence
  Description of Artificial Sequence: Synthetic coding sequence
atggccggcaaggtgaagtgggtgaccgacatcgagaagagcgtgctgatcaacaacttcgagaagagaggctgggtgcaggtgaccgagaacgaggactggaacttctactggctgctggacctgcccgagttcagatacagaagctgcctgaacgagttccccgacttcagagtgtag

SEQ ID NO: 103908 - DNA, 1068 bp, Artificial Sequence
  Description of Artificial Sequence: Synthetic coding sequence
atgccccaccagcccaccatcctgctgaacaccgtgagcgccagcgccagcccctgcctgcaccccggcgcccagaacatccccagccccaccggcctgcccagatgcagaagcggcagccacaccatcggccccttcagcagcttccagagcgccgcccacatctacagccagaagctgagcagacccagcagcgccaaggccgccggcagctgctacctgaacaagcaccacagcggcatcgccaagacccagaaggagggcgaggacgccagcctgtacagcaagagatacaaccagagcatggtgaccgccgagctgcagagactggccgagaagcaggccgccagacagtacagccccagcagccacatcaacctgctgacccagcaggtgaccaacctgaacctggccaccggcatcatcaacagaagcagcgccagcgccccccccaccctgagacccatcatcagccccagcggccccacctggagcacccagagcgacccccaggcccccgagaaccacagcagcagccccggcagcagaagcctgcagaccggcggcttcgcctgggagggcgaggtggagaacaacgtgtacagccaggccaccggcgtggtgccccagcacaagtaccaccccaccgccggcagctaccagctgcagttcgccctgcagcagctggagcagcagaagctgcagagcagacagctgctggaccagagcagagccagacaccaggccatcttcggcagccagaccctgcccaacagcaacctgtggaccatgaacaacggcgccggctgcagaatcagcagcgccaccgccagcggccagaagcccaccaccctgccccagaaggtggtgcccccccccagcagctgcgccagcctggtgcccaagcccccccccaaccacgagcaggtgctgagaagagccaccagccagaaggccagcaagggcagcagcgccgagggccagctgaacggcctgcagagcagcctgaaccccgccgccttcgtgcccatcaccagcagcaccgtgaacagccacaccgccctgtag

SEQ ID NO: 103909 - DNA, 3846 bp, Artificial Sequence
  Description of Artificial Sequence: Synthetic coding sequence
atgcccatcgtgatggccagagacctggaggagaccgccagcagcagcgaggacgaggaggtgatcagccaggaggaccacccctgcatcatgtggaccggcggctgcagaagaatccccgtgctggtgttccacgccgacgccatcctgaccaaggacaacaacatcagagtgatcggcgagagataccacctgagctacaagatcgtgagaaccgacagcagactggtgagaagcatcctgaccgcccacggcttccacgaggtgcaccccagcagcaccgactacaacctgatgtggaccggcagccacctgaagcccttcctgctgagaaccctgagcgaggcccagaaggtgaaccacttccccagaagctacgagctgaccagaaaggacagactgtacaagaacatcatcagaatgcagcacacccacggcttcaaggccttccacatcctgccccagaccttcctgctgcccgccgagtacgccgagttctgcaacagctacagcaaggacagaggcccctggatcgtgaagcccgtggccagcagcagaggcagaggcgtgtacctgatcaacaaccccaaccagatcagcctggaggagaacatcctggtgagcagatacatcaacaaccccctgctgatcgacgacttcaagttcgacgtgagactgtacgtgctggtgaccagctacgaccccctggtgatctacctgtacgaggagggcctggccagattcgccaccgtgagatacgaccagggcgccaagaacatcagaaaccagttcatgcacctgaccaactacagcgtgaacaagaagagcggcgactacgtgagctgcgacgaccccgaggtggaggactacggcaacaagtggagcatgagcgccatgctgagatacctgaagcaggagggcagagacaccaccgccctgatggcccacgtggaggacctgatcatcaagaccatcatcagcgccgagctggccatcgccaccgcctgcaagaccttcgtgccccacagaagcagctgcttcgagctgtacggcttcgacgtgctgatcgacagcaccctgaagccctggctgctggaggtgaacctgagccccagcctggcctgcgacgcccccctggacctgaagatcaaggccagcatgatcagcgacatgttcaccgtggtgggcttcgtgtgccaggaccccgcccagagagccagcaccagacccatctaccccaccttcgagagcagcagaagaaaccccttccagaagccccagagatgcagacccctgagcgccagcgacgccgagatgaagaacctggtgggcagcgccagagagaagggccccggcaagctgggcggcagcgtgctgggcctgagcatggaggagatcaaggtgctgagaagagtgaaggaggagaacgacagaagaggcggcttcatcagaatcttccccaccagcgagacctgggagatctacggcagctacctggagcacaagaccagcatgaactacatgctggccaccagactgttccaggacagaatgaccgccgacggcgcccccgagctgaagatcgagagcctgaacagcaaggccaagctgcacgccgccctgtacgagagaaagctgctgagcctggaggtgagaaagagaagaagaagaagcagcagactgagagccatgagacccaagtaccccgtgatcacccagcccgccgagatgaacgtgaagaccgagaccgagagcgaggaggaggaggaggtggccctggacaacgaggacgaggagcaggaggccagccaggaggagagcgccggcttcctgagagagaaccaggccaagtacacccccagcctgaccgccctggtggagaacacccccaaggagaacagcatgaaggtgagagagtggaacaacaagggcggccactgctgcaagctggagacccaggagctggagcccaagttcaacctgatgcagatcctgcaggacaacggcaacctgagcaagatgcaggccagaatcgccttcagcgcctacctgcagcacgtgcagatcagactgatgaaggacagcggcggccagaccttcagcgccagctgggccgccaaggaggacgagcagatggagctggtggtgagattcctgaagagagccagcaacaacctgcagcacagcctgagaatggtgctgcccagcagaagactggccctgctggagagaagaagaatcctggcccaccagctgggcgacttcatcatcgtgtacaacaaggagaccgagcagatggccgagaagaagagcaagaagaaggtggaggaggaggaggaggacggcgtgaacatggagaacttccaggagttcatcagacaggccagcgaggccgagctggaggaggtgctgaccttctacacccagaagaacaagagcgccagcgtgttcctgggcacccacagcaagatcagcaagaacaacaacaactacagcgacagcggcgccaagggcgaccaccccgagaccatcatggaggaggtgaagatcaagccccccaagcagcagcagaccaccgagatccacagcgacaagctgagcagattcaccaccagcgccgagaaggaggccaagctggtgtacagcaacagcagcagcggccccaccgccaccctgcagaagatccccaacacccacctgagcagcgtgaccaccagcgacctgagccccggcccctgccaccacagcagcctgagccagatccccagcgccatccccagcatgccccaccagcccaccatcctgctgaacaccgtgagcgccagcgccagcccctgcctgcaccccggcgcccagaacatccccagccccaccggcctgcccagatgcagaagcggcagccacaccatcggccccttcagcagcttccagagcgccgcccacatctacagccagaagctgagcagacccagcagcgccaaggccggcagctgctacctgaacaagcaccacagcggcatcgccaagacccagaaggagggcgaggacgccagcctgtacagcaagagatacaaccagagcatggtgaccgccgagctgcagagactggccgagaagcaggccgccagacagtacagccccagcagccacatcaacctgctgacccagcaggtgaccaacctgaacctggccaccggcatcatcaacagaagcagcgccagcgccccccccaccctgagacccatcatcagccccagcggccccacctggagcacccagagcgacccccaggcccccgagaaccacagcagcagccccggcagcagaagcctgcagaccggcggcttcgcctgggagggcgaggtggagaacaacgtgtacagccaggccaccggcgtggtgccccagcacaagtaccaccccaccgccggcagctaccagctgcagttcgccctgcagcagctggagcagcagaagctgcagagcagacagctgctggaccagagcagagccagacaccaggccatcttcggcagccagaccctgcccaacagcaacctgtggaccatgaacaacggcgccggctgcagaatcagcagcgccaccgccagcggccagaagcccaccaccctgccccagaaggtggtgcccccccccagcagctgcgccagcctggtgcccaagcccccccccaaccacgagcaggtgctgagaagagccaccagccagaaggccagcaagggcagcagcgccgagggccagctgaacggcctgcagagcagcctgaaccccgccgccttcgtgcccatcaccagcagcaccgaccccgcccacaccaagatctag

SEQ ID NO: 103910 - DNA, 2454 bp, Artificial Sequence
  Description of Artificial Sequence: Synthetic coding sequence
atgaaggagatcaaggtgctgagaagagtgaaggaggagaacgacagaagaggcggcttcatcagaatcttccccaccagcgagacctgggagatctacggcagctacctggagcacaagaccagcatgaactacatgctggccaccagactgttccaggacagaggcaaccccagaagaagcctgctgaccggcagaaccagaatgaccgccgacggcgcccccgagctgaagatcgagagcctgaacagcaaggccaagctgcacgccgccctgtacgagagaaagctgctgagcctggaggtgagaaagagaagaagaagaagcagcagactgagagccatgagacccaagtaccccgtgatcacccagcccgccgagatgaacgtgaagaccgagaccgagagcgaggaggaggaggaggtggccctggacaacgaggacgaggagcaggaggccagccaggaggagagcgccggcttcctgagagagaaccaggccaagtacacccccagcctgaccgccctggtggagaacacccccaaggagaacagcatgaaggtgagagagtggaacaacaagggcggccactgctgcaagctggagacccaggagctggagcccaagttcaacctgatgcagatcctgcaggacaacggcaacctgagcaagatgcaggccagaatcgccttcagcgcctacctgcagcacgtgcagatcagactgatgaaggacagcggcggccagaccttcagcgccagctgggccgccaaggaggacgagcagatggagctggtggtgagattcctgaagagagccagcaacaacctgcagcacagcctgagaatggtgctgcccagcagaagactggccctgctggagagaagaagaatcctggcccaccagctgggcgacttcatcatcgtgtacaacaaggagaccgagcagatggccgagaagaagagcaagaagaaggtggaggaggaggaggaggacggcgtgaacatggagaacttccaggagttcatcagacaggccagcgaggccgagctggaggaggtgctgaccttctacacccagaagaacaagagcgccagcgtgttcctgggcacccacagcaagatcagcaagaacaacaacaactacagcgacagcggcgccaagggcgaccaccccgagaccatcatggaggaggtgaagatcaagccccccaagcagcagcagaccaccgagatccacagcgacaagctgagcagattcaccaccagcgccgagaaggaggccaagctggtgtacagcaacagcagcagcggccccaccgccaccctgcagaagatccccaacacccacctgagcagcgtgaccaccagcgacctgagccccggcccctgccaccacagcagcctgagccagatccccagcgccatccccagcatgccccaccagcccaccatcctgctgaacaccgtgagcgccagcgccagcccctgcctgcaccccggcgcccagaacatccccagccccaccggcctgcccagatgcagaagcggcagccacaccatcggccccttcagcagcttccagagcgccgcccacatctacagccagaagctgagcagacccagcagcgccaaggccggcagctgctacctgaacaagcaccacagcggcatcgccaagacccagaaggagggcgaggacgccagcctgtacagcaagagatacaaccagagcatggtgaccgccgagctgcagagactggccgagaagcaggccgccagacagtacagccccagcagccacatcaacctgctgacccagcaggtgaccaacctgaacctggccaccggcatcatcaacagaagcagcgccagcgccccccccaccctgagacccatcatcagccccagcggccccacctggagcacccagagcgacccccaggcccccgagaaccacagcagcagccccggcagcagaagcctgcagaccggcggcttcgcctgggagggcgaggtggagaacaacgtgtacagccaggccaccggcgtggtgccccagcacaagtaccaccccaccgccggcagctaccagctgcagttcgccctgcagcagctggagcagcagaagctgcagagcagacagctgctggaccagagcagagccagacaccaggccatcttcggcagccagaccctgcccaacagcaacctgtggaccatgaacaacggcgccggctgcagaatcagcagcgccaccgccagcggccagaagcccaccaccctgccccagaaggtggtgcccccccccagcagctgcgccagcctggtgcccaagcccccccccaaccacgagcaggtgctgagaagagccaccagccagaaggccagcaacaccagattcagaagcagcttccagaactacctgtggtacttcttccaggccgtgagctag

SEQ ID NO: 103911 - DNA, 2337 bp, Artificial Sequence
  Description of Artificial Sequence: Synthetic coding sequence
atggcccacgtggaggacctgatcatcaagaccatcatcagcgccgagctggccatcgccaccgcctgcaagaccttcgtgccccacagaagcagctgcttcgagctgtacggcttcgacgtgctgatcgacagcaccctgaagccctggctgctggaggtgaacctgagccccagcctggcctgcgacgcccccctggacctgaagatcaaggccagcatgatcagcgacatgttcaccgtggtgggcttcgtgtgccaggaccccgcccagagagccagcaccagacccatctaccccaccttcgagagcagcagaagaaaccccttccagaagccccagagatgcagacccctgagcgccagcgacgccgagatgaagaacctggtgggcagcgccagagagaagggccccggcaagctgggcggcagcgtgctgggcctgagcatggaggagatcaaggtgctgagaagagtgaaggaggagaacgacagaagaggcggcttcatcagaatcttccccaccagcgagacctgggagatctacggcagctacctggagcacaagaccagcatgaactacatgctggccaccagactgttccaggacagaatgaccgccgacggcgcccccgagctgaagatcgagagcctgaacagcaaggccaagctgcacgccgccctgtacgagagaaagctgctgagcctggaggtgagaaagagaagaagaagaagcagcagactgagagccatgagacccaagtaccccgtgatcacccagcccgccgagatgaacgtgaagaccgagaccgagagcgaggaggaggaggaggtggccctggacaacgaggacgaggagcaggaggccagccaggaggagagcgccggcttcctgagagagaaccaggccaagtacacccccagcctgaccgccctggtggagaacacccccaaggagaacagcatgaaggtgagagagtggaacaacaagggcggccactgctgcaagctggagacccaggagctggagcccaagttcaacctgatgcagatcctgcaggacaacggcaacctgagcaagatgcaggccagaatcgccttcagcgcctacctgcagcacgtgcagatcagactgatgaaggacagcggcggccagaccttcagcgccagctgggccgccaaggaggacgagcagatggagctggtggtgagattcctgaagagagccagcaacaacctgcagcacagcctgagaatggtgctgcccagcagaagactggccctgctggagagaagaagaatcctggcccaccagctgggcgacttcatcatcgtgtacaacaaggagaccgagcagatggccgagaagaagagcaagaagaaggtggaggaggaggaggaggacggcgtgaacatggagaacttccaggagttcatcagacaggccagcgaggccgagctggaggaggtgctgaccttctacacccagaagaacaagagcgccagcgtgttcctgggcacccacagcaagatcagcaagaacaacaacaactacagcgacagcggcgccaagggcgaccaccccgagaccatcatggaggaggtgaagatcaagccccccaagcagcagcagaccaccgagatccacagcgacaagctgagcagattcaccaccagcgccgagaaggaggccaagctggtgtacagcaacagcagcagcggccccaccgccaccctgcagaagatccccaacacccacctgagcagcgtgaccaccagcgacctgagccccggcccctgccaccacagcagcctgagccagatccccagcgccatccccagcatgccccaccagcccaccatcctgctgaacaccgtgagcgccagcgccagcccctgcctgcaccccggcgcccagaacatccccagccccaccggcctgcccagatgcagaagcggcagccacaccatcggccccttcagcagcttccagagcgccgcccacatctacagccagaagctgagcagacccagcagcgccaaggccggcagctgctacctgaacaagcaccacagcggcatcgccaagacccagaaggagggcgaggacgccagcctgtacagcaagagatacaaccagagcatggtgaccgccgagctgcagagactggccgagaagcaggccgccagacagtacagccccagcagccacaccgacccctggaagtacgacagaagcatcagaatgtgcagccccctgaacatcctggagcccgagttcaagaagtacctgatgggcatctacagcccccacagcagcaagaagaagaagaagtag

SEQ ID NO: 103912 - DNA, 1755 bp, Artificial Sequence
  Description of Artificial Sequence: Synthetic coding sequence
atgagaatcggcacccccaccgccggccccggccccagcgccgtgatggagggctgcctgggcgtggccgagctgagaaagctgagcaccttcagcgcctacctggaggaccacagctacaacgtggagcagatctggagagacatcgaggacgtgatcatcaagaccctgatcagcgcccaccccatcatcagacacaactaccacacctgcttccccaaccacaccctgaacagcgcctgcttcgagatcctgggcttcgacatcctgctggaccacaagctgaagccctggctgctggaggtgaaccacagccccagcttcagcaccgacagcagactggacaaggaggtgaaggacggcctgctgtacgacaccctggtgctgatcaacctggagagctgcgacaagaagaaggtgctggaggaggagagacagagaggccagttcctgcagcagtgctgcagcagagagatgagaatcgaggaggccaagggcttcagagccgtgcagctgaagaagaccgagacctacgagaaggagaactgcggcggcttcagactgatctaccccagcctgaacagcgagaagtacgagaagttcttccaggacaacaacagcctgttccagaacaccgtggccagcagagccagagaggagtacgccagacagctgatccaggagctgagactgaagagagagaagaagcccttccagatgaagaagaaggtggagatgcagggcgagagcgccggcgagcaggtgagaaagaagggcatgagaggctggcagcagaagcagcagcagaaggacaaggccgccacccaggccagcaagcagtacatccagcccctgaccctggtgagctacacccccgacctgctgctgagcgtgagaggcgagagaaagaacgagaccgacagcagcctgaaccaggaggcccccaccgaggaggccagcagcgtgttccccaagctgaccagcgccaagcccttcagcagcctgcccgacctgagaaacatcaacctgagcagcagcaagctggagcccagcaagcccaacttcagcatcaaggaggccaagagcgccagcgccgtgaacgtgttcaccggcaccgtgcacctgaccagcgtggagaccacccccgagagcaccacccagctgagcatcagccccaagagcccccccaccctggccgtgaccgccagcagcgagtacagcggccccgagaccgacagagtggtgagcttcaagtgcaagaagcagcagacccccccccacctgacccagaagaagatgctgaagagcttcctgcccaccaagagcaagagcttctgggagagccccaacaccaactggaccctgctgaagagcgacatgaacaagccccacctgatcagcgagctgctgaccaagctgcagctgagcggcaagctgagcttcttccccgcccactacaaccccaagctgggcatgaacaacctgagccagaaccccagcctgcccggcgagtgccacagcagaagcgacagcagcggcgagaagagacagctggacgtgagcagcctgctgctgcagagcccccagagctacaacgtgaccctgagagacctgctggtgatcgccacccccgcccagctggaccccagaccctgcagaagccacgccagcgccatgagagacccctgcatgcaggaccaggaggcctacagccactgcctgatcagcggccagaagggctgcgagagaagctag

SEQ ID NO: 103913 - DNA, 2532 bp, Artificial Sequence
  Description of Artificial Sequence: Synthetic coding sequence
atgccccagtgccccaccctggagagccaggagggcgagaacagcgaggagaagggcgacagcagcaaggaggaccccaaggagaccgtggccctggccttcgtgagagagaaccccggcgcccagaacggcctgcagaacgcccagcagcagggcaagaagaagagaaagaagaagagactggtgatcaacctgagcagctgcagatacgagagcgtgagaagagccgcccagcagtacggcttcagagagggcggcgaggacgacgactggaccctgtactggaccgactacagcgtgagcctggagagagtgatggagatgaagagctaccagaagatcaaccacttccccggcatgagcgagatctgcagaaaggacctgctggccagaaacatgagcagaatgctgaagatgttccccaaggacttcagattcttccccagaacctggtgcctgcccgccgactggggcgacctgcagacctacagcagaagcagaaagaacaagacctacatctgcaagcccgacagcggctgccagggcaagggcatcttcatcaccagaaccgtgaaggagatcaagcccggcgaggacatgatctgccagctgtacatcagcaagcccttcatcatcgacggcttcaagttcgacctgagaatctacgtgctggtgaccagctgcgaccccctgagaatcttcgtgtacaacgagggcctggccagattcgccaccaccagctacagcagaccctgcaccgacaacctggacgacatctgcatgcacctgaccaactacagcatcaacaagcacagcagcaacttcagcagagacgcccacagcggcagcaagagaaagctgagcaccttcagcgcctacctggaggaccacagctacaacgtggagcagatctggagagacatcgaggacgtgatcatcaagaccctgatcagcgcccaccccatcatcagacacaactaccacacctgcttccccaaccacaccctgaacagcgcctgcttcgagatcctgggcttcgacatcctgctggaccacaagctgaagccctggctgctggaggtgaaccacagccccagcttcagcaccgacagcagactggacaaggaggtgaaggacggcctgctgtacgacaccctggtgctgatcaacctggagagctgcgacaagaagaaggtgctggaggaggagagacagagaggccagttcctgcagcagtgctgcagcagagagatgagaatcgaggaggccaagggcttcagagccgtgcagctgaagaagaccgagacctacgagaaggagaactgcggcggcttcagactgatctaccccagcctgaacagcgagaagtacgagaagttcttccaggacaacaacagcctgttccagaacaccgtggccagcagagccagagaggagtacgccagacagctgatccaggagctgagactgaagagagagaagaagcccttccagatgaagaagaaggtggagatgcagggcgagagcgccggcgagcaggtgagaaagaagggcatgagaggctggcagcagaagcagcagcagaaggacaaggccgccacccaggccagcaagcagtacatccagcccctgaccctggtgagctacacccccgacctgctgctgagcgtgagaggcgagagaaagaacgagaccgacagcagcctgaaccaggaggcccccaccgaggaggccagcagcgtgttccccaagctgaccagcgccaagcccttcagcagcctgcccgacctgagaaacatcaacctgagcagcagcaagctggagcccagcaagcccaacttcagcatcaaggaggccaagagcgccagcgccgtgaacgtgttcaccggcaccgtgcacctgaccagcgtggagaccacccccgagagcaccacccagctgagcatcagccccaagagcccccccaccctggccgtgaccgccagcagcgagtacagcggccccgagaccgacagagtggtgagcttcaagtgcaagaagcagcagacccccccccacctgacccagaagaagatgctgaagagcttcctgcccaccaagagcaagagcttctgggagagccccaacaccaactggaccctgctgaagagcgacatgaacaagccccacctgatcagcgagctgctgaccaagctgcagctgagcggcaagctgagcttcttccccgcccactacaaccccaagctgggcatgaacaacctgagccagaaccccagcctgcccggcgagtgccacagcagaagcgacagcagcggcgagaagagacagctggacgtgagcagcctgctgctgcagagcccccagagctacaacgtgaccctgagagacctgctggtgatcgccacccccgcccagctggaccccagaccctgcagaagccacgccagcgccatgagagacccctgcatgcaggaccaggaggcctacagccactgcctgatcagcggccagaagggctgcgagagaagctag

SEQ ID NO: 103914 - DNA, 558 bp, Artificial Sequence
  Description of Artificial Sequence: Synthetic coding sequence
cagcccatgggcgccctgctgctgcaccccagcagaagaggccccgccggcgtggtggccagctggaccagcagccccgccggcagagacggcggcgtgggcatcgccggcgcctggtacttccccagagccagcagccaggccagagagatgccccagtgccccaccctggagagccaggagggcgagaacagcgaggagaagggcgacagcagcaaggaggaccccaaggagaccgtggccctggccttcgtgagagagaaccccggcgcccagaacggcctgcagaacgcccagcagcagggcaagaagaagagaaagaagaagagaatgcccctgaagaacagcagaaagagaagattcccctgcttcaagaaggccctgatctgccccggcaacctggtgagactgcagtacgacagcaccatcctgacctaccaggaccccaccgccgcctgcgccttccagttcctgttcaacatcagcccctgcctggcccccttcagactgatcgacgagggcaagctggtgcacttcctgatccacagcttcccctag

SEQ ID NO: 103915 - DNA, 1710 bp, Artificial Sequence
  Description of Artificial Sequence: Synthetic coding sequence
atggagggctgcctgggcgtggccgagctgagaaagctgagcaccttcagcgcctacctggaggaccacagctacaacgtggagcagatctggagagacatcgaggacgtgatcatcaagaccctgatcagcgcccaccccatcatcagacacaactaccacacctgcttccccaaccacaccctgaacagcgcctgcttcgagatcctgggcttcgacatcctgctggaccacaagctgaagccctggctgctggaggtgaaccacagccccagcttcagcaccgacagcagactggacaaggaggtgaaggacggcctgctgtacgacaccctggtgctgatcaacctggagagctgcgacaagaagaaggtgctggaggaggagagacagagaggccagttcctgcagcagtgctgcagcagagagatgagaatcgaggaggccaagggcttcagagccgtgcagctgaagaagaccgagacctacgagaaggagaactgcggcggcttcagactgatctaccccagcctgaacagcgagaagtacgagaagttcttccaggacaacaacagcctgttccagaacaccgtggccagcagagccagagaggagtacgccagacagctgatccaggagctgagactgaagagagagaagaagcccttccagatgaagaagaaggtggagatgcagggcgagagcgccggcgagcaggtgagaaagaagggcatgagaggctggcagcagaagcagcagcagaaggacaaggccgccacccaggccagcaagcagtacatccagcccctgaccctggtgagctacacccccgacctgctgctgagcgtgagaggcgagagaaagaacgagaccgacagcagcctgaaccaggaggcccccaccgaggaggccagcagcgtgttccccaagctgaccagcgccaagcccttcagcagcctgcccgacctgagaaacatcaacctgagcagcagcaagctggagcccagcaagcccaacttcagcatcaaggaggccaagagcgccagcgccgtgaacgtgttcaccggcaccgtgcacctgaccagcgtggagaccacccccgagagcaccacccagctgagcatcagccccaagagcccccccaccctggccgtgaccgccagcagcgagtacagcggccccgagaccgacagagtggtgagcttcaagtgcaagaagcagcagacccccccccacctgacccagaagaagatgctgaagagcttcctgcccaccaagagcaagagcttctgggagagccccaacaccaactggaccctgctgaagagcgacatgaacaagccccacctgatcagcgagctgctgaccaagctgcagctgagcggcaagctgagcttcttccccgcccactacaaccccaagctgggcatgaacaacctgagccagaaccccagcctgcccggcgagtgccacagcagaagcgacagcagcggcgagaagagacagctggacgtgagcagcctgctgctgcagagcccccagagctacaacgtgaccctgagagacctgctggtgatcgccacccccgcccagctggaccccagaccctgcagaagccacgccagcgccatgagagacccctgcatgcaggaccaggaggcctacagccactgcctgatcagcggccagaagggctgcgagagaagctag

SEQ ID NO: 103916 - DNA, 2676 bp, Artificial Sequence
  Description of Artificial Sequence: Synthetic coding sequence
atgggcgccctgctgctgcaccccagcagaagaggccccgccggcgtggtggccagctggaccagcagccccgccggcagagacggcggcgtgggcatcgccggcgcctggtacttccccagagccagcagccaggccagagagatgccccagtgccccaccctggagagccaggagggcgagaacagcgaggagaagggcgacagcagcaaggaggaccccaaggagaccgtggccctggccttcgtgagagagaaccccggcgcccagaacggcctgcagaacgcccagcagcagggcaagaagaagagaaagaagaagagactggtgatcaacctgagcagctgcagatacgagagcgtgagaagagccgcccagcagtacggcttcagagagggcggcgaggacgacgactggaccctgtactggaccgactacagcgtgagcctggagagagtgatggagatgaagagctaccagaagatcaaccacttccccggcatgagcgagatctgcagaaaggacctgctggccagaaacatgagcagaatgctgaagatgttccccaaggacttcagattcttccccagaacctggtgcctgcccgccgactggggcgacctgcagacctacagcagaagcagaaagaacaagacctacatctgcaagcccgacagcggctgccagggcaagggcatcttcatcaccagaaccgtgaaggagatcaagcccggcgaggacatgatctgccagctgtacatcagcaagcccttcatcatcgacggcttcaagttcgacctgagaatctacgtgctggtgaccagctgcgaccccctgagaatcttcgtgtacaacgagggcctggccagattcgccaccaccagctacagcagaccctgcaccgacaacctggacgacatctgcatgcacctgaccaactacagcatcaacaagcacagcagcaacttcagcagagacgcccacagcggcagcaagagaaagctgagcaccttcagcgcctacctggaggaccacagctacaacgtggagcagatctggagagacatcgaggacgtgatcatcaagaccctgatcagcgcccaccccatcatcagacacaactaccacacctgcttccccaaccacaccctgaacagcgcctgcttcgagatcctgggcttcgacatcctgctggaccacaagctgaagccctggctgctggaggtgaaccacagccccagcttcagcaccgacagcagactggacaaggaggtgaaggacggcctgctgtacgacaccctggtgctgatcaacctggagagctgcgacaagaagaaggtgctggaggaggagagacagagaggccagttcctgcagcagtgctgcagcagagagatgagaatcgaggaggccaagggcttcagagccgtgcagctgaagaagaccgagacctacgagaaggagaactgcggcggcttcagactgatctaccccagcctgaacagcgagaagtacgagaagttcttccaggacaacaacagcctgttccagaacaccgtggccagcagagccagagaggagtacgccagacagctgatccaggagctgagactgaagagagagaagaagcccttccagatgaagaagaaggtggagatgcagggcgagagcgccggcgagcaggtgagaaagaagggcatgagaggctggcagcagaagcagcagcagaaggacaaggccgccacccaggccagcaagcagtacatccagcccctgaccctggtgagctacacccccgacctgctgctgagcgtgagaggcgagagaaagaacgagaccgacagcagcctgaaccaggaggcccccaccgaggaggccagcagcgtgttccccaagctgaccagcgccaagcccttcagcagcctgcccgacctgagaaacatcaacctgagcagcagcaagctggagcccagcaagcccaacttcagcatcaaggaggccaagagcgccagcgccgtgaacgtgttcaccggcaccgtgcacctgaccagcgtggagaccacccccgagagcaccacccagctgagcatcagccccaagagcccccccaccctggccgtgaccgccagcagcgagtacagcggccccgagaccgacagagtggtgagcttcaagtgcaagaagcagcagacccccccccacctgacccagaagaagatgctgaagagcttcctgcccaccaagagcaagagcttctgggagagccccaacaccaactggaccctgctgaagagcgacatgaacaagccccacctgatcagcgagctgctgaccaagctgcagctgagcggcaagctgagcttcttccccgcccactacaaccccaagctgggcatgaacaacctgagccagaaccccagcctgcccggcgagtgccacagcagaagcgacagcagcggcgagaagagacagctggacgtgagcagcctgctgctgcagagcccccagagctacaacgtgaccctgagagacctgctggtgatcgccacccccgcccagctggaccccagaccctgcagaagccacgccagcgccatgagagacccctgcatgcaggaccaggaggcctacagccactgcctgatcagcggccagaagggctgcgagagaagctag

SEQ ID NO: 103917 - DNA, 306 bp, Artificial Sequence
  Description of Artificial Sequence: Synthetic coding sequence
atgccccagtgccccaccctggagagccaggagggcgagaacagcgaggagaagggcgacagcagcaaggaggaccccaaggagaccgtggccctggccttcgtgagagagaaccccggcgcccagaacggcctgcagaacgcccagcagcagggcaagaagaagagaaagaagaagagactggtgatcaacctgagcagctgcagatacgagagcgtgagaagagccgcccagcagtacggcttcagagagggcggcgaggacgacgactggaccctgtactggaccgactacagcgtgagctag

SEQ ID NO: 103918 - DNA, 1356 bp, Artificial Sequence
  Description of Artificial Sequence: Synthetic coding sequence
atgagagagtgcatcagcatccacgtgggccaggccggcgtgcagatcggcaacgcctgctgggagctgtactgcctggagcacggcatccagcccgacggccagatgcccagcgacaagaccatcggcggcggcgacgacagcttcaacaccttcttcagcgagaccggcgccggcaagcacgtgcccagagccgtgttcgtggacctggagcccaccgtgatcgacgaggtgagaaccggcacctacagacagctgttccaccccgagcagctgatcaccggcaaggaggacgccgccaacaactacgccagaggccactacaccatcggcaaggagatcatcgacctggtgctggacagaatcagaaagctggccgaccagtgcaccggcctgcagggcttcctggtgttccacagcttcggcggcggcaccggcagcggcttcaccagcctgctgatggagagactgagcgtggactacggcaagaagagcaagctggagttcagcatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcggccagatcgtgagcagcatcaccgccagcctgagattcgacggcgccctgaacgtggacctgaccgagttccagaccaacctggtgccctaccccagaatccacttccccctggccacctacgcccccgtgatcagcgccgagaaggcctaccacgagcagctgagcgtggccgagatcaccaacgcctgcttcgagcccgccaaccagatggtgaagtgcgaccccagacacggcaagtacatggcctgctgcctgctgtacagaggcgacgtggtgcccaaggacgtgaacgccgccatcgccaccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacatggccgccctggagaaggactacgaggaggtgggcgtggacagcgtggagggcgagggcgaggaggagggcgaggagtactag

SEQ ID NO: 103919 - DNA, 1356 bp, Artificial Sequence; identical to SEQ ID NO: 103918
  Description of Artificial Sequence: Synthetic coding sequence

SEQ ID NO: 103920 - DNA, 1152 bp, Artificial Sequence
  Description of Artificial Sequence: Synthetic coding sequence
atgatcgacctggagcccaccgtggtggacgaggtgagagccggcacctacagacagctgttccaccccgagcagctgatcaccggcaaggaggacgccgccaacaactacgccagaggccactacaccgtgggcaaggagagcatcgacctggtgctggacagaatcagaaagctgaccgacgcctgcagcggcctgcagggcttcctgatcttccacagcttcggcggcggcaccggcagcggcttcaccagcctgctgatggagagactgagcctggactacggcaagaagagcaagctggagttcgccatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggtgacctacgcccccatcatcagcgccgagaaggcctaccacgagcagctgagcgtggccgagatcaccagcagctgcttcgagcccaacagccagatggtgaagtgcgaccccagacacggcaagtacatggcctgctgcatgctgtacagaggcgacgtggtgcccaaggacgtgaacgtggccatcgccgccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacctggccgccctggagaaggactacgaggaggtgggcaccgacagcttcgaggaggagaacgagggcgaggagttctag

SEQ ID NO: 103921 - DNA, 1350 bp, Artificial Sequence
  Description of Artificial Sequence: Synthetic coding sequence
atgagagagtgcatcagcgtgcacgtgggccaggccggcgtgcagatcggcaacgcctgctgggagctgttctgcctggagcacggcatccaggccgacggcaccttcgacgcccaggccagcaagatcaacgacgacgacagcttcaccaccttcttcagcgagaccggcaacggcaagcacgtgcccagagccgtgatgatcgacctggagcccaccgtggtggacgaggtgagagccggcacctacagacagctgttccaccccgagcagctgatcaccggcaaggaggacgccgccaacaactacgccagaggccactacaccgtgggcaaggagagcatcgacctggtgctggacagaatcagaaagctgaccgacgcctgcagcggcctgcagggcttcctgatcttccacagcttcggcggcggcaccggcagcggcttcaccagcctgctgatggagagactgagcctggactacggcaagaagagcaagctggagttcgccatctaccccgccccccaggtgagcaccgccgtggtggagccctacaacagcatcctgaccacccacaccaccctggagcacagcgactgcgccttcatggtggacaacgaggccatctacgacatctgcagaagaaacctggacatcgagagacccacctacaccaacctgaacagactgatcagccagatcgtgagcagcatcaccgccagcctgagattcgacggcgccctgaacgtggacctgaccgagttccagaccaacctggtgccctaccccagaatccacttccccctggtgacctacgcccccatcatcagcgccgagaaggcctaccacgagcagctgagcgtggccgagatcaccagcagctgcttcgagcccaacagccagatggtgaagtgcgaccccagacacggcaagtacatggcctgctgcatgctgtacagaggcgacgtggtgcccaaggacgtgaacgtggccatcgccgccatcaagaccaagagaaccatccagttcgtggactggtgccccaccggcttcaaggtgggcatcaactaccagccccccaccgtggtgcccggcggcgacctggccaaggtgcagagagccgtgtgcatgctgagcaacaccaccgccatcgccgaggcctgggccagactggaccacaagttcgacctgatgtacgccaagagagccttcgtgcactggtacgtgggcgagggcatggaggagggcgagttcagcgaggccagagaggacctggccgccctggagaaggactacgaggaggtgggcaccgacagcttcgaggaggagaacgagggcgaggagttctag

SEQ ID NO: 103922 - DNA, 912 bp, Artificial Sequence
  Description of Artificial Sequence: Synthetic coding sequence
atggccagaagaggccccggctggagacccctgctgctgctggtgctgctggccggcgccgcccagggcggcctgtacttcagaagaggccagacctgctacagacccctgagaggcgacggcctggcccccctgggcagaagcacctaccccagaccccacgagtacctgagccccgccgacctgcccaagagctgggactggagaaacgtggacggcgtgaactacgccagcatcaccagaaaccagcacatcccccagtactgcggcagctgctgggcccacgccagcaccagcgccatggccgacagaatcaacatcaagagaaagggcgcctggcccagcaccctgctgagcgtgcagaacgtgatcgactgcggcaacgccggcagctgcgagggcggcaacgacctgagcgtgtgggactacgcccaccagcacggcatccccgacgagacctgcaacaactaccaggccaaggaccaggagtgcgacaagttcaaccagtgcggcacctgcaacgagttcaaggagtgccacgccatcagaaactacaccctgtggagagtgggcgactacggcagcctgagcggcagagagaagatgatggccgagatctacgccaacggccccatcagctgcggcatcatggccaccgagagactggccaactacaccggcggcatctacgccgagtaccaggacaccacctacatcaaccacgtggtgagcgtggccggctggggcatcagcgacggcaccgagtactggatcgtgagaaacagctggggcgagccctggggcgagagaggctggctgagaatcgtgaccagcacctacaaggacggcaagggcgccagatacaacctggccatcgaggagcactgcaccttcggcgaccccatcgtgtag

SEQ ID NO: 103923 - DNA, 1338 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcagctaccacggcgacagcgacctgcagctggagagaatcaacgtgtactacaacgaggccaccggcaacaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggagagcgagagctgcgactgcctgcagggcttccagctgacccacagcctgggcggcggcaccggcagcggcatgggcaccctgctgatcagcaagatcagagaggagtaccccgacagaatcatgaacaccttcagcgtgatgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcagatgttcgacagcaagaacatgatggccgcctgcgaccccagacacggcagatacctgaccgtggccgccatcttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatgagcgccaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgacgagcagggcgagttcgaggaggaggagggcgaggacgaggcctag

SEQ ID NO: 103924 - DNA, 1353 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccagcggcaactacgtgggcgacagcgacctgcagctggagagaatcagcgtgtactacaacgaggccagcagccacaagtacgtgcccagagccatcctggtggacctggagcccggcaccatggacagcgtgagaagcggcgccttcggccacctgttcagacccgacaacttcatcttcggccagagcggcgccggcaacaactgggccaagggccactacaccgagggcgccgagctggtggacagcgtgctggacgtggtgagaaaggagtgcgagaactgcgactgcctgcagggcttccagctgacccacagcctgggcggcggcaccggcagcggcatgggcaccctgctgatcagcaaggtgagagaggagtaccccgacagaatcatgaacaccttcagcgtggtgcccagccccaaggtgagcgacaccgtggtggagccctacaacgccaccctgagcatccaccagctggtggagaacaccgacgagacctactgcatcgacaacgaggccctgtacgacatctgcttcagaaccctgaagctggccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccgccagaggcagccagcagtacagagccctgaccgtgcccgagctgacccagcagatgttcgacgccaagaacatgatggccgcctgcgaccccagacacggcagatacctgaccgtggccaccgtgttcagaggcagaatgagcatgaaggaggtggacgagcagatgctggccatccagagcaagaacagcagctacttcgtggagtggatccccaacaacgtgaaggtggccgtgtgcgacatcccccccagaggcctgaagatgagcagcaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagatgtacgaggacgacgaggaggagagcgaggcccagggccccaagtag

SEQ ID NO: 103925 - DNA, 1137 bp, Artificial Sequence
  Description of Artificial Sequence: Synthetic coding sequence
atggacagcgtgagaagcggcgccttcggccacctgttcagacccgacaacttcatcttcggccagagcggcgccggcaacaactgggccaagggccactacaccgagggcgccgagctggtggacagcgtgctggacgtggtgagaaaggagtgcgagaactgcgactgcctgcagggcttccagctgacccacagcctgggcggcggcaccggcagcggcatgggcaccctgctgatcagcaaggtgagagaggagtaccccgacagaatcatgaacaccttcagcgtggtgcccagccccaaggtgagcgacaccgtggtggagccctacaacgccaccctgagcatccaccagctggtggagaacaccgacgagacctactgcatcgacaacgaggccctgtacgacatctgcttcagaaccctgaagctggccacccccacctacggcgacctgaaccacctggtgagcgccaccatgagcggcgtgaccaccagcctgagattccccggccagctgaacgccgacctgagaaagctggccgtgaacatggtgcccttccccagactgcacttcttcatgcccggcttcgcccccctgaccgccagaggcagccagcagtacagagccctgaccgtgcccgagctgacccagcagatgttcgacgccaagaacatgatggccgcctgcgaccccagacacggcagatacctgaccgtggccaccgtgttcagaggcagaatgagcatgaaggaggtggacgagcagatgctggccatccagagcaagaacagcagctacttcgtggagtggatccccaacaacgtgaaggtggccgtgtgcgacatcccccccagaggcctgaagatgagcagcaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggagggcgagatgtacgaggacgacgaggaggagagcgaggcccagggccccaagtag

SEQ ID NO: 103926 - DNA, 1335 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggaggcctag

SEQ ID NO: 103927 - DNA, 1119 bp, Artificial Sequence
  Description of Artificial Sequence: Synthetic coding sequence
atggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggaggcctag

SEQ ID NO: 103928 - DNA, 1335 bp, Artificial Sequence; identical to SEQ ID NO: 103926
  Description of Artificial Sequence: Synthetic coding sequence

SEQ ID NO: 103929 - DNA, 1119 bp, Artificial Sequence; identical to SEQ ID NO: 103927
  Description of Artificial Sequence: Synthetic coding sequence

SEQ ID NO: 103930 - DNA, 1281 bp, Artificial Sequence
  Description of Artificial Sequence: Synthetic coding sequence
atgttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggaggcctag

SEQ ID NO: 103931 - DNA, 1119 bp, Artificial Sequence; identical to SEQ ID NO: 103927
  Description of Artificial Sequence: Synthetic coding sequence

SEQ ID NO: 103932 - DNA, 1119 bp, Artificial Sequence; identical to SEQ ID NO: 103927
  Description of Artificial Sequence: Synthetic coding sequence

SEQ ID NO: 103933 - DNA, 1281 bp, Artificial Sequence; identical to SEQ ID NO: 103930
  Description of Artificial Sequence: Synthetic coding sequence

SEQ ID NO: 103934 - DNA, 1281 bp, Artificial Sequence; identical to SEQ ID NO: 103930
  Description of Artificial Sequence: Synthetic coding sequence

SEQ ID NO: 103935 - DNA, 1119 bp, Artificial Sequence; identical to SEQ ID NO: 103927
  Description of Artificial Sequence: Synthetic coding sequence

SEQ ID NO: 103936 - DNA, 1281 bp, Artificial Sequence; identical to SEQ ID NO: 103930
  Description of Artificial Sequence: Synthetic coding sequence

SEQ ID NO: 103937 - DNA, 1335 bp, Artificial Sequence; identical to SEQ ID NO: 103926
  Description of Artificial Sequence: Synthetic coding sequence

SEQ ID NO: 103938 - DNA, 1281 bp, Artificial Sequence; identical to SEQ ID NO: 103930
  Description of Artificial Sequence: Synthetic coding sequence

SEQ ID NO: 103939 - DNA, 1119 bp, Artificial Sequence; identical to SEQ ID NO: 103927
  Description of Artificial Sequence: Synthetic coding sequence

SEQ ID NO: 103940 - DNA, 1335 bp, Artificial Sequence; identical to SEQ ID NO: 103926
  Description of Artificial Sequence: Synthetic coding sequence

SEQ ID NO: 103941 - DNA, 1335 bp, Artificial Sequence; identical to SEQ ID NO: 103926
  Description of Artificial Sequence: Synthetic coding sequence

SEQ ID NO: 103942 - DNA, 1335 bp, Artificial Sequence; identical to SEQ ID NO: 103926
  Description of Artificial Sequence: Synthetic coding sequence

SEQ ID NO: 103943 - DNA, 1062 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggaggcctag

SEQ ID NO: 103944 - DNA, 1281 bp, Artificial Sequence; identical to SEQ ID NO: 103930
  Description of Artificial Sequence: Synthetic coding sequence

SEQ ID NO: 103945 - DNA, 1119 bp, Artificial Sequence; identical to SEQ ID NO: 103927
  Description of Artificial Sequence: Synthetic coding sequence

SEQ ID NO: 103946 - DNA, 1281 bp, Artificial Sequence; identical to SEQ ID NO: 103930
  Description of Artificial Sequence: Synthetic coding sequence

SEQ ID NO: 103947 - DNA, 1281 bp, Artificial Sequence; identical to SEQ ID NO: 103930
  Description of Artificial Sequence: Synthetic coding sequence

SEQ ID NO: 103948 - DNA, 1119 bp, Artificial Sequence; identical to SEQ ID NO: 103927
  Description of Artificial Sequence: Synthetic coding sequence

SEQ ID NO: 103949 - DNA, 1335 bp, Artificial Sequence; identical to SEQ ID NO: 103926
  Description of Artificial Sequence: Synthetic coding sequence

SEQ ID NO: 103950 - DNA, 732 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggaggcctag

SEQ ID NO: 103951 - DNA, 1119 bp, Artificial Sequence; identical to SEQ ID NO: 103927
  Description of Artificial Sequence: Synthetic coding sequence

SEQ ID NO: 103952 - DNA, 1119 bp, Artificial Sequence; identical to SEQ ID NO: 103927
  Description of Artificial Sequence: Synthetic coding sequence

SEQ ID NO: 103953 - DNA, 1335 bp, Artificial Sequence; identical to SEQ ID NO: 103926
  Description of Artificial Sequence: Synthetic coding sequence

SEQ ID NO: 103954 - DNA, 1119 bp, Artificial Sequence; identical to SEQ ID NO: 103927
  Description of Artificial Sequence: Synthetic coding sequence

SEQ ID NO: 103955 - DNA, 1119 bp, Artificial Sequence; identical to SEQ ID NO: 103927
  Description of Artificial Sequence: Synthetic coding sequence

SEQ ID NO: 103956 - DNA, 1119 bp, Artificial Sequence; identical to SEQ ID NO: 103927
  Description of Artificial Sequence: Synthetic coding sequence

SEQ ID NO: 103957 - DNA, 1119 bp, Artificial Sequence; identical to SEQ ID NO: 103927
  Description of Artificial Sequence: Synthetic coding sequence

SEQ ID NO: 103958 - DNA, 1119 bp, Artificial Sequence; identical to SEQ ID NO: 103927
  Description of Artificial Sequence: Synthetic coding sequence

SEQ ID NO: 103959 - DNA, 1119 bp, Artificial Sequence; identical to SEQ ID NO: 103927
  Description of Artificial Sequence: Synthetic coding sequence

SEQ ID NO: 103960 - DNA, 624 bp, Artificial Sequence
  Description of Artificial Sequence: Synthetic coding sequence
atgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggccccagcagtgccaggacagcagactgtag

SEQ ID NO: 103961 - DNA, 1248 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggaggaggaggacttcggcgaggaggccgaggaggagtag

SEQ ID NO: 103962 - DNA, 1062 bp, Artificial Sequence; identical to SEQ ID NO: 103943
  Description of Artificial Sequence: Synthetic coding sequence

SEQ ID NO: 103963 - DNA, 1062 bp, Artificial Sequence; identical to SEQ ID NO: 103943
  Description of Artificial Sequence: Synthetic coding sequence

SEQ ID NO: 103964 - DNA, 1308 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgagggcggcggcctgtag

SEQ ID NO: 103965 - DNA, 1308 bp, Artificial Sequence; identical to SEQ ID NO: 103964
  Description of Artificial Sequence: Synthetic coding sequence

SEQ ID NO: 103966 - DNA, 1308 bp, Artificial Sequence; identical to SEQ ID NO: 103964
  Description of Artificial Sequence: Synthetic coding sequence

SEQ ID NO: 103967 - DNA, 1248 bp, Artificial Sequence; identical to SEQ ID NO: 103961
  Description of Artificial Sequence: Synthetic coding sequence

SEQ ID NO: 103968 - DNA, 1248 bp, Artificial Sequence; identical to SEQ ID NO: 103961
  Description of Artificial Sequence: Synthetic coding sequence

SEQ ID NO: 103969 - DNA, 1248 bp, Artificial Sequence; identical to SEQ ID NO: 103961
  Description of Artificial Sequence: Synthetic coding sequence

SEQ ID NO: 103970 - DNA, 1308 bp, Artificial Sequence; identical to SEQ ID NO: 103964
  Description of Artificial Sequence: Synthetic coding sequence

SEQ ID NO: 103971 - DNA, 1308 bp, Artificial Sequence; identical to SEQ ID NO: 103964
  Description of Artificial Sequence: Synthetic coding sequence

SEQ ID NO: 103972 - DNA, 1308 bp, Artificial Sequence; identical to SEQ ID NO: 103964
  Description of Artificial Sequence: Synthetic coding sequence

SEQ ID NO: 103973 - DNA, 1062 bp, Artificial Sequence; identical to SEQ ID NO: 103943
  Description of Artificial Sequence: Synthetic coding sequence

SEQ ID NO: 103974 - DNA, 1248 bp, Artificial Sequence; identical to SEQ ID NO: 103961
  Description of Artificial Sequence: Synthetic coding sequence

SEQ ID NO: 103975 - DNA, 1308 bp, Artificial Sequence
  Description of Artificial Sequence: Synthetic coding sequence
atgagagagatcgtgcacatccaggccggccagtgcggcaaccagatcggcgccaagttctgggaggtgatcagcgacgagcacggcatcgaccccaccggcacctaccacggcgacagcgacctgcagctggacagaatcagcgtgtactacaacgaggccaccggcggcaagtacgtgcccagagccatcctggtggacctggagcccggcaccatggacagcgtgagaagcggccccttcggccagatcttcagacccgacaacttcgtgttcggccagagcggcgccggcaacaactgggccaagggccactacaccgagggcgccgagctggtggacagcgtgctggacgtggtgagaaaggaggccgagagctgcgactgcctgcagggcttccagctgacccacagcctgggcggcggcaccggcagcggcatgggcaccctgctgatcagcaagatcagagaggagtaccccgacagaatcatgaacaccttcagcgtggtgcccagccccaaggtgagcgacaccgtggtggagccctacaacgccaccctgagcgtgcaccagctggtggagaacaccgacgagacctactgcatcgacaacgaggccctgtacgacatctgcttcagaaccctgaagctgaccacccccacctacggcgacctgaaccacctggtgagcgccaccatgagcggcgtgaccacctgcctgagattccccggccagctgaacgccgacctgagaaagctggccgtgaacatggtgcccttccccagactgcacttcttcatgcccggcttcgcccccctgaccagcagaggcagccagcagtacagagccctgaccgtgcccgagctgacccagcaggtgttcgacgccaagaacatgatggccgcctgcgaccccagacacggcagatacctgaccgtggccgccgtgttcagaggcagaatgagcatgaaggaggtggacgagcagatgctgaacgtgcagaacaagaacagcagctacttcgtggagtggatccccaacaacgtgaagaccgccgtgtgcgacatcccccccagaggcctgaagatggccgtgaccttcatcggcaacagcaccgccatccaggagctgttcaagagaatcagcgagcagttcaccgccatgttcagaagaaaggccttcctgcactggtacaccggcgagggcatggacgagatggagttcaccgaggccgagagcaacatgaacgacctggtgagcgagtaccagcagtaccaggacgccaccgccgaggagggcggcgtgtag

SEQ ID NO: 103976 - DNA, 1062 bp, Artificial Sequence; identical to SEQ ID NO: 103943
  Description of Artificial Sequence: Synthetic coding sequence

SEQ ID NO: 103977 - DNA, 1062 bp, Artificial Sequence; identical to SEQ ID NO: 103943
  Description of Artificial Sequence: Synthetic coding sequence

SEQ ID NO: 103978 - DNA, 1062 bp, Artificial Sequence; identical to SEQ ID NO: 103943
  Description of Artificial Sequence: Synthetic coding sequence

SEQ ID NO: 103979 - DNA, 1248 bp, Artificial Sequence; identical to SEQ ID NO: 103961
  Description of Artificial Sequence: Synthetic coding sequence

SEQ ID NO: 103980 - DNA, 1248 bp, Artificial Sequence; identical to SEQ ID NO: 103961
  Description of Artificial Sequence: Synthetic coding sequence

SEQ ID NO: 103981 - DNA, 1062 bp, Artificial Sequence; identical to SEQ ID NO: 103943
  Description of Artificial Sequence: Synthetic coding sequence

SEQ ID NO: 103982 - DNA, 1362 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcgtgcccatcgccagagccgtgctggtggacatggagcccaaggtgatcaaccagatgctgagcaaggccgcccagagcggccagtggaagtacggccagcacgcctgcttctgccagaagcagggcagcggcaacaactgggcctacggctacagcgtgcacggccccagacacgaggagagcatcatgaacatcatcagaaaggaggtggagaagtgcgacagcttcagcggcttcttcatcatcatgagcatggccggcggcaccggcagcggcctgggcgccttcgtgacccagaacctggaggaccagtacagcaacagcctgaagatgaaccagatcatctggccctacggcaccggcgaggtgatcgtgcagaactacaacagcatcctgaccctgagccacctgtacagaagcagcgacgccctgctgctgcacgagaacgacgccatccacaagatctgcgccaagctgatgaacatcaagcagatcagcttcagcgacatcaaccaggtgctggcccaccagctgggcagcgtgttccagcccacctacagcgccgagagcagcttccactacagaagaaaccccctgggcgacctgatggagcacctggtgccccaccccgagttcaagatgctgagcgtgagaaacatcccccacatgagcgagaacagcctggcctacaccaccttcacctgggccggcctgctgaagcacctgagacagatgctgatcagcaacgccaagatggaggagggcatcgacagacacgtgtggccccccctgagcggcctgccccccctgagcaagatgagcctgaacaaggacctgcacttcaacaccagcatcgccaacctggtgatcctgagaggcaaggacgtgcagagcgccgacgtggagggcttcaaggaccccgccctgtacaccagctggctgaagcccgtgaacgccttcaacgtgtggaagacccagagagccttcagcaagtacgagaagagcgccgtgctggtgagcaacagccagttcctggtgaagcccctggacatgatcgtgggcaaggcctggaacatgttcgccagcaaggcctacatccaccagtacaccaagttcggcatcgaggaggaggacttcctggacagcttcaccagcctggagcaggtggtggccagctactgcaacctgtag

SEQ ID NO: 103983 - DNA, 1197 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcgtgcccatcgccagagccgtgctggtggacatggagcccaaggtgatcaaccagatgctgagcaaggccgcccagagcggccagtggaagtacggccagcacgcctgcttctgccagaagcagggcagcggcaacaactgggcctacggctacagcgtgcacggccccagacacgaggagagcatcatgaacatcatcagaaaggaggtggagaagtgcgacagcttcagcggcttcttcatcatcatgagcatggccggcggcaccggcagcggcctgggcgccttcgtgacccagaacctggaggaccagtacagcaacagcctgaagatgaaccagatcatctggccctacggcaccggcgaggtgatcgtgcagaactacaacagcatcctgaccctgagccacctgtacagaagcagcgacgccctgctgctgcacgagaacgacgccatccacaagatctgcgccaagctgatgaacatcaagcagatcagcttcagcgacatcaaccaggtgctggcccaccagctgggcagcgtgttccagcccacctacagcgccgagagcagcttccactacagaagaaaccccctgggcatcgacagacacgtgtggccccccctgagcggcctgccccccctgagcaagatgagcctgaacaaggacctgcacttcaacaccagcatcgccaacctggtgatcctgagaggcaaggacgtgcagagcgccgacgtggagggcttcaaggaccccgccctgtacaccagctggctgaagcccgtgaacgccttcaacgtgtggaagacccagagagccttcagcaagtacgagaagagcgccgtgctggtgagcaacagccagttcctggtgaagcccctggacatgatcgtgggcaaggcctggaacatgttcgccagcaaggcctacatccaccagtacaccaagttcggcatcgaggaggaggacttcctggacagcttcaccagcctggagcaggtggtggccagctactgcaacctgtag

SEQ ID NO: 103984 - DNA, 600 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcggcatcgacagacacgtgtggccccccctgagcggcctgccccccctgagcaagatgagcctgaacaaggacctgcacttcaacaccagcatcgccaacctggtgatcctgagaggcaaggacgtgcagagcgccgacgtggagggcttcaaggaccccgccctgtacaccagctggctgaagcccgtgaacgccttcaacgtgtggaagacccagagagccttcagcaagtacgagaagagcgccgtgctggtgagcaacagccagttcctggtgaagcccctggacatgatcgtgggcaaggcctggaacatgttcgccagcaaggcctacatccaccagtacaccaagttcggcatcgaggaggaggacttcctggacagcttcaccagcctggagcaggtggtggccagctactgcaacctgtag

SEQ ID NO: 103985 - DNA, 1056 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcgtgcccatcgccagagccgtgctggtggacatggagcccaaggtgatcaaccagatgctgagcaaggccgcccagagcggccagtggaagtacggccagcacgcctgcttctgccagaagcagggcagcggcaacaactgggcctacggctacagcgtgcacggccccagacacgaggagagcatcatgaacatcatcagaaaggaggtggagaagtgcgacagcttcagcggcttcttcatcatcatgagcatggccggcggcaccggcagcggcctgggcgccttcgtgacccagaacctggaggaccagtacagcaacagcctgaagatgaaccagatcatctggccctacggcaccggcgaggtgatcgtgcagaactacaacagcatcctgaccctgagccacctgtacagaagcagcgacgccctgctgctgcacgagaacgacgccatccacaagatctgcgccaagctgatgaacatcaagcagatcagcttcagcgacatcaaccaggtgctggcccaccagctgggcagcgtgttccagcccacctacagcgccgagagcagcttccactacagaagaaaccccctggagggcttcaaggaccccgccctgtacaccagctggctgaagcccgtgaacgccttcaacgtgtggaagacccagagagccttcagcaagtacgagaagagcgccgtgctggtgagcaacagccagttcctggtgaagcccctggacatgatcgtgggcaaggcctggaacatgttcgccagcaaggcctacatccaccagtacaccaagttcggcatcgaggaggaggacttcctggacagcttcaccagcctggagcaggtggtggccagctactgcaacctgtag

SEQ ID NO: 103986 - DNA, 1191 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcgtgcccatcgccagagccgtgctggtggacatggagcccaaggtgatcaaccagatgctgagcaaggccgcccagagcggccagtggaagtacggccagcacgcctgcttctgccagaagcagggcagcggcaacaactgggcctacggctacagcgtgcacggccccagacacgaggagagcatcatgaacatcatcagaaaggaggtggagaagtgcgacagcttcagcggcttcttcatcatcatgagcatggccggcggcaccggcagcggcctgggcgccttcgtgacccagaacctggaggaccagtacagcaacagcctgaagatgaaccagatcatctggccctacggcaccggcgaggtgatcgtgcagaactacaacagcatcctgaccctgagccacctgtacagaagcagcgacgccctgctgctgcacgagaacgacgccatccacaagatctgcgccaagctgatgaacatcaagcagatcagcttcagcgacatcaaccaggtgctggcccaccagctgggcagcgtgttccagcccacctacagcgccgagagcagcttccactacagaagaaaccccctgggcgacctgatggagcacctggtgccccaccccgagttcaagatgctgagcgtgagaaacatcccccacatgagcgagaacagcctggcctacaccaccttcacctgggccggcctgctgaagcacctgagacagatgctgatcagcaacgccaagatggaggagggcatcgacagacacgtgtggccccccctgagcggcctgccccccctgagcaagatgagcctgaacaaggacctgcacttcaacaccagcatcgccaacctggtgatcctgagaggcaaggacgtgcagagcgccgacgtgggcaagaagttcagagcctacatccaccagtacaccaagttcggcatcgaggaggaggacttcctggacagcttcaccagcctggagcaggtggtggccagctactgcaacctgtag

SEQ ID NO: 103987 - DNA, 714 bp, Artificial Sequence
  Description of Artificial Sequence: Synthetic coding sequence
atgaacatcaagcagatcagcttcagcgacatcaaccaggtgctggcccaccagctgggcagcgtgttccagcccacctacagcgccgagagcagcttccactacagaagaaaccccctgggcgacctgatggagcacctggtgccccaccccgagttcaagatgctgagcgtgagaaacatcccccacatgagcgagaacagcctggcctacaccaccttcacctgggccggcctgctgaagcacctgagacagatgctgatcagcaacgccaagatggaggagggcatcgacagacacgtgtggccccccctgagcggcctgccccccctgagcaagatgagcctgaacaaggacctgcacttcaacaccagcatcgccaacctggtgatcctgagaggcaaggacgtgcagagcgccgacgtggagggcttcaaggaccccgccctgtacaccagctggctgaagcccgtgaacgccttcaacgtgtggaagacccagagagccttcagcaagtacgagaagagcgccgtgctggtgagcaacagccagttcctggtgaagcccctggacatgatcgtgggcaaggcctggaacatgttcgccagcaaggcctacatccaccagtacaccaagttcggcatcgaggaggaggacttcctggacagcttcaccagcctggagcaggtggtggccagctactgcaacctgtag

SEQ ID NO: 103988 - DNA, 378 bp, Artificial Sequence
  Description of Artificial Sequence: Synthetic coding sequence
atgagcatcgtgaccgtgcagctgggccagtgcggcaaccagatcggcttcgaggtgttcgacgccctgctgagcgacagccacagcagccagggcctgtgcagcatgagagagaacgaggcctaccaggccagctgcaaggagagattcttcagcgaggaggagaacggcgtgcccatcgccagagccgtgctggtggacatggagcccaaggtgatcaaccagatgctgagcaaggccgcccagagcggccagtggaagtacggccagcacgcctgcttctgccagaagcagggcagcggcaacaactgggcctacggcagagacaaggacagcgcctgctaccccgactggagcggcacccccggcctgcagtag

SEQ ID NO: 103989 - DNA, 492 bp, Artificial Sequence
  Description of Artificial Sequence: Synthetic coding sequence
atgacccagagcgtggtggtgcaggtgggccagtgcggcaaccagatcggctgctgcttctgggacctggccctgagagagcacgccgccgtgaaccagaagggcatctacgacgaggccatcagcagcttcttcagaaacgtggacaccagagtggtgggcgacggcggcagcatcagcaagggcaagatctgcagcctgaaggccagagccgtgctgatcgacatggaggagggcgtggtgaacgagatcctgcagggccccctgagagacgtgttcgacaccaagcagctgatcaccgacatcagcggcagcggcaacaactgggccgtgggccacaaggtgttcggcagcctgtaccaggaccagatcctggagaagttcagaaagagcgccgagcactgcgactgcctgcagtgcttcttcatcatccacagcatgggcggcggcaagatcttccacagcttcgcctgcaacagcgtgaagggctag

SEQ ID NO: 103990 - DNA, 621 bp, Artificial Sequence
  Description of Artificial Sequence: Synthetic coding sequence
atggagagcgaccagagaaaggtggtgggcgacggcggcagcatcagcaagggcaagatctgcagcctgaaggccagagccgtgctgatcgacatggaggagggcgtggtgaacgagatcctgcagggccccctgagagacgtgttcgacaccaagcagctgatcaccgacatcagcggcagcggcaacaactgggccgtgggccacaaggtgttcggcagcctgtaccaggaccagatcctggagaagttcagaaagagcgccgagcactgcgactgcctgcagtgcttcttcatcatccacagcatgggcggcggcaccggcagcggcctgggcaccttcctgctgaaggtgctggaggacgagttccccgaggtgtacagattcgtgaccagcatctaccccagcggcgaggacgacgtgatcaccagcccctacaacagcatcctggccatgaaggagctgaacgagcacgccgactgcgtgctgcccatcgacaaccagagcctgttcgacatcatcagcaagatcgacctgatggtgaacagcggcaagctgggcaccaccgtgaagcccaagagcctggtgaccagcagcagcggcgccctgaagaagcagtag

SEQ ID NO: 103991 - DNA, 1428 bp, Artificial Sequence
  Description of Artificial Sequence: Synthetic coding sequence
atgacccagagcgtggtggtgcaggtgggccagtgcggcaaccagatcggctgctgcttctgggacctggccctgagagagcacgccgccgtgaaccagaagggcatctacgacgaggccatcagcagcttcttcagaaacgtggacaccagagtggtgggcgacggcggcagcatcagcaagggcaagatctgcagcctgaaggccagagccgtgctgatcgacatggaggagggcgtggtgaacgagatcctgcagggccccctgagagacgtgttcgacaccaagcagctgatcaccgacatcagcggcagcggcaacaactgggccgtgggccacaaggtgttcggcagcctgtaccaggaccagatcctggagaagttcagaaagagcgccgagcactgcgactgcctgcagtgcttcttcatcatccacagcatgggcggcggcaccggcagcggcctgggcaccttcctgctgaaggtgctggaggacgagttccccgaggtgtacagattcgtgaccagcatctaccccagcggcgaggacgacgtgatcaccagcccctacaacagcatcctggccatgaaggagctgaacgagcacgccgactgcgtgctgcccatcgacaaccagagcctgttcgacatcatcagcaagatcgacctgatggtgaacagcggcaagctgggcaccaccgtgaagcccaagagcctggtgaccagcagcagcggcgccctgaagaagcagcacaagaagcccttcgacgccatgaacaacatcgtggccaacctgctgctgaacctgaccagcagcgccagattcgagggcagcctgaacatggacctgaacgagatcagcatgaacctggtgcccttcccccagctgcactacctggtgagcagcctgacccccctgtacaccctgaccgacgtgaacatcccccccagaagactggaccagatgttcagcgacgccttcagcaaggaccaccagctgctgagagccgaccccaagcacagcctgtacctggcctgcgccctgatggtgagaggcaacgtgcagatcagcgacctgagaagaaacatcgagagactgaagcccagcctgcagttcgtgagctggaaccaggagggctggaagaccagcctgtgcagcgtgccccccgtgggccacagccacagcctgctggccctggccaacaacacctgcgtgaagcccaccttcatggagctgaaggagagattcatgagactgtacaagaagaaggcccacctgcaccactacctgcaggtggagggcatggaggagagctgcttcaccgaggccgtgagcagcctgagcgccctgatccaggagtacgaccagctggacgccaccaagaacatgcccgtgcaggacctgcccagactgagcatcgccatgtag

SEQ ID NO: 103992 - DNA, 621 bp, Artificial Sequence; identical to SEQ ID NO: 103990
  Description of Artificial Sequence: Synthetic coding sequence

SEQ ID NO: 103993 - DNA, 1356 bp, Artificial Sequence
  Description of Artificial Sequence: Synthetic coding sequence
atgcccagagagatcatcaccctgcagctgggccagtgcggcaaccagatcggcttcgagttctggaagcagctgtgcgccgagcacggcatcagccccgagggcatcgtggaggagttcgccaccgagggcaccgacagaaaggacgtgttcttctaccaggccgacgacgagcactacatccccagagccgtgctgctggacctggagcccagagtgatccacagcatcctgaacagcccctacgccaagctgtacaaccccgagaacatctacctgagcgagcacggcggcggcgccggcaacaactgggccagcggcttcagccagggcgagaagatccacgaggacatcttcgacatcatcgacagagaggccgacggcagcgacagcctggagggcttcgtgctgtgccacagcatcgccggcggcaccggcagcggcctgggcagctacctgctggagagactgaacgacagataccccaagaagctggtgcagacctacagcgtgttccccaaccaggacgagatgagcgacgtggtggtgcagccctacaacagcctgctgaccctgaagagactgacccagaacgccgactgcgtggtggtgctggacaacaccgccctgaacagaatcgccaccgacagactgcacatccagaaccccagcttcagccagatcaaccagctggtgagcaccatcatgagcgccagcaccaccaccctgagataccccggctacatgaacaacgacctgatcggcctgatcgccagcctgatccccacccccagactgcacttcctgatgaccggctacacccccctgaccaccgaccagagcgtggccagcgtgagaaagaccaccgtgctggacgtgatgagaagactgctgcagcccaagaacgtgatggtgagcaccggcagagacagacagaccaaccactgctacatcgccatcctgaacatcatccagggcgaggtggaccccacccaggtgcacaagagcctgcagagaatcagagagagaaagctggccaacttcatcccctggggccccgccagcatccaggtggccctgagcagaaagagcccctacctgcccagcgcccacagagtgagcggcctgatgatggccaaccacaccagcatcagcagcctgttcgagagaacctgcagacagtacgacaagctgagaaagagagaggccttcctggagcagttcagaaaggaggacatgttcaaggacaacttcgacgagatggacaccagcagagagatcgtgcagcagctgatcgacgagtaccacgccgccaccagacccgactacatcagctggggcacccaggagcagtag

SEQ ID NO: 103994 - DNA, 1356 bp, Artificial Sequence
  Description of Artificial Sequence: Synthetic coding sequence
atgcccagagagatcatcaccctgcagctgggccagtgcggcaaccagatcggcttcgagttctggaagcagctgtgcgccgagcacggcatcagccccgagggcatcgtggaggagttcgccaccgagggcaccgacagaaaggacgtgttcttctaccaggccgacgacgagcactacatccccagagccgtgctgctggacctggagcccagagtgatccacagcatcctgaacagcccctacgccaagctgtacaaccccgagaacatctacctgagcgagcacggcggcggcgccggcaacaactgggccagcggcttcagccagggcgagaagatccacgaggacatcttcgacatcatcgacagagaggccgacggcagcgacagcctggagggcttcgtgctgtgccacagcatcgccggcggcaccggcagcggcctgggcagctacctgctggagagactgaacgacagataccccaagaagctggtgcagacctacagcgtgttcccctaccaggacgagatgagcgacgtggtggtgcagccctacaacagcctgctgaccctgaagagactgacccagaacgccgactgcgtggtggtgctggacaacaccgccctgaacagaatcgccaccgacagactgcacatccagaaccccagcttcagccagatcaaccagctggtgagcaccatcatgagcgccagcaccaccaccctgagataccccggctacatgaacaacgacctgatcggcctgatcgccagcctgatccccacccccagactgcacttcctgatgaccggctacacccccctgaccaccgaccagagcgtggccagcgtgagaaagaccaccgtgctggacgtgatgagaagactgctgcagcccaagaacgtgatggtgagcaccggcagagacagacagaccaaccactgctacatcgccatcctgaacatcatccagggcgaggtggaccccacccaggtgcacaagagcctgcagagaatcagagagagaaagctggccaacttcatcccctggggccccgccagcatccaggtggccctgagcagaaagagcccctacctgcccagcgcccacagagtgagcggcctgatgatggccaaccacaccagcatcagcagcctgttcgagagcagctgccagcagttcgacaagctgagaaagagagacgccttcctggagcagttcagaaaggaggacatgttcaaggacaacttcgacgagatggacagaagcagagaggtggtgcaggagctgatcgacgagtaccacgccgccacccagcccgactacatcagctggggcacccaggagcagtag

SEQ ID NO: 103995 - DNA, 2001 bp, Artificial Sequence; identical to SEQ ID NO: 103902
  Description of Artificial Sequence: Synthetic coding sequence

SEQ ID NO: 103996 - DNA, 1029 bp, Artificial Sequence
  Description of Artificial Sequence: Synthetic coding sequence
atggtggtggtggagcagatcaagagccagaagatccacggctgccagatcctggagaccgtgtacaagcacagctgcggcggcctgccccccgtgagaagcgccctggagaagatcctggccgtgtgccacggcgtgatgtacaagcagctgagcgcctggatgctgcacggcctgctgctggaccagcacgaggagttcttcatcaagcagggccccagcagcggcaacgtgagcgcccagcccgaggaggacgaggaggacctgggcatcggcggcctgaccggcaagcagctgagagagctgcaggacctgagactgatcgaggaggagaacatgctggcccccagcctgaagcagttcagcctgagagtggagatcctgcccagctacatccccgtgagagtggccgagaagatcctgttcgtgggcgagagcgtgcagatgttcgagaaccagaacgtgaacctgaccagaaagggcagcatcctgaagaaccaggaggacaccttcgccgccgagctgcacagactgaagcagcagcccctgttcagcctggtggacttcgagcaggtggtggacagaatcagaagcaccgtggccgagcacctgtggaagctgatggtggaggagagcgacctgctgggccagctgaagatcatcaaggacttctacctgctgggcagaggcgagctgttccaggccttcatcgacaccgcccagcacatgctgaagaccccccccaccgccgtgaccgagcacgacgtgaacgtggccttccagcagagcgcccacaaggtgctgctggacgacgacaacctgctgcccctgctgcacctgaccatcgagtaccacggcaaggagcacaaggccgacgccacccaggccagagagggccccagcagagagaccagccccagagaggcccccgccagcggctgggccgccctgggcctgagctacaaggtgcagtggcccctgcacatcctgttcacccccgccgtgctggagaagaacagacagttctag

SEQ ID NO: 103997 - DNA, 3075 bp, Artificial Sequence
  Description of Artificial Sequence: Synthetic coding sequence
atggccagacacggccccccctggagcagactggacgcccagcaggagagagacgtgagagagctggtgagaggcgtggccggcctgcaggacgaggccgaccccaacttccagctggccctgaacttcgcctggagcaacttcagattccacagattcctggacgtgaacagccacaagatcgagaagaccatcgagggcatctacgagaagttcgtgatccacagcgacctgagcaaggccgccagctggaagagactgaccgaggagttcctgaacgcccccctgcccagcatcaaggagatcaagaccgacgcccactacagcatcctgagcctgctgctgtgcctgagcgacagccccagcaacagcagctacgtggagacccccagaaacaaggaggtggagaagaaggacgacttcgactggggcaagtacctgatggaggacgaggagatggacatcggcccctacatggacacccccaactggagcgaggagagcgaggaggagaacgaccagcagcccctgagcagagaggacagcggcatccaggtggacagaacccccctggaggagcaggaccagaacagaaagctggacccctgcatcagctggaaggacgagcccgacgacagaagctggctggagcaccacgtggtgcaccagtactggaccgccagacccagccagttcccccacagcctgcacctgcacagcaacctggccgccgtgtgggaccagcacctgtacagcagcgaccccctgtacgtgcccgacgacagagtgctggtgaccgagacccaggtgatcagagagaccctgtggctgctgagcggcgtgaagaagctgttcatcttccagctgatcgacggcaaggtgaccgtgagaaacaacatcatcgtgacccacctgacccacagctgcctgagaagcgtgctggagcagatcgccgcctacggccaggtggtgttcagactgcaggagttcatcgacgaggtgatgggccacagcagcgagagcatgctgcccggcagcggcagcgtgcccaagaagagcaccgaggcccccttcagaacctaccaggccttcatgtgggccctgtacaagtacttcatcagcttcaaggaggagctggccgagatcgagaagtgcatcatcaacaacgacaccaccatcaccctggccatcgtggtggacaagctggcccccagactgagccagctgaaggtgctgcacaaggtgttcagcaccggcgtggccgaggtgccccccgacaccagaaacgtggtgagagccagccacctgctgaacaccctgtacaaggccatcctggagtacgacaacgtgggcgaggccagcgagcagaccgtgagcctgctgttcagcctgtgggtggagaccgtgagaccctacctgcagaccgtggacgagtggatcgtgcacggccacctgtgggacggcgccagagagttcatcatccagagaaacaagaacgtgcccgtgaaccacagagacttctggtacgccacctacaccctgtacagcgtgagcgagaagaccgagaacgaggagaagatgagcgacaacgccagcgccagcagcggcagcgaccagggccccagcagcagacagcacaccatggtgagcttcctgaagcccgtgctgaagcagatcatcatggccggcaagagcatgcagctgctgaagaacctgcagtgcgccgagagcaccacctgccaggccggcgccagagacgccgagagaaagagcctgtacaccctgttcctggagagcgtgcagagcagactgagacacggcgaggacagcaccccccaggtgctgaccgagcagcaggccaccaaggagaacctgatgaagatgcagagcatcgccgagagccacctggagctggacgacgtgcacgaccccctgctggccatcaacttcgccagaatgtacctggagcagagcgacttccacgagaagttcgccggcggcgacgtgtgcgtggacagaagcagcgagagcgtgacctgccagaccttcgagctgaccctgagaagctgcctgtacccccacatcgacaagcagtacctggactgctgcggcaacctgatgcagaccctgaagaaggactacagactggtggagtacctgcaggccatgagaaacttcttcctgatggagggcggcgacaccatgtacgacttctacaccagcatcttcgacaagatcagagagaaggagacctggcagaacgtgagcttcctgaacgtgcagctgcaggaggccgtgggccagagataccccgaggacagcagcagactgagcatcagcttcgagaacgtggacaccgccaagaagaagctgcccgtgcacatcctggacggcctgaccctgagctacaaggtgccctggcccgtggacatcgtgatcagcctggagtgccagaagatctacaaccaggtgttcctgctgctgctgcagatcaagtgggccaagtacagcctggacgtgctgctgttcggcgagctggtgagcaccgccgagaagcccagactgaaggagggcctgatccacgagcaggacaccgtggcccagttcggcccccagaaggagcccgtgagacagcagatccacagaatgttcctgctgagagtgaagctgatgcacttcgtgaacagcctgcacaactacatcatgaccagaatcctgcacagcaccggcctggagttccagcaccaggtggaggaggccaaggacctggaccagctgatcaagatccactacagatacctgagcaccatccacgacagatgcctgctgagagagaaggtgagcttcgtgaaggaggccatcatgaaggtgctgaacctggccctgatgttcgccgacggctggcaggccggcctgggcacctggagaatggagagcatcgagaagatggagagcgacttcaagaactgccacatgttcctggtgaccatcctgaacaaggccgtgtgcagaggcagcttcccccacctggagagcctggccctgagcctgatggccggcatggagcagagctag

SEQ ID NO: 103998 - DNA, 3075 bp, Artificial Sequence
  Description of Artificial Sequence: Synthetic coding sequence
atggccagacacggccccccctggagcagactggacgcccagcaggagagagacgtgagagagctggtgagaggcgtggccggcctgcaggacgaggccgaccccaacttccagctggccctgaacttcgcctggagcaacttcagattccacagattcctggacgtgaacagccacaagatcgagaagaccatcgagggcatctacgagaagttcgtgatccacagcgacctgagcaaggccgccagctggaagagactgaccgaggagttcctgaacgcccccctgcccagcatcaaggagatcaagaccgacgcccactacagcatcctgagcctgctgctgtgcctgagcgacagccccagcaacagcagctacgtggagacccccagaaacaaggaggtggagaagaaggacgacttcgactggggcaagtacctgatggaggacgaggagatggacatcggcccctacatggacacccccaactggagcgaggagagcgaggaggagaacgaccagcagcccctgagcagagaggacagcggcatccaggtggacagaacccccctggaggagcaggaccagaacagaaagctggacccctgcatcagctggaaggacgagcccgacgacagaagctggctggagcaccacgtggtgcaccagtactggaccgccagacccagccagttcccccacagcctgcacctgcacagcaacctggccgccgtgtgggaccagcacctgtacagcagcgaccccctgtacgtgcccgacgacagagtgctggtgaccgagacccaggtgatcagagagaccctgtggctgctgagcggcgtgaagaagctgttcatcttccagctgatcgacggcaaggtgaccgtgagaaacaacatcatcgtgacccacctgacccacagctgcctgagaagcgtgctggagcagatcgccgcctacggccaggtggtgttcagactgcaggagttcatcgacgaggtgatgggccacagcagcgagagcatgctgcccggcagcggcagcgtgcccaagaagagcaccgaggcccccttcagaacctaccaggccttcatgtgggccctgtacaagtacttcatcagcttcaaggaggagctggccgagatcgagaagtgcatcatcaacaacgacaccaccatcaccctggccatcgtggtggacaagctggcccccagactgagccagctgaaggtgctgcacaaggtgttcagcaccggcgtggccgaggtgccccccgacaccagaaacgtggtgagagccagccacctgctgaacaccctgtacaaggccatcctggagtacgacaacgtgggcgaggccagcgagcagaccgtgagcctgctgttcagcctgtgggtggagaccgtgagaccctacctgcagaccgtggacgagtggatcgtgcacggccacctgtgggacggcgccagagagttcatcatccagagaaacaagaacgtgcccgtgaaccacagagacttctggtacgccacctacaccctgtacagcgtgagcgagaagaccgagaacgaggagaagatgagcgacaacgccagcgccagcagcggcagcgaccagggccccagcagcagacagcacaccatggtgagcttcctgaagcccgtgctgaagcagatcatcatggccggcaagagcatgcagctgctgaagaacctgcagtgcgccgagagcaccacctgccaggccggcgccagagacgccgagagaaagagcctgtacaccctgttcctggagagcgtgcagagcagactgagacacggcgaggacagcaccccccaggtgctgaccgagcagcaggccaccaaggagaacctgatgaagatgcagagcatcgccgagagccacctggagctggacgacgtgcacgaccccctgctggccatcaacttcgccagaatgtacctggagcagagcgacttccacgagaagttcgccggcggcgacgtgtgcgtggacagaagcagcgagagcgtgacctgccagaccttcgagctgaccctgagaagctgcctgtacccccacatcgacaagcagtacctggactgctgcggcaacctgatgcagaccctgaagaaggactacagactggtggagtacctgcaggccatgagaaacttcttcctgatggagggcggcgacaccatgtacgacttctacaccagcatcttcgacaagatcagagagaaggagacctggcagaacgtgagcttcctgaacgtgcagctgcaggaggccgtgggccagagataccccgaggacagcagcagactgagcatcagcttcgagaacgtggacaccgccaagaagaagctgcccgtgcacatcctggacggcctgaccctgagctacaaggtgccctggcccgtggacatcgtgatcagcctggagtgccagaagatctacaaccaggtgttcctgctgctgctgcagatcaagtgggccaagtacagcctggacgtgctgctgttcggcgagctggtgagcaccgccgagaagcccagactgaaggagggcctgatccacgagcaggacaccgtggcccagttcggcccccagaaggagcccgtgagacagcagatccacagaatgttcctgctgagagtgaagctgatgcacttcgtgaacagcctgcacaactacatcatgaccagaatcctgcacagcaccggcctggagttccagcaccaggtggaggaggccaaggacctggaccagctgatcaagatccactacagatacctgagcaccatccacgacagatgcctgctgagagagaaggtgagcttcgtgaaggaggccatcatgaaggtgctgaacctggccctgatgttcgccgacggctggcaggccggcctgggcacctggagaatggagagcatcgagaagatggagagcgacttcaagaactgccacatgttcctggtgaccatcctgaacaaggccgtgtgcagaggcagcttcccccactgcgagtacatcatgctgaagtacttctacctgtgcatcagcctgtag

SEQ ID NO: 103999 - DNA, 1431 bp, Artificial Sequence
  Description of Artificial Sequence: Synthetic coding sequence
atgtggaccggctacaagatcctgatcttcagctacctgaccaccgagatctggatggagaagcagtacctgagccagagagaggtggacctggaggcctacttcaccagaaaccacaccgtgctgcagggcaccagattcaagagagccatcttccagggccagtactgcagaaacttcggctgctgcgaggacagagacgacggctgcgtgaccgagttctacgccgccaacgccctgtgctactgcgacaagttctgcgacagagagaacagcgactgctgccccgactacaagagcttctgcagagaggagaaggagtggcccccccacacccagccctggtaccccgagggctgcttcaaggacggccagcactacgaggagggcagcgtgatcaaggagaactgcaacagctgcacctgcagcggccagcagtggaagtgcagccagcacgtgtgcctggtgagaagcgagctgatcgagcaggtgaacaagggcgactacggctggaccgcccagaactacagccagttctggggcatgaccctggaggacggcttcaagttcagactgggcaccctgccccccagccccatgctgctgagcatgaacgagatgaccgccagcctgcccgccaccaccgacctgcccgagttcttcgtggccagctacaagtggcccggctggacccacggccccctggaccagaagaactgcgccgccagctgggccttcagcaccgccagcgtggccgccgacagaatcgccatccagagcaagggcagatacaccgccaacctgagcccccagaacctgatcagctgctgcgccaagaacagacacggctgcaacagcggcagcatcgacagagcctggtggtacctgagaaagagaggcctggtgagccacgcctgctaccccctgttcaaggaccagaacgccaccaacaacggctgcgccatggccagcagaagcgacggcagaggcaagagacacgccaccaagccctgccccaacaacgtggagaagagcaacagaatctaccagtgcagccccccctacagagtgagcagcaacgagaccgagatcatgaaggagatcatgcagaacggccccgtgcaggccatcatgcaggtgagagaggacttcttccactacaagaccggcatctacagacacgtgaccagcaccaacaaggagagcgagaagtacagaaagctgcagacccacgccgtgaagctgaccggctggggcaccctgagaggcgcccagggccagaaggagaagttctggatcgccgccaacagctggggcaagagctggggcgagaacggctacttcagaatcctgagaggcgtgaacgagagcgacatcgagaagctgatcatcgccgcctggggccagctgaccagcagcgacgagccctag

SEQ ID NO: 104000 - DNA, 1008 bp, Artificial Sequence
  Description of Artificial Sequence: Synthetic coding sequence
atgtggaccggctacaagatcctgatcttcagctacctgaccaccgagatctggatggagaagcagtacctgagccagagagaggtggacctggaggcctacttcaccagaaaccacaccgtgctgcagggcaccagattcaagagagccatcttccagggccagtactgcagaaacttcggctgctgcgaggacagagacgacggctgcgtgaccgagttctacgccgccaacgccctgtgctactgcgacaagttctgcgacagagagaacagcgactgctgccccgactacaagagcttctgcagagaggagaaggagtggcccccccacacccagccctggtaccccgagggcagatggaccgcccagaactacagccagttctggggcatgaccctggaggacggcttcaagttcagactgggcaccctgccccccagccccatgctgctgagcatgaacgagatgaccagactggtgagccacgcctgctaccccctgttcaaggaccagaacgccaccaacaacggctgcgccatggccagcagaagcgacggcagaggcaagagacacgccaccaagccctgccccaacaacgtggagaagagcaacagaatctaccagtgcagccccccctacagagtgagcagcaacgagaccgagatcatgaaggagatcatgcagaacggccccgtgcaggccatcatgcaggtgagagaggacttcttccactacaagaccggcatctacagacacgtgaccagcaccaacaaggagagcgagaagtacagaaagctgcagacccacgccgtgaagctgaccggctggggcaccctgagaggcgcccagggccagaaggagaagttctggatcgccgccaacagctggggcaagagctggggcgagaacggctacttcagaatcctgagaggcgtgaacgagagcgacatcgagaagctgatcatcgccgcctggggccagctgaccagcagcgacgagccctag

SEQ ID NO: 104001 - DNA, 612 bp, Artificial Sequence
  Description of Artificial Sequence: Synthetic coding sequence
atggagaagcagtacctgagccagagagaggtggacctggaggcctacttcaccagaaaccacaccgtgctgcagggcaccagattcaagagagccatcttccagggccagtactgcagaaacttcggctgctgcgaggacagagacgacggctgcgtgaccgagttctacgccgccaacgccctgtgctactgcgacaagttctgcgacagagagaacagcgactgctgccccgactacaagagcttctgcagagaggagaaggagtggcccccccacacccagccctggtaccccgagggctgcttcaaggacggccagcactacgaggagggcagcgtgatcaaggagaactgcaacagctgcacctgcagcggccagcagtggaagtgcagccagcacgtgtgcctggtgagaagcgagctgatcgagcaggtgaacaagggcgactacggctggaccgcccagaactacagccagttctggggcatgaccctggaggacggcttcaagttcagactgggcaccctgccccccagccccatgctgctgagcatgaacgagatgaccgtgagcgtgcccagcgacagcagaatgtgcatgtacctgtag

SEQ ID NO: 104002 - DNA, 468 bp, Artificial Sequence
  Description of Artificial Sequence: Synthetic coding sequence
atggccagcagaagcgacggcagaggcaagagacacgccaccaagccctgccccaacaacgtggagaagagcaacagaatctaccagtgcagccccccctacagagtgagcagcaacgagaccgagatcatgaaggagatcatgcagaacggccccgtgcaggccatcatgcaggtgagagaggacttcttccactacaagaccggcatctacagacacgtgaccagcaccaacaaggagagcgagaagtacagaaagctgcagacccacgccgtgaagctgaccggctggggcaccctgagaggcgcccagggccagaaggagaagttctggatcgccgccaacagctggggcaagagctggggcgagaacggctacttcagaatcctgagaggcgtgaacgagagcgacatcgagaagctgatcatcgccgcctggggccagctgaccagcagcgacgagccctag

SEQ ID NO: 104003 - DNA, 618 bp, Artificial Sequence
  Description of Artificial Sequence: Synthetic coding sequence
atgagagcctggatgttcgtgagcatgcaggccgagatctggatggagaagcagtacctgagccagagagaggtggacctggaggcctacttcaccagaaaccacaccgtgctgcagggcaccagattcaagagagccatcttccagggccagtactgcagaaacttcggctgctgcgaggacagagacgacggctgcgtgaccgagttctacgccgccaacgccctgtgctactgcgacaagttctgcgacagagagaacagcgactgctgccccgactacaagagcttctgcagagaggagaaggagtggcccccccacacccagccctggtaccccgagggctgcttcaaggacggccagcactacgaggagggcagcgtgatcaaggagaactgcaacagctgcacctgcagcggccagcagtggaagtgcagccagcacgtgtgcctggtgagaagcgagctgatcgagcaggtgaacaagggcgactacggctggaccgcccagaactacagccagttctggggcatgaccctggaggacggcttcaagttcagactgggcaccctgccccccagccccatgctgctgagcatgaacgagatgaccgagtag

SEQ ID NO: 104004 - DNA, 3570 bp, Artificial Sequence
  Description of Artificial Sequence: Synthetic coding sequence
atgagcgtgaagagccccttcaacgtgatgagcagaaacaacctggaggcccccccctgcaagatgaccgagcccttcaacttcgagaagaacgagaacaagctgcccccccacgagagcctgagaagccccggcaccctgcccaaccaccccaacttcagactgaagagcagcgagaacggcaacaagaagaacaacttcctgctgtgcgagcagaccaagcagtacctggccagccaggaggacaacagcgtgagcagcaaccccaacggcatcaacggcgaggtggtgggcagcaagggcgacagaaagaagctgcccgccggcaacagcgtgagcccccccagcgccgagagcaacagcccccccaaggaggtgaacatcaagcccggcaacaacgtgagacccgccaagagcaagaagctgaacaagctggtggagaacagcctgagcatcagcaaccccggcctgttcaccagcctgggcccccccctgagaagcaccacctgccacagatgcggcctgttcggcagcctgagatgcagccagtgcaagcagacctactactgcagcaccgcctgccagagaagagactggagcgcccacagcatcgtgtgcagacccgtgcagcccaacttccacaagctggagaacaagagcagcatcgagaccaaggacgtggaggtgaacaacaagagcgactgccccctgggcgtgaccaaggagatcgccatctgggccgagagaatcatgttcagcgacctgagaagcctgcagctgaagaagaccatggagatcaagggcaccgtgaccgagttcaagcaccccggcgacttctacgtgcagctgtacagcagcgaggtgctggagtacatgaaccagctgagcgccagcctgaaggagacctacgccaacgtgcacgagaaggactacatccccgtgaagggcgaggtgtgcatcgccaagtacaccgtggaccagacctggaacagagccatcatccagaacgtggacgtgcagcagaagaaggcccacgtgctgtacatcgactacggcaacgaggagatcatccccctgaacagaatctaccacctgaacagaaacatcgacctgttccccccctgcgccatcaagtgcttcgtggccaacgtgatccccgccgagggcaactggagcagcgactgcatcaaggccaccaagcccctgctgatggagcagtactgcagcatcaagatcgtggacatcctggaggaggaggtggtgaccttcgccgtggaggtggagctgcccaacagcggcaagctgctggaccacgtgctgatcgagatgggctacggcctgaagcccagcggccaggacagcaagaaggagaacgccgaccagagcgaccccgaggacgtgggcaagatgaccaccgagaacaacatcgtggtggacaagagcgacctgatccccaaggtgctgaccctgaacgtgggcgacgagttctgcggcgtggtggcccacatccagacccccgaggacttcttctgccagcagctgcagagcggcagaaagctggccgagctgcaggccagcctgagcaagtactgcgaccagctgccccccagaagcgacttctaccccgccatcggcgacatctgctgcgcccagttcagcgaggacgaccagtggtacagagccagcgtgctggcctacgccagcgaggagagcgtgctggtgggctacgtggactacggcaacttcgagatcctgagcctgatgagactgtgccccatcatccccaagctgctggagctgcccatgcaggccatcaagtgcgtgctggccggcgtgaagcccagcctgggcatctggacccccgaggccatctgcctgatgaagaagctggtgcagaacaagatcatcaccgtgaaggtggtggacaagctggagaacagcagcctggtggagctgatcgacaagagcgagaccccccacgtgagcgtgagcaaggtgctgctggacgccggcttcgccgtgggcgagcagagcatggtgaccgacaagcccagcgacgtgaaggagaccagcgtgcccctgggcgtggagggcaaggtgaaccccctggagtggacctgggtggagctgggcgtggaccagaccgtggacgtggtggtgtgcgtgatctacagccccggcgagttctactgccacgtgctgaaggaggacgccctgaagaagctgaacgacctgaacaagagcctggccgagcactgccagcagaagctgcccaacggcttcaaggccgagatcggccagccctgctgcgccttcttcgccggcgacggcagctggtacagagccctggtgaaggagatcctgcccaacggccacgtgaaggtgcacttcgtggactacggcaacatcgaggaggtgaccgccgacgagctgagaatgatcagcagcaccttcctgaacctgcccttccagggcatcagatgccagctggccgacatccagagcagaaacaagcactggagcgaggaggccatcaccagattccagatgtgcgtggccggcatcaagctgcaggccagagtggtggaggtgaccgagaacggcatcggcgtggagctgaccgacctgagcacctgctaccccagaatcatcagcgacgtgctgatcgacgagcacctggtgctgaagagcgccagcccccacaaggacctgcccaacgacagactggtgaacaagcacgagctgcaggtgcacgtgcagggcctgcaggccaccagcagcgccgagcagtggaagaccatcgagctgcccgtggacaagaccatccaggccaacgtgctggagatcatcagccccaacctgttctacgccctgcccaagggcatgcccgagaaccaggagaagctgtgcatgctgaccgccgagctgctggagtactgcaacgcccccaagagcagacccccctacagacccagaatcggcgacgcctgctgcgccaagtacaccagcgacgacttctggtacagagccgtggtgctgggcaccagcgacaccgacgtggaggtgctgtacgccgactacggcaacatcgagaccctgcccctgtgcagagtgcagcccatcaccagcagccacctggccctgcccttccagatcatcagatgcagcctggagggcctgatggagctgaacggcagcagcagccagctgatcatcatgctgctgaagaacttcatgctgaaccagaacgtgatgctgagcgtgaagggcatcaccaagaacgtgcacaccgtgagcgtggagaagtgcagcgagaacggcaccgtggacgtggccgacaagctggtgaccttcggcctggccaagaacatcaccccccagagacagagcgccctgaacaccgagaagatgtacagaatgaactgctgctgcaccgagctgcagaagcaggtggagaagcacgagcacatcctgctgttcctgctgaacaacagcaccaaccagaacaagttcatcgagatgaagaagctgctgaagaagaccgccagcctgggcggcaagcccctgtag

SEQ ID NO: 104005 - DNA, 3315 bp, Artificial Sequence
  Description of Artificial Sequence: Synthetic coding sequence
atgagcgtgaagagccccttcaacgtgatgagcagaaacaacctggaggcccccccctgcaagatgaccgagcccttcaacttcgagaagaacgagaacaagctgcccccccacgagagcctgagaagccccggcaccctgcccaaccaccccaacttcagactgaagagcagcgagaacggcaacaagaagaacaacttcctgctgtgcgagcagaccaagcagtacctggccagccaggaggacaacagcgtgagcagcaaccccaacggcatcaacggcgaggtggtgggcagcaagggcgacagaaagaagctgcccgccggcaacagcgtgagcccccccagcgccgagagcaacagcccccccaaggaggtgaacatcaagcccggcaacaacgtgagacccgccaagagcaagaagctgaacaagctggtggagaacagcctgagcatcagcaaccccggcctgttcaccagcctgggcccccccctgagaagcaccacctgccacagatgcggcctgttcggcagcctgagatgcagccagtgcaagcagacctactactgcagcaccgcctgccagagaagagactggagcgcccacagcatcgtgtgcagacccgtgcagcccaacttccacaagctggagaacaagagcagcatcgagaccaaggacgtggaggtgaacaacaagagcgactgccccctgggcgtgaccaaggagatcgccatctgggccgagagaatcatgttcagcgacctgagaagcctgcagctgaagaagaccatggagatcaagggcaccgtgaccgagttcaagcaccccggcgacttctacgtgcagctgtacagcagcgaggtgctggagtacatgaaccagctgagcgccagcctgaaggagacctacgccaacgtgcacgagaaggactacatccccgtgaagggcgaggtgtgcatcgccaagtacaccgtggaccagacctggaacagagccatcatccagaacgtggacgtgcagcagaagaaggcccacgtgctgtacatcgactacggcaacgaggagatcatccccctgaacagaatctaccacctgaacagaaacatcgacctgttccccccctgcgccatcaagtgcttcgtggccaacgtgatccccgccgagggcaactggagcagcgactgcatcaaggccaccaagcccctgctgatggagcagtactgcagcatcaagatcgtggacatcctggaggaggaggtggtgaccttcgccgtggaggtggagctgcccaacagcggcaagctgctggaccacgtgctgatcgagatgggctacggcctgaagcccagcggccaggacagcaagaaggagaacgccgaccagagcgaccccgaggacgtgggcaagatgaccaccgagaacaacatcgtggtggacaagagcgacctgatccccaaggtgctgaccctgaacgtgggcgacgagttctgcggcgtggtggcccacatccagacccccgaggacttcttctgccagcagctgcagagcggcagaaagctggccgagctgcaggccagcctgagcaagtactgcgaccagctgccccccagaagcgacttctaccccgccatcggcgacatctgctgcgcccagttcagcgaggacgaccagtggtacagagccagcgtgctggcctacgccagcgaggagagcgtgctggtgggctacgtggactacggcaacttcgagatcctgagcctgatgagactgtgccccatcatccccaagctgctggagctgcccatgcaggccatcaagtgcgtgctggccggcgtgaagcccagcctgggcatctggacccccgaggccatctgcctgatgaagaagctggtgcagaacaagatcatcaccgtgaaggtggtggacaagctggagaacagcagcctggtggagctgatcgacaagagcgagaccccccacgtgagcgtgagcaaggtgctgctggacgccggcttcgccgtgggcgagcagagcatggtgaccgacaagcccagcgacgtgaaggagaccagcgtgcccctgggcgtggagggcaaggtgaaccccctggagtggacctgggtggagctgggcgtggaccagaccgtggacgtggtggtgtgcgtgatctacagccccggcgagttctactgccacgtgctgaaggaggacgccctgaagaagctgaacgacctgaacaagagcctggccgagcactgccagcagaagctgcccaacggcttcaaggccgagatcggccagccctgctgcgccttcttcgccggcgacggcagctggtacagagccctggtgaaggagatcctgcccaacggccacgtgaaggtgcacttcgtggactacggcaacatcgaggaggtgaccgccgacgagctgagaatgatcagcagcaccttcctgaacctgcccttccagggcatcagatgccagctggccgacatccagagcagaaacaagcactggagcgaggaggccatcaccagattccagatgtgcgtggccggcatcaagctgcaggccagagtggtggaggtgaccgagaacggcatcggcgtggagctgaccgacctgagcacctgctaccccagaatcatcagcgacgtgctgatcgacgagcacctggtgctgaagagcgccagcccccacaaggacctgcccaacgacagactggtgaacaagcacgagctgcaggtgcacgtgcagggcctgcaggccaccagcagcgccgagcagtggaagaccatcgagctgcccgtggacaagaccatccaggccaacgtgctggagatcatcagccccaacctgttctacgccctgcccaagggcatgcccgagaaccaggagaagctgtgcatgctgaccgccgagctgctggagtactgcaacgcccccaagagcagacccccctacagacccagaatcggcgacgcctgctgcgccaagtacaccagcgacgacttctggtacagagccgtggtgctgggcaccagcgacaccgacgtggaggtgctgtacgccgactacggcaacatcgagaccctgcccctgtgcagagtgcagcccatcaccagcagccacctggccctgcccttccagatcatcagatgcagcctggaggagaagatgtacagaatgaactgctgctgcaccgagctgcagaagcaggtggagaagcacgagcacatcctgctgttcctgctgaacaacagcaccaaccagaacaagttcatcgagatgaagaagctgctgaagagctag

SEQ ID NO: 104006 - DNA, 3228 bp, Artificial Sequence
  Description of Artificial Sequence: Synthetic coding sequence
atgagcgtgaagagccccttcaacgtgatgagcagaaacaacctggaggcccccccctgcaagatgaccgagcccttcaacttcgagaagaacgagaacaagctgcccccccacgagagcctgagaagccccggcaccctgcccaaccaccccaacttcagactgaagagcagcgagaacggcaacaagaagaacaacttcctgctgtgcgagcagaccaagcagtacctggccagccaggaggacaacagcgtgagcagcaaccccaacggcatcaacggcgaggtggtgggcagcaagggcgacagaaagaagctgcccgccggcaacagcgtgagcccccccagcgccgagagcaacagcccccccaaggaggtgaacatcaagcccggcaacaacgtgagacccgccaagagcaagaagctgaacaagctggtggagaacagcctgagcatcagcaaccccggcctgttcaccagcctgggcccccccctgagaagcaccacctgccacagatgcggcctgttcggcagcctgagatgcagccagtgcaagcagacctactactgcagcaccgcctgccagagaagagactggagcgcccacagcatcgtgtgcagacccgtgcagcccaacttccacaagctggagaacaagagcagcatcgagaccaaggacgtggaggtgaacaacaagagcgactgccccctgggcgtgaccaaggagatcgccatctgggccgagagaatcatgttcagcgacctgagaagcctgcagctgaagaagaccatggagatcaagggcaccgtgaccgagttcaagcaccccggcgacttctacgtgcagctgtacagcagcgaggtgctggagtacatgaaccagctgagcgccagcctgaaggagacctacgccaacgtgcacgagaaggactacatccccgtgaagggcgaggtgtgcatcgccaagtacaccgtggaccagacctggaacagagccatcatccagaacgtggacgtgcagcagaagaaggcccacgtgctgtacatcgactacggcaacgaggagatcatccccctgaacagaatctaccacctgaacagaaacatcgacctgttccccccctgcgccatcaagtgcttcgtggccaacgtgatccccgccgagggcaactggagcagcgactgcatcaaggccaccaagcccctgctgatggagcagtactgcagcatcaagatcgtggacatcctggaggaggaggtggtgaccttcgccgtggaggtggagctgcccaacagcggcaagctgctggaccacgtgctgatcgagatgggctacggcctgaagcccagcggccaggacagcaagaaggagaacgccgaccagagcgaccccgaggacgtgggcaagatgaccaccgagaacaacatcgtggtggacaagagcgacctgatccccaaggtgctgaccctgaacgtgggcgacgagttctgcggcgtggtggcccacatccagacccccgaggacttcttctgccagcagctgcagagcggcagaaagctggccgagctgcaggccagcctgagcaagtactgcgaccagctgccccccagaagcgacttctaccccgccatcggcgacatctgctgcgcccagttcagcggcgtgaagcccagcctgggcatctggacccccgaggccatctgcctgatgaagaagctggtgcagaacaagatcatcaccgtgaaggtggtggacaagctggagaacagcagcctggtggagctgatcgacaagagcgagaccccccacgtgagcgtgagcaaggtgctgctggacgccggcttcgccgtgggcgagcagagcatggtgaccgacaagcccagcgacgtgaaggagaccagcgtgcccctgggcgtggagggcaaggtgaaccccctggagtggacctgggtggagctgggcgtggaccagaccgtggacgtggtggtgtgcgtgatctacagccccggcgagttctactgccacgtgctgaaggaggacgccctgaagaagctgaacgacctgaacaagagcctggccgagcactgccagcagaagctgcccaacggcttcaaggccgagatcggccagccctgctgcgccttcttcgccgacatccagagcagaaacaagcactggagcgaggaggccatcaccagattccagatgtgcgtggccggcatcaagctgcaggccagagtggtggaggtgaccgagaacggcatcggcgtggagctgaccgacctgagcacctgctaccccagaatcatcagcgacgtgctgatcgacgagcacctggtgctgaagagcgccagcccccacaaggacctgcccaacgacagactggtgaacaagcacgagctgcaggtgcacgtgcagggcctgcaggccaccagcagcgccgagcagtggaagaccatcgagctgcccgtggacaagaccatccaggccaacgtgctggagatcatcagccccaacctgttctacgccctgcccaagggcatgcccgagaaccaggagaagctgtgcatgctgaccgccgagctgctggagtactgcaacgcccccaagagcagacccccctacagacccagaatcggcgacgcctgctgcgccaagtacaccagcgacgacttctggtacagagccgtggtgctgggcaccagcgacaccgacgtggaggtgctgtacgccgactacggcaacatcgagaccctgcccctgtgcagagtgcagcccatcaccagcagccacctggccctgcccttccagatcatcagatgcagcctggagggcctgatggagctgaacggcagcagcagccagctgatcatcatgctgctgaagaacttcatgctgaaccagaacgtgatgctgagcgtgaagggcatcaccaagaacgtgcacaccgtgagcgtggagaagtgcagcgagaacggcaccgtggacgtggccgacaagctggtgaccttcggcctggccaagaacatcaccccccagagacagagcgccctgaacaccgagaagatgtacagaatgaactgctgctgcaccgagctgcagaagcaggtggagaagcacgagcacatcctgctgttcctgctgaacaacagcaccaaccagaacaagttcatcgagatgaagaagctgctgaagaagaccgccagcctgggcggcaagcccctgtag

SEQ ID NO: 104007 - DNA, 3342 bp, Artificial Sequence
  Description of Artificial Sequence: Synthetic coding sequence
atgagcgtgaagagccccttcaacgtgatgagcagaaacaacctggaggcccccccctgcaagatgaccgagcccttcaacttcgagaagaacgagaacaagctgcccccccacgagagcctgagaagccccggcaccctgcccaaccaccccaacttcagactgaagagcagcgagaacggcaacaagaagaacaacttcctgctgtgcgagcagaccaagcagtacctggccagccaggaggacaacagcgtgagcagcaaccccaacggcatcaacggcgaggtggtgggcagcaagggcgacagaaagaagctgcccgccggcaacagcgtgagcccccccagcgccgagagcaacagcccccccaaggaggtgaacatcaagcccggcaacaacgtgagacccgccaagagcaagaagctgaacaagctggtggagaacagcctgagcatcagcaaccccggcctgttcaccagcctgggcccccccctgagaagcaccacctgccacagatgcggcctgttcggcagcctgagatgcagccagtgcaagcagacctactactgcagcaccgcctgccagagaagagactggagcgcccacagcatcgtgtgcagacccgtgcagcccaacttccacaagctggagaacaagagcagcatcgagaccaaggacgtggaggtgaacaacaagagcgactgccccctgggcgtgaccaaggagatcgccatctgggccgagagaatcatgttcagcgacctgagaagcctgcagctgaagaagaccatggagatcaagggcaccgtgaccgagttcaagcaccccggcgacttctacgtgcagctgtacagcagcgaggtgctggagtacatgaaccagctgagcgccagcctgaaggagacctacgccaacgtgcacgagaaggactacatccccgtgaagggcgaggtgtgcatcgccaagtacaccgtggaccagacctggaacagagccatcatccagaacgtggacgtgcagcagaagaaggcccacgtgctgtacatcgactacggcaacgaggagatcatccccctgaacagaatctaccacctgaacagaaacatcgacctgttccccccctgcgccatcaagtgcttcgtggccaacgtgatccccgccgagggcaactggagcagcgactgcatcaaggccaccaagcccctgctgatggagcagtactgcagcatcaagatcgtggacatcctggaggaggaggtggtgaccttcgccgtggaggtggagctgcccaacagcggcaagctgctggaccacgtgctgatcgagatgggctacggcctgaagcccagcggccaggacagcaagaaggagaacgccgaccagagcgaccccgaggacgtgggcaagatgaccaccgagaacaacatcgtggtggacaagagcgacctgatccccaaggtgctgaccctgaacgtgggcgacgagttctgcggcgtggtggcccacatccagacccccgaggacttcttctgccagcagctgcagagcggcagaaagctggccgagctgcaggccagcctgagcaagtactgcgaccagctgccccccagaagcgacttctaccccgccatcggcgacatctgctgcgcccagttcagcgaggacgaccagtggtacagagccagcgtgctggcctacgccagcgaggagagcgtgctggtgggctacgtggactacggcaacttcgagatcctgagcctgatgagactgtgccccatcatccccaagctgctggagctgcccatgcaggccatcaagtgcgtgctggccggcgtgaagcccagcctgggcatctggacccccgaggccatctgcctgatgaagaagctggtgcagaacaagatcatcaccgtgaaggtggtggacaagctggagaacagcagcctggtggagctgatcgacaagagcgagaccccccacgtgagcgtgagcaaggtgctgctggacgccggcttcgccgtgggcgagcagagcatggtgaccgacaagcccagcgacgtgaaggagaccagcgtgcccctgggcgtggagggcaaggtgaaccccctggagtggacctgggtggagctgggcgtggaccagaccgtggacgtggtggtgtgcgtgatctacagccccggcgagttctactgccacgtgctgaaggaggacgccctgaagaagctgaacgacctgaacaagagcctggccgagcactgccagcagaagctgcccaacggcttcaaggccgagatcggccagccctgctgcgccttcttcgccggcgacggcagctggtacagagccctggtgaaggagatcctgcccaacggccacgtgaaggtgcacttcgtggactacggcaacatcgaggaggtgaccgccgacgagctgagaatgatcagcagcaccttcctgaacctgcccttccagggcatcagatgccagctggccgacatccagagcagaaacaagcactggagcgaggaggccatcaccagattccagatgtgcgtggccggcatcaagctgcaggccagagtggtggaggtgaccgagaacggcatcggcgtggagctgaccgacctgagcacctgctaccccagaatcatcagcgacgtgctgatcgacgagcacctggtgctgaagagcgccagcccccacaaggacctgcccaacgacagactggtgaacaagcacgagctgcaggtgcacgtgcagggcctgcaggccaccagcagcgccgagcagtggaagaccatcgagctgcccgtggacaagaccatccaggccaacgtgctggagatcatcagccccaacctgttctacgccctgcccaagggcatgcccgagaaccaggagaagctgtgcatgctgaccgccgagctgctggagtactgcaacgcccccaagagcagacccccctacagacccagaatcggcgacgcctgctgcgccaagtacaccagcgacgacttctggtacagagccgtggtgctgggcaccagcgacaccgacgtggaggtgctgtacgccgactacggcaacatcgagaccctgcccctgtgcagagtgcagcccatcaccagcagccacctggccctgcccttccagatcatcagatgcagcctggaggagaagatgtacagaatgaactgctgctgcaccgagctgcagaagcaggtggagaagcacgagcacatcctgctgttcctgctgaacaacagcaccaaccagaacaagttcatcgagatgaagaagctgctgaagaagaccgccagcctgggcggcaagcccctgtag

SEQ ID NO: 104008 - DNA, 2154 bp, Artificial Sequence
  Description of Artificial Sequence: Synthetic coding sequence
atgaaccagctgagcgccagcctgaaggagacctacgccaacgtgcacgagaaggactacatccccgtgaagggcgaggtgtgcatcgccaagtacaccgtggaccaggccatcaagtgcttcgtggccaacgtgatccccgccgagggcaactggagcagcgactgcatcaaggccaccaagcccctgctgatggagcagtactgcagcatcaagatcgtggacatcctggaggaggaggtggtgaccttcgccgtggaggtggagctgcccaacagcggcaagctgctggaccacgtgctgatcgagatgggctacggcctgaagcccagcggccaggacagcaagaaggagaacgccgaccagagcgaccccgaggacgtgggcaagatgaccaccgagaacaacatcgtggtggacaagagcgacctgatccccaaggtgctgaccctgaacgtgggcgacgagttctgcggcgtggtggcccacatccagacccccgaggacttcttctgccagcagctgcagagcggcagaaagctggccgagctgcaggccagcctgagcaagtactgcgaccagctgccccccagaagcgacttctaccccgccatcggcgacatctgctgcgcccagttcagcggcgtgaagcccagcctgggcatctggacccccgaggccatctgcctgatgaagaagctggtgcagaacaagatcatcaccgtgaaggtggtggacaagctggagaacagcagcctggtggagctgatcgacaagagcgagaccccccacgtgagcgtgagcaaggtgctgctggacgccggcttcgccgtgggcgagcagagcatggtgaccgacaagcccagcgacgtgaaggagaccagcgtgcccctgggcgtggagggcaaggtgaaccccctggagtggacctgggtggagctgggcgtggaccagaccgtggacgtggtggtgtgcgtgatctacagccccggcgagttctactgccacgtgctgaaggaggacgccctgaagaagctgaacgacctgaacaagagcctggccgagcactgccagcagaagctgcccaacggcttcaaggccgagatcggccagccctgctgcgccttcttcgccggcgacggcagctggtacagagccctggtgaaggagatcctgcccaacggccacgtgaaggtgcacttcgtggactacggcaacatcgaggaggtgaccgccgacgagctgagaatgatcagcagcaccttcctgaacctgcccttccagggcatcagatgccagctggccgacatccagagcagaaacaagcactggagcgaggaggccatcaccagattccagatgtgcgtggccggcatcaagctgcaggccagagtggtggaggtgaccgagaacggcatcggcgtggagctgaccgacctgagcacctgctaccccagaatcatcagcgacgtgctgatcgacgagcacctggtgctgaagagcgccagcccccacaaggacctgcccaacgacagactggtgaacaagcacgagctgcaggtgcacgtgcagggcctgcaggccaccagcagcgccgagcagtggaagaccatcgagctgcccgtggacaagaccatccaggccaacgtgctggagatcatcagccccaacctgttctacgccctgcccaagggcatgcccgagaaccaggagaagctgtgcatgctgaccgccgagctgctggagtactgcaacgcccccaagagcagacccccctacagacccagaatcggcgacgcctgctgcgccaagtacaccagcgacgacttctggtacagagccgtggtgctgggcaccagcgacaccgacgtggaggtgctgtacgccgactacggcaacatcgagaccctgcccctgtgcagagtgcagcccatcaccagcagccacctggccctgcccttccagatcatcagatgcagcctggaggagaagatgtacagaatgaactgctgctgcaccgagctgcagaagcaggtggagaagcacgagcacatcctgctgttcctgctgaacaacagcaccaaccagaacaagttcatcgagatgaagaagctgctgaagaagaccgccagcctgggcggcaagcccctgtag

SEQ ID NO: 104009 - DNA, 1956 bp, Artificial Sequence
  Description of Artificial Sequence: Synthetic coding sequence
atgctgagactgcagatgaccgacggccacatcagctgcaccgccgtggagttcagctacatgagcaagatcagcctgaacaccccccccggcaccaaggtgaagctgagcggcatcgtggacatcaagaacggcttcctgctgctgaacgacagcaacaccaccgtgctgggcggcgaggtggagcacctgatcgagaagtgggagctgcagagaagcctgagcaagcacaacagaagcaacatcggcaccgagggcggccccccccccttcgtgcccttcggccagaagtgcgtgagccacgtgcaggtggacagcagagagctggacagaagaaagaccctgcaggtgaccatgcccgtgaagcccaccaacgacaacgacgagttcgagaagcagagaaccgccgccatcgccgaggtggccaagagcaaggagaccaagaccttcggcggcggcggcggcggcgccagaagcaacctgaacatgaacgccgccggcaacagaaacagagaggtgctgcagaaggagaagagcaccaagagcgagggcaagcacgagggcgtgtacagagagctggtggacgagaaggccctgaagcacatcaccgagatgggcttcagcaaggaggccagcagacaggccctgatggacaacggcaacaacctggaggccgccctgaacgtgctgctgaccagcaacaagcagaagcccgtgatgggcccccccctgagaggcagaggcaagggcagaggcagaatcagaagcgaggacgaggaggacctgggcaacgccagacccagcgcccccagcaccctgttcgacttcctggagagcaagatgggcaccctgaacgtggaggagcccaagagccagccccagcagctgcaccagggccagtacagaagcagcaacaccgagcagaacggcgtgaaggacaacaaccacctgagacacccccccagaaacgacaccagacagcccagaaacgagaagccccccagattccagagagacagccagaacagcaagagcgtgctggagggcagcggcctgcccagaaacagaggcagcgagagacccagcaccagcagcgtgagcgaggtgtgggccgaggacagaatcaagtgcgacagaccctacagcagatacgacagaaccaaggacaccagctaccccctgggcagccagcacagcgacggcgccttcaagaagagagacaacagcatgcagagcagaagcggcaagggccccagcttcgccgaggccaaggagaaccccctgccccagggcagcgtggactacaacaaccagaagagaggcaagagagagagccagaccagcatccccgactacttctacgacagaaagagccagaccatcaacaacgaggccttcagcggcatcaagatcgagaagcacttcaacgtgaacaccgactaccagaaccccgtgagaagcaacagcttcatcggcgtgcccaacggcgaggtggagatgcccctgaagggcagaagaatcggccccatcaagcccgccggccccgtgaccgccgtgccctgcgacgacaagatcttctacaacagcggccccaagagaagaagcggccccatcaagcccgagaagatcctggagagcagcatccccatggagtacgccaagatgtggaagcccggcgacgagtgcttcgccctgtactgggaggacaacaagttctacagagccgaggtggaggccctgcacagcagcggcatgaccgccgtggtgaagttcatcgactacggcaactacgaggaggtgctgctgagcaacatcaagcccatccagaccgaggcctgggaggaggagggcacctacgaccagaccctggagttcagaagaggcggcgacggccagcccagaagaagcaccagacccacccagcagttctaccagccccccagagccagaaactag

SEQ ID NO: 104010 - DNA, 1956 bp, Artificial Sequence; identical to SEQ ID NO: 104009
  Description of Artificial Sequence: Synthetic coding sequence

SEQ ID NO: 104011 - DNA, 390 bp, Artificial Sequence
  Description of Artificial Sequence: Synthetic coding sequence
atgctgagactgcagatgaccgacggccacatcagctgcaccgccgtggagttcagctacatgagcaagatcagcctgaacaccccccccggcaccaaggtgaagctgagcggcatcgtggacatcaagaacggcttcctgctgctgaacgacagcaacaccaccgtgctgggcggcgaggtggagcacctgatcgagaagtgggagctgcagagaagcctgagcaagcacaacagaagcaacatcggcaccgagggcggccccccccccttcgtgcccttcggccagaagtgcgtgagccacgtgcaggtggacagcagagagctggacagaagaaagaccctgcaggtgaccatgcccgtgaagcccaccaacgacaacgacgagtag

SEQ ID NO: 104012 - DNA, 1956 bp, Artificial Sequence; identical to SEQ ID NO: 104009
  Description of Artificial Sequence: Synthetic coding sequence

SEQ ID NO: 104013 - DNA, 2235 bp, Artificial Sequence
  Description of Artificial Sequence: Synthetic coding sequence
atggcccaggtggccggcgccgccctgagccaggccggctggtacctgagcgacgagggcatcgaggcctgcaccagcagccccgacaaggtgaacgtgaacgacatcatcctgatcgccctgaacaccgacctgagaaccatcggcaagaagttcctgcccagcgacatcaacagcggcaaggtggagaagctggagggcccctgcgtgctgcagatccagaagatcagaaacgtggccgcccccaaggacaacgaggagagccaggccgcccccagaatgctgagactgcagatgaccgacggccacatcagctgcaccgccgtggagttcagctacatgagcaagatcagcctgaacaccccccccggcaccaaggtgaagctgagcggcatcgtggacatcaagaacggcttcctgctgctgaacgacagcaacaccaccgtgctgggcggcgaggtggagcacctgatcgagaagtgggagctgcagagaagcctgagcaagcacaacagaagcaacatcggcaccgagggcggccccccccccttcgtgcccttcggccagaagtgcgtgagccacgtgcaggtggacagcagagagctggacagaagaaagaccctgcaggtgaccatgcccgtgaagcccaccaacgacaacgacgagttcgagaagcagagaaccgccgccatcgccgaggtggccaagagcaaggagaccaagaccttcggcggcggcggcggcggcgccagaagcaacctgaacatgaacgccgccggcaacagaaacagagaggtgctgcagaaggagaagagcaccaagagcgagggcaagcacgagggcgtgtacagagagctggtggacgagaaggccctgaagcacatcaccgagatgggcttcagcaaggaggccagcagacaggccctgatggacaacggcaacaacctggaggccgccctgaacgtgctgctgaccagcaacaagcagaagcccgtgatgggcccccccctgagaggcagaggcaagggcagaggcagaatcagaagcgaggacgaggaggacctgggcaacgccagacccagcgcccccagcaccctgttcgacttcctggagagcaagatgggcaccctgaacgtggaggagcccaagagccagccccagcagctgcaccagggccagtacagaagcagcaacaccgagcagaacggcgtgaaggacaacaaccacctgagacacccccccagaaacgacaccagacagcccagaaacgagaagccccccagattccagagagacagccagaacagcaagagcgtgctggagggcagcggcctgcccagaaacagaggcagcgagagacccagcaccagcagcgtgagcgaggtgtgggccgaggacagaatcaagtgcgacagaccctacagcagatacgacagaaccaaggacaccagctaccccctgggcagccagcacagcgacggcgccttcaagaagagagacaacagcatgcagagcagaagcggcaagggccccagcttcgccgaggccaaggagaaccccctgccccagggcagcgtggactacaacaaccagaagagaggcaagagagagagccagaccagcatccccgactacttctacgacagaaagagccagaccatcaacaacgaggccttcagcggcatcaagatcgagaagcacttcaacgtgaacaccgactaccagaaccccgtgagaagcaacagcttcatcggcgtgcccaacggcgaggtggagatgcccctgaagggcagaagaatcggccccatcaagcccgccggccccgtgaccgccgtgccctgcgacgacaagatcttctacaacagcggccccaagagaagaagcggccccatcaagcccgagaagatcctggagagcagcatccccatggagtacgccaagatgtggaagcccggcgacgagtgcttcgccctgtactgggaggacaacaagttctacagagccgaggtggaggccctgcacagcagcggcatgaccgccgtggtgaagttcatcgactacggcaactacgaggaggtgctgctgagcaacatcaagcccatccagaccgaggcctgggaggaggagggcacctacgaccagaccctggagttcagaagaggcggcgacggccagcccagaagaagcaccagacccacccagcagttctaccagccccccagagccagaaactag

SEQ ID NO: 104014 - DNA, 3297 bp, Artificial Sequence
  Description of Artificial Sequence: Synthetic coding sequence
atgctggagggcgacctggtgagcaagatgctgagagccgtgctgcagagccacaagaacggcgtggccctgcccagactgcagggcgagtacagaagcctgaccggcgactggatccccttcaagcagctgggcttccccaccctggaggcctacctgagaagcgtgcccgccgtggtgagaatcgagaccagcagaagcggcgagatcacctgctacgccatggcctgcaccgagaccgccagaatcgcccagctggtggccagacagagaagcagcaagagaaagaccggcagacaggtgaactgccagatgagagtgaagaagaccatgcccttcttcctggagggcaagcccaaggccaccctgagacagcccggcttcgccagcaacttcagcgtgggcaagaagcccaaccccgcccccctgagagacaagggcaacagcgtgggcgtgaagcccgacgccgagatgagcccctacatgctgcacaccaccctgggcaacgaggccttcaaggacatccccgtgcagagacacgtgaccatgagcaccaacaacagattcagccccaaggccagcctgcagccccccctgcagatgcacctgagcagaaccagcaccaaggagatgagcgacaacctgaaccagaccgtggagaagcccaacgtgaagccccccgccagctacacctacaagatggacgaggtgcagaacagaatcaaggagatcctgaacaagcacaacaacggcatctggatcagcaagctgccccacttctacaaggagctgtacaaggaggacctgaaccagggcatcctgcagcagttcgagcactggccccacatctgcaccgtggagaagccctgcagcggcggccaggacctgctgctgtaccccgccaagagaaagcagctgctgagaagcgagctggacaccgagaaggtgcccctgagccccctgcccggccccaagcagaccccccccctgaagggctgccccaccgtgatggccggcgacttcaaggagaaggtggccgacctgctggtgaagtacaccagcggcctgtgggccagcgccctgcccaaggccttcgaggagatgtacaaggtgaagttccccgaggacgccctgaagaacctggccagcctgagcgacgtgtgcagcatcgactacatcagcggcaacccccagaaggccatcctgtacgccaagctgcccctgcccaccgacaagatccagaaggacgccggccaggcccacggcgacaacgacatcaaggccatggtggagcaggagtacctgcaggtggaggagagcatcgccgagagcgccaacaccttcatggaggacatcaccgtgccccccctgatgatccccaccgaggccagccccagcgtgctggtggtggagctgagcaacaccaacgaggtggtgatcagatacgtgggcaaggactacagcgccgcccaggagctgatggaggacgagatgaaggagtactacagcaagaaccccaagatcacccccgtgcaggccgtgaacgtgggccagctgctggccgtgaacgccgaggaggacgcctggctgagagcccaggtgatcagcaccgaggagaacaagatcaaggtgtgctacgtggactacggcttcagcgagaacgtggagaagagcaaggcctacaagctgaaccccaagttctgcagcctgagcttccaggccaccaagtgcaagctggccggcctggaggtgctgagcgacgaccccgacctggtgaaggtggtggagagcctgacctgcggcaagatcttcgccgtggagatcctggacaaggccgacatccccctggtggtgctgtacgacaccagcggcgaggacgacatcaacatcaacgccacctgcctgaaggccatctgcgacaagagcctggaggtgcacctgcaggtggacgccatgtacaccaacgtgaaggtgaccaacatctgcagcgacggcaccctgtactgccaggtgccctgcaagggcctgaacaagctgagcgacctgctgagaaagatcgaggactacttccactgcaagcacatgaccagcgagtgcttcgtgagcctgcccttctgcggcaagatctgcctgttccactgcaagggcaagtggctgagagtggagatcaccaacgtgcacagcagcagagccctggacgtgcagttcctggacagcggcaccgtgaccagcgtgaaggtgagcgagctgagagagatcccccccagattcctgcaggagatgatcgccatccccccccaggccatcaagtgctgcctggccgacctgccccagagcatcggcatgtggacccccgacgccgtgctgtggctgagagacagcgtgctgaactgcagcgactgcagcatcaaggtgaccaaggtggacgagaccagaggcatcgcccacgtgtacctgttcacccccaagaacttccccgacccccacagaagcatcaacagacagatcaccaacgccgacctgtggaagcaccagaaggacgtgttcctgagcgccatcagcagcggcgccgacagccccaacagcaagaacggcaacatgcccatgagcggcaacaccggcgagaacttcagaaagaacctgaccgacgtgatcaagaagagcatggtggaccacaccagcgccttcagcaccgaggagctgcccccccccgtgcacctgagcaagcccggcgagcacatggacgtgtacgtgcccgtggcctgccaccccggctacttcgtgatccagccctggcaggagatccacaagctggaggtgctgatggaggagatgatcctgtactacagcgtgagcgaggagagacacatcgccgtggagaaggaccaggtgtacgccgccaaggtggagaacaagtggcacagagtgctgctgaagggcatcctgaccaacggcctggtgagcgtgtacgagctggactacggcaagcacgagctggtgaacatcagaaaggtgcagcccctggtggacatgttcagaaagctgcccttccaggccgtgaccgcccagctggccggcgtgaagtgcaaccagtggagcgaggaggccagcatggtgttcagaaaccacgtggagaagaagcccctggtggccctggtgcagaccgtgatcgagaacgccaacccctgggacagaaaggtggtggtgtacctggtggacaccagcctgcccgacaccgacacctggatccacgacttcatgagcgagtacctgatcgagctgagcaaggtgaactag

SEQ ID NO: 104015 - DNA, 3075 bp, Artificial Sequence
  Description of Artificial Sequence: Synthetic coding sequence
atggcctgcaccgagaccgccagaatcgcccagctggtggccagacagagaagcagcaagagaaagaccggcagacaggtgaactgccagatgagagtgaagaagaccatgcccttcttcctggagggcaagcccaaggccaccctgagacagcccggcttcgccagcaacttcagcgtgggcaagaagcccaaccccgcccccctgagagacaagggcaacagcgtgggcgtgaagcccgacgccgagatgagcccctacatgctgcacaccaccctgggcaacgaggccttcaaggacatccccgtgcagagacacgtgaccatgagcaccaacaacagattcagccccaaggccagcctgcagccccccctgcagatgcacctgagcagaaccagcaccaaggagatgagcgacaacctgaaccagaccgtggagaagcccaacgtgaagccccccgccagctacacctacaagatggacgaggtgcagaacagaatcaaggagatcctgaacaagcacaacaacggcatctggatcagcaagctgccccacttctacaaggagctgtacaaggaggacctgaaccagggcatcctgcagcagttcgagcactggccccacatctgcaccgtggagaagccctgcagcggcggccaggacctgctgctgtaccccgccaagagaaagcagctgctgagaagcgagctggacaccgagaaggtgcccctgagccccctgcccggccccaagcagaccccccccctgaagggctgccccaccgtgatggccggcgacttcaaggagaaggtggccgacctgctggtgaagtacaccagcggcctgtgggccagcgccctgcccaaggccttcgaggagatgtacaaggtgaagttccccgaggacgccctgaagaacctggccagcctgagcgacgtgtgcagcatcgactacatcagcggcaacccccagaaggccatcctgtacgccaagctgcccctgcccaccgacaagatccagaaggacgccggccaggcccacggcgacaacgacatcaaggccatggtggagcaggagtacctgcaggtggaggagagcatcgccgagagcgccaacaccttcatggaggacatcaccgtgccccccctgatgatccccaccgaggccagccccagcgtgctggtggtggagctgagcaacaccaacgaggtggtgatcagatacgtgggcaaggactacagcgccgcccaggagctgatggaggacgagatgaaggagtactacagcaagaaccccaagatcacccccgtgcaggccgtgaacgtgggccagctgctggccgtgaacgccgaggaggacgcctggctgagagcccaggtgatcagcaccgaggagaacaagatcaaggtgtgctacgtggactacggcttcagcgagaacgtggagaagagcaaggcctacaagctgaaccccaagttctgcagcctgagcttccaggccaccaagtgcaagctggccggcctggaggtgctgagcgacgaccccgacctggtgaaggtggtggagagcctgacctgcggcaagatcttcgccgtggagatcctggacaaggccgacatccccctggtggtgctgtacgacaccagcggcgaggacgacatcaacatcaacgccacctgcctgaaggccatctgcgacaagagcctggaggtgcacctgcaggtggacgccatgtacaccaacgtgaaggtgaccaacatctgcagcgacggcaccctgtactgccaggtgccctgcaagggcctgaacaagctgagcgacctgctgagaaagatcgaggactacttccactgcaagcacatgaccagcgagtgcttcgtgagcctgcccttctgcggcaagatctgcctgttccactgcaagggcaagtggctgagagtggagatcaccaacgtgcacagcagcagagccctggacgtgcagttcctggacagcggcaccgtgaccagcgtgaaggtgagcgagctgagagagatcccccccagattcctgcaggagatgatcgccatccccccccaggccatcaagtgctgcctggccgacctgccccagagcatcggcatgtggacccccgacgccgtgctgtggctgagagacagcgtgctgaactgcagcgactgcagcatcaaggtgaccaaggtggacgagaccagaggcatcgcccacgtgtacctgttcacccccaagaacttccccgacccccacagaagcatcaacagacagatcaccaacgccgacctgtggaagcaccagaaggacgtgttcctgagcgccatcagcagcggcgccgacagccccaacagcaagaacggcaacatgcccatgagcggcaacaccggcgagaacttcagaaagaacctgaccgacgtgatcaagaagagcatggtggaccacaccagcgccttcagcaccgaggagctgcccccccccgtgcacctgagcaagcccggcgagcacatggacgtgtacgtgcccgtggcctgccaccccggctacttcgtgatccagccctggcaggagatccacaagctggaggtgctgatggaggagatgatcctgtactacagcgtgagcgaggagagacacatcgccgtggagaaggaccaggtgtacgccgccaaggtggagaacaagtggcacagagtgctgctgaagggcatcctgaccaacggcctggtgagcgtgtacgagctggactacggcaagcacgagctggtgaacatcagaaaggtgcagcccctggtggacatgttcagaaagctgcccttccaggccgtgaccgcccagctggccggcgtgaagtgcaaccagtggagcgaggaggccagcatggtgttcagaaaccacgtggagaagaagcccctggtggccctggtgcagaccgtgatcgagaacgccaacccctgggacagaaaggtggtggtgtacctggtggacaccagcctgcccgacaccgacacctggatccacgacttcatgagcgagtacctgatcgagctgagcaaggtgaactag

SEQ ID NO: 104016 - DNA, 1257 bp, Artificial Sequence
  Description of Artificial Sequence: Synthetic coding sequence
atgtacaccaacgtgaaggtgaccaacatctgcagcgacggcaccctgtactgccaggtgccctgcaagggcctgaacaagctgagcgacctgctgagaaagatcgaggactacttccactgcaagatcaccaacgtgcacagcagcagagccctggacgtgcagttcctggacagcggcaccgtgaccagcgtgaaggtgagcgagctgagagagatcccccccagattcctgcaggagatgatcgccatccccccccaggccatcaagtgctgcctggccgacctgccccagagcatcggcatgtggacccccgacgccgtgctgtggctgagagacagcgtgctgaactgcagcgactgcagcatcaaggtgaccaaggtggacgagaccagaggcatcgcccacgtgtacctgttcacccccaagaacttccccgacccccacagaagcatcaacagacagatcaccaacgccgacctgtggaagcaccagaaggacgtgttcctgagcgccatcagcagcggcgccgacagccccaacagcaagaacggcaacatgcccatgagcggcaacaccggcgagaacttcagaaagaacctgaccgacgtgatcaagaagagcatggtggaccacaccagcgccttcagcaccgaggagctgcccccccccgtgcacctgagcaagcccggcgagcacatggacgtgtacgtgcccgtggcctgccaccccggctacttcgtgatccagccctggcaggagatccacaagctggaggtgctgatggaggagatgatcctgtactacagcgtgagcgaggagagacacatcgccgtggagaaggaccaggtgtacgccgccaaggtggagaacaagtggcacagagtgctgctgaagggcatcctgaccaacggcctggtgagcgtgtacgagctggactacggcaagcacgagctggtgaacatcagaaaggtgcagcccctggtggacatgttcagaaagctgcccttccaggccgtgaccgcccagctggccggcgtgaagtgcaaccagtggagcgaggaggccagcatggtgttcagaaaccacgtggagaagaagcccctggtggccctggtgcagaccgtgatcgagaacgccaacccctgggacagaaaggtggtggtgtacctggtggacaccagcctgcccgacaccgacacctggatccacgacttcatgagcgagtacctgatcgagctgagcaaggtgaactag

SEQ ID NO: 104017 - DNA, 2514 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaaccccaacagacagagacactggcagaccaaggaggaggccacctacggcgtgtgggccgagagagacagcgacgacgagagacccagcttcggcggcaagagagccagagactacagcgcccccgtgaacttcatcagcgccggcctgaagaagggcgccgccgaggaggccgagctggaggacagcgacgacgaggagaagcccgtgaagcaggacgacttccccaaggacttcggccccagaaagctgaagaccggcggcaacttcaagcccagccagaagggcttcgccggcggcaccaagagcttcatggacttcggcagctgggagagacacaccaagggcatcggccagaagctgctgcagaagatgggctacgtgcccggcagaggcctgggcaagaacgcccagggcatcatcaaccccatcgaggccaagcagagaaagggcaagggcgccgtgggcgcctacggcagcgagagaaccacccagagcatgcaggacttccccgtggtggacagcgaggaggaggccgaggaggagttccagaaggagctgagccagtggagaaaggaccccagcggcagcaagaagaagcccaagtacagctacaagaccgtggaggagctgaaggccaagggcagaatcagcaagaagctgaccgccccccagaaggagctgagccaggtgaaggtgatcgacatgaccggcagagagcagaaggtgtactacagctacagccagatcagccacaagcacaacgtgcccgacgacggcctgcccctgcagagccagcagctgccccagagcggcaaggaggccaaggcccccggcttcgccctgcccgagctggagcacaacctgcagctgctgatcgacctgaccgagcaggagatcatccagaacgacagacagctgcagtacgagagagacatggtggtgaacctgttccacgagctggagaagatgaccgaggtgctggaccacgaggagagagtgatcagcaacctgagcaaggtgctggagatggtggaggagtgcgagagaagaatgcagcccgactgcagcaaccccctgaccctggacgagtgcgccagaatcttcgagaccctgcaggacaagtactacgaggagtacagaatgagcgacagagtggacctggccgtggccatcgtgtaccccctgatgaaggagtacttcaaggagtgggaccccctgaaggactgcacctacggcaccgagatcatcagcaagtggaagagcctgctggagaacgaccagctgctgagccacggcggccaggacctgagcgccgacgccttccacagactgatctgggaggtgtggatgcccttcgtgagaaacatcgtgacccagtggcagcccagaaactgcgaccccatggtggacttcctggacagctgggtgcacatcatccccgtgtggatcctggacaacatcctggaccagctgatcttccccaagctgcagaaggaggtggagaactggaaccccctgaccgacaccgtgcccatccacagctggatccacccctggctgcccctgatgcaggccagactggagcccctgtacagccccatcagaagcaagctgagcagcgccctgcagaagtggcaccccagcgacagcagcgccaagctgatcctgcagccctggaaggacgtgttcacccccggcagctgggaggccttcatggtgaagaacatcgtgcccaagctgggcatgtgcctgggcgagctggtgatcaacccccaccagcagcacatggacgccttctactgggtgatcgactgggagggcatgatcagcgtgagcagcctggtgggcctgctggagaagcacttcttccccaagtggctgcaggtgctgtgcagctggctgagcaacagccccaactacgaggagatcaccaagtggtacctgggctggaagagcatgttcagcgaccaggtgctggcccaccccagcgtgaaggacaagttcaacgaggccctggacatcatgaacagagccgtgagcagcaacgtgggcgcctacatgcagcccggcgccagagagaacatcgcctacctgacccacaccgagagaagaaaggacttccagtacgaggccatgcaggagagaagagaggccgagaacatggcccagagaggcatcggcgtggccgccagcagcgtgcccatgaacttcaaggacctgatcgagaccaaggccgaggagcacaacatcgtgttcatgcccgtgatcggcaagagacacgagggcaagcagctgtacaccttcggcagaatcgtgatctacatcgacagaggcgtggtgttcgtgcagggcgagaagacctgggtgcccaccagcctgcagagcctgatcgacatggccaagtag

SEQ ID NO: 104018 - DNA, 2514 bp, Artificial Sequence; identical to SEQ ID NO: 104017
  Description of Artificial Sequence: Synthetic coding sequence

SEQ ID NO: 104019 - DNA, 2514 bp, Artificial Sequence; identical to SEQ ID NO: 104017
  Description of Artificial Sequence: Synthetic coding sequence

SEQ ID NO: 104020 - DNA, 2514 bp, Artificial Sequence; identical to SEQ ID NO: 104017
  Description of Artificial Sequence: Synthetic coding sequence

SEQ ID NO: 104021 - DNA, 267 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaaccccaacagacagagacactggcagaccaaggaggaggccacctacggcgtgtgggccgagagagacagcgacgacgagagacccagcttcggcggcaagagagccagagactacagcgcccccgtgaacttcatcagcgccggcctgaagaagggctag

SEQ ID NO: 104022 - DNA, 261 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaaccccaacagacagagacactggcagaccaaggaggaggccacctacggcgtgtgggccgagagagacagcgacgacgagagacccagcttcggcggcaagagagccagagactacagcgcccccgtgaacttcatcagcgccggcctgaagtag

SEQ ID NO: 104023 - DNA, 129 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaaccccaacagacagagacactag

SEQ ID NO: 104024 - DNA, 1569 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaacctgttccacgagctggagaagatgaccgaggtgctggaccacgaggagagagtgatcagcaacctgagcaaggtgctggagatggtggaggagtgcgagagaagaatgcagcccgactgcagcaaccccctgaccctggacgagtgcgccagaatcttcgagaccctgcaggacaagtactacgaggagtacagaatgagcgacagagtggacctggccgtggccatcgtgtaccccctgatgaaggagtacttcaaggagtgggaccccctgaaggactgcacctacggcaccgagatcatcagcaagtggaagagcctgctggagaacgaccagctgctgagccacggcggccaggacctgagcgccgacgccttccacagactgatctgggaggtgtggatgcccttcgtgagaaacatcgtgacccagtggcagcccagaaactgcgaccccatggtggacttcctggacagctgggtgcacatcatccccgtgtggatcctggacaacatcctggaccagctgatcttccccaagctgcagaaggaggtggagaactggaaccccctgaccgacaccgtgcccatccacagctggatccacccctggctgcccctgatgcaggccagactggagcccctgtacagccccatcagaagcaagctgagcagcgccctgcagaagtggcaccccagcgacagcagcgccaagctgatcctgcagccctggaaggacgtgttcacccccggcagctgggaggccttcatggtgaagaacatcgtgcccaagctgggcatgtgcctgggcgagctggtgatcaacccccaccagcagcacatggacgccttctactgggtgatcgactgggagggcatgatcagcgtgagcagcctggtgggcctgctggagaagcacttcttccccaagtggctgcaggtgctgtgcagctggctgagcaacagccccaactacgaggagatcaccaagtggtacctgggctggaagagcatgttcagcgaccaggtgctggcccaccccagcgtgaaggacaagttcaacgaggccctggacatcatgaacagagccgtgagcagcaacgtgggcgcctacatgcagcccggcgccagagagaacatcgcctacctgacccacaccgagagaagaaaggacttccagtacgaggccatgcaggagagaagagaggccgagaacatggcccagagaggcatcggcgtggccgccagcagcgtgcccatgaacttcaaggacctgatcgagaccaaggccgaggagcacaacatcgtgttcatgcccgtgatcggcaagagacacgagggcaagcagctgtacaccttcggcagaatcgtgatctacatcgacagaggcgtggtgttcgtgcagggcgagaagacctgggtgcccaccagcctgcagagcctgatcgacatggccaagtag

SEQ ID NO: 104025 - DNA, 576 bp, Artificial Sequence
  Description of Artificial Sequence: Synthetic coding sequence
tgaggcagaggcctgggcaagaacgcccagggcatcatcaaccccatcgaggccaagcagagaaagggcaagggcgccgtgggcgcctacggcagcgagagaaccacccagagcatgcaggacttccccgtggtggacagcgaggaggaggccgaggagtggctgttcctggccgccagcgactgcatcctgctggtgcaggagttccagaaggagctgagccagtggagaaaggaccccagcggcagcaagaagaagcccaagtacagctacaagaccgtggaggagctgaaggccaagggcagaatcagcaagaagctgaccgccccccagaaggagctgagccaggtgaaggtgatcgacatgaccggcagagagcagaaggtgtactacagctacagccagatcagccacaagcacaacgtgcccgacgacggcctgcccctgcagagccagcagctgccccagagcggcaaggaggccaaggcccccggcttcgccctgcccgagctggagcacaacctgcagctgctgatcgacctgaccgagcaggagatcatccagaacgacagatag

SEQ ID NO: 104026 - DNA, 366 bp, Artificial Sequence
  Description of Artificial Sequence: Synthetic coding sequence
atgagcctgagccacctgtacagagacggcgagggcagaatcgacgacgacgacgacgagagagagaacttcgagatcaccgactgggacctgcagaacgagttcaaccccaacagacagagacactggcagaccaaggaggaggccacctacggcgtgtgggccgagagagacagcgacgacgagagacccagcttcggcggcaagagagccagagactacagcgcccccgtgaacttcatcagcgccggcctgaagaagggcgccgccgaggaggccgagctggaggacagcgacgacgaggagaagcccgtgaagcaggacgacttccccaaggacttcggccccagaaagctgaagacctag

SEQ ID NO: 104027 - DNA, 723 bp, Artificial Sequence
  Description of Artificial Sequence: Synthetic coding sequence
atggaggagagcgtggtgagacccagcgtgttcgtggtggacggccagaccgacatccccttcaccagactgggcagaagccacagaagacagagctgcagcgtggccagagtgggcctgggcctgctgctgctgctgatgggcgccggcctggccgtgcagggctggttcctgctgcagctgcactggagactgggcgagatggtgaccagactgcccgacggccccgccggcagctgggagcagctgatccaggagagaagaagccacgaggtgaaccccgccgcccacctgaccggcgccaacagcagcctgaccggcagcggcggccccctgctgtgggagacccagctgggcctggccttcctgagaggcctgagctaccacgacggcgccctggtggtgaccaaggccggctactactacatctacagcaaggtgcagctgggcggcgtgggctgccccctgggcctggccagcaccatcacccacggcctgtacaagagaacccccagataccccgaggagctggagctgctggtgagccagcagagcccctgcggcagagccaccagcagcagcagagtgtggtgggacagcagcttcctgggcggcgtggtgcacctggaggccggcgagaaggtggtggtgagagtgctggacgagagactggtgagactgagagacggcaccagaagctacttcggcgccttcatggtgtag

SEQ ID NO: 104028 - DNA, 954 bp, Artificial Sequence
  Description of Artificial Sequence: Synthetic coding sequence
atgagaagagccagcagagactacaccaagtacctgagaggcagcgaggagatgggcggcggccccggcgccccccacgagggccccctgcacgccccccccccccccgccccccaccagccccccgccgccagcagaagcatgttcgtggccctgctgggcctgggcctgggccaggtggtgtgcagcgtggccctgttcttctacttcagagcccagatggaccccaacagaatcagcgaggacggcacccactgcatctacagaatcctgagactgcacgagaacgccgacttccaggacaccaccctggagagccaggacaccaagctgatccccgacagctgcagaagaatcaagcaggccttccagggcgccgtgcagaaggagctgcagcacatcgtgggcagccagcacatcagagccgagaaggccatggtggacggcagctggctggacctggccaagagaagcaagctggaggcccagcccttcgcccacctgaccatcaacgccaccgacatccccagcggcagccacaaggtgagcctgagcagctggtaccacgacagaggctgggccaagatcagcaacatgaccttcagcaacggcaagctgatcgtgaaccaggacggcttctactacctgtacgccaacatctgcttcagacaccacgagaccagcggcgacctggccaccgagtacctgcagctgatggtgtacgtgaccaagaccagcatcaagatccccagcagccacaccctgatgaagggcggcagcaccaagtactggagcggcaacagcgagttccacttctacagcatcaacgtgggcggcttcttcaagctgagaagcggcgaggagatcagcatcgaggtgagcaaccccagcctgctggaccccgaccaggacgccacctacttcggcgccttcaaggtgagagacatcgactag

SEQ ID NO: 104029 - DNA, 735 bp, Artificial Sequence
  Description of Artificial Sequence: Synthetic coding sequence
atggaccccaacagaatcagcgaggacggcacccactgcatctacagaatcctgagactgcacgagaacgccgacttccaggacaccaccctggagagccaggacaccaagctgatccccgacagctgcagaagaatcaagcaggccttccagggcgccgtgcagaaggagctgcagcacatcgtgggcagccagcacatcagagccgagaaggccatggtggacggcagctggctggacctggccaagagaagcaagctggaggcccagcccttcgcccacctgaccatcaacgccaccgacatccccagcggcagccacaaggtgagcctgagcagctggtaccacgacagaggctgggccaagatcagcaacatgaccttcagcaacggcaagctgatcgtgaaccaggacggcttctactacctgtacgccaacatctgcttcagacaccacgagaccagcggcgacctggccaccgagtacctgcagctgatggtgtacgtgaccaagaccagcatcaagatccccagcagccacaccctgatgaagggcggcagcaccaagtactggagcggcaacagcgagttccacttctacagcatcaacgtgggcggcttcttcaagctgagaagcggcgaggagatcagcatcgaggtgagcaaccccagcctgctggaccccgaccaggacgccacctacttcggcgccttcaaggtgagagacatcgactag

SEQ ID NO: 104030 - DNA, 735 bp, Artificial Sequence; identical to SEQ ID NO: 104029
  Description of Artificial Sequence: Synthetic coding sequence

SEQ ID NO: 104031 - DNA, 735 bp, Artificial Sequence; identical to SEQ ID NO: 104029
  Description of Artificial Sequence: Synthetic coding sequence

SEQ ID NO: 104032 - DNA, 735 bp, Artificial Sequence; identical to SEQ ID NO: 104029
  Description of Artificial Sequence: Synthetic coding sequence

SEQ ID NO: 104033 - DNA, 750 bp, Artificial Sequence
  Description of Artificial Sequence: Synthetic coding sequence
atggccgccagaagaagccagagaagaagaggcagaagaggcgagcccggcaccgccctgctggtgcccctggccctgggcctgggcctggccctggcctgcctgggcctgctgctggccgtggtgagcctgggcagcagagccagcctgagcgcccaggagcccgcccaggaggagctggtggccgaggaggaccaggaccccagcgagctgaacccccagaccgaggagagccaggaccccgcccccttcctgaacagactggtgagacccagaagaagcgcccccaagggcagaaagaccagagccagaagagccatcgccgcccactacgaggtgcaccccagacccggccaggacggcgcccaggccggcgtggacggcaccgtgagcggctgggaggaggccagaatcaacagcagcagccccctgagatacaacagacagatcggcgagttcatcgtgaccagagccggcctgtactacctgtactgccaggtgcacttcgacgagggcaaggccgtgtacctgaagctggacctgctggtggacggcgtgctggccctgagatgcctggaggagttcagcgccaccgccgccagcagcctgggcccccagctgagactgtgccaggtgagcggcctgctggccctgagacccggcagcagcctgagaatcagaaccctgccctgggcccacctgaaggccgcccccttcctgacctacttcggcctgttccaggtgcactag

SEQ ID NO: 104034 - DNA, 993 bp, Artificial Sequence
  Description of Artificial Sequence: Synthetic coding sequence
atggccgccagaagaagccagagaagaagaggcagaagaggcgagcccggcaccgccctgctggtgcccctggccctgggcctgggcctggccctggcctgcctgggcctgctgctggccgtggtgagcctgggcagcagagccagcctgagcgcccaggagcccgcccaggaggagctggtggccgaggaggaccaggaccccagcgagctgaacccccagaccgaggagagccaggaccccgcccccttcctgaacagactggtgagacccagaagaagcgcccccaagggcagaaagaccagagccagaagagccatcgccgcccactacgaggtgcaccccagacccggccaggacggcgcccaggccggcgtggacggcaccgtgagcggctgggaggaggccagaatcaacagcagcagccccctgagatacaacagacagatcggcgagttcatcgtgaccagagccggcctgtactacctgtactgccagagcagcgacgccctggaggcctgggagaacggcgagagaagcagaaagagaagagccgtgctgacccagaagcagaagaagcagcacagcgtgctgcacctggtgcccatcaacgccaccagcaaggacgacagcgacgtgaccgaggtgatgtggcagcccgccctgagaagaggcagaggcctgcaggcccagggctacggcgtgagaatccaggacgccggcgtgtacctgctgtacagccaggtgctgttccaggacgtgaccttcaccatgggccaggtggtgagcagagagggccagggcagacaggagaccctgttcagatgcatcagaagcatgcccagccaccccgacagagcctacaacagctgctacagcgccggcgtgttccacctgcaccagggcgacatcctgagcgtgatcatccccagagccagagccaagctgaacctgagcccccacggcaccttcctgggcttcgtgaagctgtag

SEQ ID NO: 104035 - DNA, 723 bp, Artificial Sequence; identical to SEQ ID NO: 104027
  Description of Artificial Sequence: Synthetic coding sequence

SEQ ID NO: 104036 - DNA, 615 bp, Artificial Sequence
  Description of Artificial Sequence: Synthetic coding sequence
atggaggagagcgtggtgagacccagcgtgttcgtggtggacggccagaccgacatccccttcaccagactgggcagaagccacagaagacagagctgcagcgtggccagagacggccccgccggcagctgggagcagctgatccaggagagaagaagccacgaggtgaaccccgccgcccacctgaccggcgccaacagcagcctgaccggcagcggcggccccctgctgtgggagacccagctgggcctggccttcctgagaggcctgagctaccacgacggcgccctggtggtgaccaaggccggctactactacatctacagcaaggtgcagctgggcggcgtgggctgccccctgggcctggccagcaccatcacccacggcctgtacaagagaacccccagataccccgaggagctggagctgctggtgagccagcagagcccctgcggcagagccaccagcagcagcagagtgtggtgggacagcagcttcctgggcggcgtggtgcacctggaggccggcgagaaggtggtggtgagagtgctggacgagagactggtgagactgagagacggcaccagaagctacttcggcgccttcatggtgtag

SEQ ID NO: 104037 - DNA, 525 bp, Artificial Sequence
  Description of Artificial Sequence: Synthetic coding sequence
atgagacacttcctgagcaaggtgtacagcttccccatgagaaagctgatcctgttcctggtgttccccgtggtgagacagacccccacccagcacttcaagaaccagttccccgccctgcactgggagcacgagctgggcctggccttcaccaagaacagaatgaactacaccaacaagttcctgctgatccccgagagcggcgactacttcatctacagccaggtgaccttcagaggcatgaccagcgagtgcagcgagatcagacaggccggcagacccaacaagcccgacagcatcaccgtggtgatcaccaaggtgaccgacagctaccccgagcccacccagctgctgatgggcaccaagagcgtgtgcgaggtgggcagcaactggttccagcccatctacctgggcgccatgttcagcctgcaggagggcgacaagctgatggtgaacgtgagcgacatcagcctggtggactacaccaaggaggacaagaccttcttcggcgccttcctgctgtag

SEQ ID NO: 104038 - DNA, 756 bp, Artificial Sequence
  Description of Artificial Sequence: Synthetic coding sequence
atggccgaggacctgggcctgagcttcggcgagaccgccagcgtggagatgctgcccgagcacggcagctgcagacccaaggccagaagcagcagcgccagatgggccctgacctgctgcctggtgctgctgcccttcctggccggcctgaccacctacctgctggtgagccagctgagagcccagggcgaggcctgcgtgcagttccaggccctgaagggccaggagttcgcccccagccaccagcaggtgtacgcccccctgagagccgacggcgacaagcccagagcccacctgaccgtggtgagacagacccccacccagcacttcaagaaccagttccccgccctgcactgggagcacgagctgggcctggccttcaccaagaacagaatgaactacaccaacaagttcctgctgatccccgagagcggcgactacttcatctacagccaggtgaccttcagaggcatgaccagcgagtgcagcgagatcagacaggccggcagacccaacaagcccgacagcatcaccgtggtgatcaccaaggtgaccgacagctaccccgagcccacccagctgctgatgggcaccaagagcgtgtgcgaggtgggcagcaactggttccagcccatctacctgggcgccatgttcagcctgcaggagggcgacaagctgatggtgaacgtgagcgacatcagcctggtggactacaccaaggaggacaagaccttcttcggcgccttcctgctgtag

SEQ ID NO: 104039 - DNA, 534 bp, Artificial Sequence
  Description of Artificial Sequence: Synthetic coding sequence
atgtgcctgagccacctggagaacatgcccctgagccacagcagaacccagggcgcccagagaagcagctggaagctgtggctgttctgcagcatcgtgatgctgctgttcctgtgcagcttcagctggctgatcttcatcttcctgcagctggagaccgccaaggagccctgcatggccaagttcggccccctgcccagcaagtggcagatggccagcagcgagcccccctgcgtgaacaaggtgagcgactggaagctggagatcctgcagaacggcctgtacctgatctacggccaggtggcccccaacgccaactacaacgacgtggcccccttcgaggtgagactgtacaagaacaaggacatgatccagaccctgaccaacaagagcaagatccagaacgtgggcggcacctacgagctgcacgtgggcgacaccatcgacctgatcttcaacagcgagcaccaggtgctgaagaacaacacctactggggcatcatcctgctggccaacccccagttcatcagctag

SEQ ID NO: 104040 - DNA, 600 bp, Artificial Sequence
  Description of Artificial Sequence: Synthetic coding sequence
atgaccctgcaccccagccccatcacctgcgagttcctgttcagcaccgccctgatcagccccaagatgtgcctgagccacctggagaacatgcccctgagccacagcagaacccagggcgcccagagaagcagctggaagctgtggctgttctgcagcatcgtgatgctgctgttcctgtgcagcttcagctggctgatcttcatcttcctgcagctggagaccgccaaggagccctgcatggccaagttcggccccctgcccagcaagtggcagatggccagcagcgagcccccctgcgtgaacaaggtgagcgactggaagctggagatcctgcagaacggcctgtacctgatctacggccaggtggcccccaacgccaactacaacgacgtggcccccttcgaggtgagactgtacaagaacaaggacatgatccagaccctgaccaacaagagcaagatccagaacgtgggcggcacctacgagctgcacgtgggcgacaccatcgacctgatcttcaacagcgagcaccaggtgctgaagaacaacacctactggggcatcatcctgctggccaacccccagttcatcagctag

SEQ ID NO: 104041 - DNA, 552 bp, Artificial Sequence
  Description of Artificial Sequence: Synthetic coding sequence
atggagagagtgcagcccctggaggagaacgtgggcaacgccgccagacccagattcgagagaaacaagctgctgctggtggccagcgtgatccagggcctgggcctgctgctgtgcttcacctacatctgcctgcacttcagcgccctgcaggtgagccacagataccccagaatccagagcatcaaggtgcagttcaccgagtacaagaaggagaagggcttcatcctgaccagccagaaggaggacgagatcatgaaggtgcagaacaacagcgtgatcatcaactgcgacggcttctacctgatcagcctgaagggctacttcagccaggaggtgaacatcagcctgcactaccagaaggacgaggagcccctgttccagctgaagaaggtgagaagcgtgaacagcctgatggtggccagcctgacctacaaggacaaggtgtacctgaacgtgaccaccgacaacaccagcctggacgacttccacgtgaacggcggcgagctgatcctgatccaccagaaccccggcgagttctgcgtgctgtag

SEQ ID NO: 104042 - DNA, 402 bp, Artificial Sequence
  Description of Artificial Sequence: Synthetic coding sequence
atggtgagccacagataccccagaatccagagcatcaaggtgcagttcaccgagtacaagaaggagaagggcttcatcctgaccagccagaaggaggacgagatcatgaaggtgcagaacaacagcgtgatcatcaactgcgacggcttctacctgatcagcctgaagggctacttcagccaggaggtgaacatcagcctgcactaccagaaggacgaggagcccctgttccagctgaagaaggtgagaagcgtgaacagcctgatggtggccagcctgacctacaaggacaaggtgtacctgaacgtgaccaccgacaacaccagcctggacgacttccacgtgaacggcggcgagctgatcctgatccaccagaaccccggcgagttctgcgtgctgtag

SEQ ID NO: 104043 - DNA, 402 bp, Artificial Sequence; identical to SEQ ID NO: 104042
  Description of Artificial Sequence: Synthetic coding sequence

SEQ ID NO: 104044 - DNA, 765 bp, Artificial Sequence
  Description of Artificial Sequence: Synthetic coding sequence
atggagtacgccagcgacgccagcctggaccccgaggccccctggccccccgcccccagagccagagcctgcagagtgctgccctgggccctggtggccggcctgctgctgctgctgctgctggccgccgcctgcgccgtgttcctggcctgcccctgggccgtgagcggcgccagagccagccccggcagcgccgccagccccagactgagagagggccccgagctgagccccgacgaccccgccggcctgctggacctgagacagggcatgttcgcccagctggtggcccagaacgtgctgctgatcgacggccccctgagctggtacagcgaccccggcctggccggcgtgagcctgaccggcggcctgagctacaaggaggacaccaaggagctggtggtggccaaggccggcgtgtactacgtgttcttccagctggagctgagaagagtggtggccggcgagggcagcggcagcgtgagcctggccctgcacctgcagcccctgagaagcgccgccggcgccgccgccctggccctgaccgtggacctgccccccgccagcagcgaggccagaaacagcgccttcggcttccagggcagactgctgcacctgagcgccggccagagactgggcgtgcacctgcacaccgaggccagagccagacacgcctggcagctgacccagggcgccaccgtgctgggcctgttcagagtgacccccgagatccccgccggcctgcccagccccagaagcgagtag

SEQ ID NO: 104045 - DNA, 1851 bp, Artificial Sequence
  Description of Artificial Sequence: Synthetic coding sequence
atggcccccagagccagaagaagaagacccctgttcgccctgctgctgctgtgcgccctgctggccagactgcaggtggccctgcagatcgcccccccctgcaccagcgagaagcactacgagcacctgggcagatgctgcaacaagtgcgagcccggcaagtacatgagcagcaagtgcaccaccaccagcgacagcgtgtgcctgccctgcggccccgacgagtacctggacagctggaacgaggaggacaagtgcctgctgcacaaggtgtgcgacaccggcaaggccctggtggccgtggtggccggcaacagcaccacccccagaagatgcgcctgcaccgccggctaccactggagccaggactgcgagtgctgcagaagaaacaccgagtgcgcccccggcctgggcgcccagcaccccctgcagctgaacaaggacaccgtgtgcaagccctgcctggccggctacttcagcgacgccttcagcagcaccgacaagtgcagaccctggaccaactgcaccttcctgggcaagagagtggagcaccacggcaccgagaagagcgacgccgtgtgcagcagcagcctgcccgccagaaagccccccaacgagccccacgtgtacctgcccggcctgatcatcctgctgctgttcgccagcgtggccctggtggccgccatcatcttcggcgtgtgctacagaaagaagggcaaggccctgaccgccaacctgtggcactggatcaacgaggcctgcggcagactgagcggcgacaaggagagcagcggcgacagctgcgtgagcacccacaccgccaacttcggccagcagggcgcctgcgagggcgtgctgctgctgaccctggaggagaagaccttccccgaggacatgtgctaccccgaccagggcggcgtgtgccagggcacctgcgtgggcggcggcccctacgcccagggcgaggacgccagaatgctgagcctggtgagcaagaccgagatcgaggaggacagcttcagacagatgcccaccgaggacgagtacatggacagacccagccagcccaccgaccagctgctgttcctgaccgagcccggcagcaagagcaccccccccttcagcgagcccctggaggtgggcgagaacgacagcctgagccagtgcttcaccggcacccagagcaccgtgggcagcgagagctgcaactgcaccgagcccctgtgcagaaccgactggacccccatgagcagcgagaactacctgcagaaggaggtggacagcggccactgcccccactgggccgccagccccagccccaactgggccgacgtgtgcaccggctgcagaaacccccccggcgaggactgcgagcccctggtgggcagccccaagagaggccccctgccccagtgcgcctacggcatgggcctgccccccgaggaggaggccagcagaaccgaggccagagaccagcccgaggacggcgccgacggcagactgcccagcagcgccagagccggcgccggcagcggcagcagccccggcggccagagccccgccagcggcaacgtgaccggcaacagcaacagcaccttcatcagcagcggccaggtgatgaacttcaagggcgacatcatcgtggtgtacgtgagccagaccagccaggagggcgccgccgccgccgccgagcccatgggcagacccgtgcaggaggagaccctggccagaagagacagcttcgccggcaacggccccagattccccgacccctgcggcggccccgagggcctgagagagcccgagaaggccagcagacccgtgcaggagcagggcggcgccaaggcctag

SEQ ID NO: 104046 - DNA, 780 bp, Artificial Sequence
  Description of Artificial Sequence: Synthetic coding sequence
atggccagaatccccaagaccctgaagttcgtggtggtgatcgtggccgtgctgctgcccgtgctggcctacagcgccaccaccgccagacaggaggaggtgccccagcagaccgtggccccccagcagcagagacacagcttcaagggcgaggagtgccccgccggcagccacagaagcgagcacaccggcgcctgcaacccctgcaccgagggcgtggactacaccaacgccagcaacaacgagcccagctgcttcccctgcaccgtgtgcaagagcgaccagaagcacaagagcagctgcaccatgaccagagacaccgtgtgccagtgcaaggagggcaccttcagaaacgagaacagccccgagatgtgcagaaagtgcagcagatgccccagcggcgaggtgcaggtgagcaactgcaccagctgggacgacatccagtgcgtggaggagttcggcgccaacgccaccgtggagacccccgccgccgaggagaccatgaacaccagccccggcacccccgcccccgccgccgaggagaccatgaacaccagccccggcacccccgcccccgccgccgaggagaccatgaccaccagccccggcacccccgcccccgccgccgaggagaccatgaccaccagccccggcacccccgcccccgccgccgaggagaccatgatcaccagccccggcacccccgccagcagccactacctgagctgcaccatcgtgggcatcatcgtgctgatcgtgctgctgatcgtgttcgtgtag

SEQ ID NO: 104047 - DNA, 474 bp, Artificial Sequence
  Description of Artificial Sequence: Synthetic coding sequence
atgaccagagacaccgtgtgccagtgcaaggagggcaccttcagaaacgagaacagccccgagatgtgcagaaagtgcagcagatgccccagcggcgaggtgcaggtgagcaactgcaccagctgggacgacatccagtgcgtggaggagttcggcgccaacgccaccgtggagacccccgccgccgaggagaccatgaacaccagccccggcacccccgcccccgccgccgaggagaccatgaacaccagccccggcacccccgcccccgccgccgaggagaccatgaccaccagccccggcacccccgcccccgccgccgaggagaccatgaccaccagccccggcacccccgcccccgccgccgaggagaccatgatcaccagccccggcacccccgccagcagccactacctgagctgcaccatcgtgggcatcatcgtgctgatcgtgctgctgatcgtgttcgtgtag

SEQ ID NO: 104048 - DNA, 834 bp, Artificial Sequence
  Description of Artificial Sequence: Synthetic coding sequence
atggccagaatccccaagaccctgaagttcgtggtggtgatcgtggccgtgctgctgcccgtgctggcctacagcgccaccaccgccagacaggaggaggtgccccagcagaccgtggccccccagcagcagagacacagcttcaagggcgaggagtgccccgccggcagccacagaagcgagcacaccggcgcctgcaacccctgcaccgagggcgtggactacaccaacgccagcaacaacgagcccagctgcttcccctgcaccgtgtgcaagagcgaccagaagcacaagagcagctgcaccatgaccagagacaccgtgtgccagtgcaaggagggcaccttcagaaacgagaacagccccgagatgtgcagaaagtgcagcagatgccccagcggcgaggtgcaggtgagcaactgcaccagctgggacgacatccagtgcgtggaggagttcggcgccaacgccaccgtggagacccccgccgccgaggagaccatgaacaccagccccggcacccccgcccccgccgccgaggagaccatgaacaccagccccggcacccccgcccccgccgccgaggagaccatgaccaccagccccggcacccccgcccccgccgccgaggagaccatgaccaccagccccggcacccccgcccccgccgccgaggagaccatgatcaccagccccggcacccccgccagcagccactacctgagctgcaccatcgtgggcatcatcgtgctgatcgtgctgctgatcgtgccctacctgaagaagaagaagaagaagaagctgaagaagaagcagaagagaaagagcaagtag

SEQ ID NO: 104049 - DNA, 1851 bp, Artificial Sequence; identical to SEQ ID NO: 104045
  Description of Artificial Sequence: Synthetic coding sequence

SEQ ID NO: 104050 - DNA, 966 bp, Artificial Sequence
  Description of Artificial Sequence: Synthetic coding sequence
ggcagcagagccagatgggccaccgaggccgccgaggccgccgcccccgccagcctgagcagagccatggcccccagagccagaagaagaagacccctgttcgccctgctgctgctgtgcgccctgctggccagactgcaggtggccctgcagatcgcccccccctgcaccagcgagaagcactacgagcacctgggcagatgctgcaacaagtgcgagcccggcaagtacatgagcagcaagtgcaccaccaccagcgacagcgtgtgcctgccctgcggccccgacgagtacctggacagctggaacgaggaggacaagtgcctgctgcacaaggtgtgcgacaccggcaaggccctggtggccgtggtggccggcaacagcaccacccccagaagatgcgcctgcaccgccggctaccactggagccaggactgcgagtgctgcagaagaaacaccgagtgcgcccccggcctgggcgcccagcaccccctgcagctgaacaaggacaccgtgtgcaagccctgcctggccggctacttcagcgacgccttcagcagcaccgacaagtgcagaccctggaccaactgcaccttcctgggcaagagagtggagcaccacggcaccgagaagagcgacgccgtgtgcagcagcagcctgcccgccagaaagccccccaacggcaacgtgaccggcaacagcaacagcaccttcatcagcagcggccaggtgatgaacttcaagggcgacatcatcgtggtgtacgtgagccagaccagccaggagggcgccgccgccgccgccgagcccatgggcagacccgtgcaggaggagaccctggccagaagagacagcttcgccggcaacggccccagattccccgacccctgcggcggccccgagggcctgagagagcccgagaaggccagcagacccgtgcaggagcagggcggcgccaaggcctag

SEQ ID NO: 104051 - DNA, 1206 bp, Artificial Sequence
  Description of Artificial Sequence: Synthetic coding sequence
atgaacaacctgctgtgctgcgccctggtgttcctggacatcagcatcaagtggaccacccaggagaccttcccccccaagtacctgcactacgacgaggagaccagccaccagctgctgtgcgacaagtgcccccccggcacctacctgaagcagcactgcaccgccaagtggaagaccgtgtgcgccccctgccccgaccactactacaccgacagctggcacaccagcgacgagtgcctgtactgcagccccgtgtgcaaggagctgcagtacgtgaagcaggagtgcaacagaacccacaacagagtgtgcgagtgcaaggagggcagatacctggagatcgagttctgcctgaagcacagaagctgcccccccggcttcggcgtggtgcaggccggcacccccgagagaaacaccgtgtgcaagagatgccccgacggcttcttcagcaacgagaccagcagcaaggccccctgcagaaagcacaccaactgcagcgtgttcggcctgctgctgacccagaagggcaacgccacccacgacaacatctgcagcggcaacagcgagagcacccagaagtgcggcatcgacgtgaccctgtgcgaggaggccttcttcagattcgccgtgcccaccaagttcacccccaactggctgagcgtgctggtggacaacctgcccggcaccaaggtgaacgccgagagcgtggagagaatcaagagacagcacagcagccaggagcagaccttccagctgctgaagctgtggaagcaccagaacaaggaccaggacatcgtgaagaagatcatccaggacatcgacctgtgcgagaacagcgtgcagagacacatcggccacgccaacctgaccttcgagcagctgagaagcctgatggagagcctgcccggcaagaaggtgggcgccgaggacatcgagaagaccatcaaggcctgcaagcccagcgaccagatcctgaagctgctgagcctgtggagaatcaagaacggcgaccaggacaccctgaagggcctgatgcacgccctgaagcacagcaagacctaccacttccccaagaccgtgacccagagcctgaagaagaccatcagattcctgcacagcttcaccatgtacaagctgtaccagaagctgttcctggagatgatcggcaaccaggtgcagagcgtgaagatcagctgcctgtag

SEQ ID NO: 104052 - DNA, 390 bp, Artificial Sequence
  Description of Artificial Sequence: Synthetic coding sequence
atggccagaggcagcctgagaagactgctgagactgctggtgctgggcctgtggctggccctgctgagaagcgtggccggcgagcaggcccccggcaccgccccctgcagcagaggcagcagctggagcgccgacctggacaagtgcatggactgcgccagctgcagagccagaccccacagcgacttctgcctgggctgcgccgccgccccccccgcccccttcagactgctgtggcccatcctgggcggcgccctgagcctgaccttcgtgctgggcctgctgagcggcttcctggtgtggagaagatgcagaagaagagagaagttcaccacccccatcgaggagaccggcggcgagggctgccccgccgtggccctgatccagtag

SEQ ID NO: 104053 - DNA, 285 bp, Artificial Sequence
  Description of Artificial Sequence: Synthetic coding sequence
atggccagaggcagcctgagaagactgctgagactgctggtgctgggcctgtggctggccctgctgagaagcgtggccggcgagcaggcccccggcgccgccgccccccccgcccccttcagactgctgtggcccatcctgggcggcgccctgagcctgaccttcgtgctgggcctgctgagcggcttcctggtgtggagaagatgcagaagaagagagaagttcaccacccccatcgaggagaccggcggcgagggctgccccgccgtggccctgatccagtag

SEQ ID NO: 104054 - DNA, 882 bp, Artificial Sequence
  Description of Artificial Sequence: Synthetic coding sequence
atgagcggcctgggcagaagcagaagaggcggcagaagcagagtggaccaggaggagagattcccccagggcctgtggaccggcgtggccatgagaagctgccccgaggagcagtactgggaccccctgctgggcacctgcatgagctgcaagaccatctgcaaccaccagagccagagaacctgcgccgccttctgcagaagcctgagctgcagaaaggagcagggcaagttctacgaccacctgctgagagactgcatcagctgcgccagcatctgcggccagcaccccaagcagtgcgcctacttctgcgagaacaagctgagaagccccgtgaacctgccccccgagctgagaagacagagaagcggcgaggtggagaacaacagcgacaacagcggcagataccagggcctggagcacagaggcagcgaggccagccccgccctgcccggcctgaagctgagcgccgaccaggtggccctggtgtacagcaccctgggcctgtgcctgtgcgccgtgctgtgctgcttcctggtggccgtggcctgcttcctgaagaagagaggcgacccctgcagctgccagcccagaagcagacccagacagagccccgccaagagcagccaggaccacgccatggaggccggcagccccgtgagcaccagccccgagcccgtggagacctgcagcttctgcttccccgagtgcagagcccccacccaggagagcgccgtgacccccggcacccccgaccccacctgcgccggcagatggggctgccacaccagaaccaccgtgctgcagccctgcccccacatccccgacagcggcctgggcatcgtgtgcgtgcccgcccaggagggcggccccggcgcctag

SEQ ID NO: 104055 - DNA, 747 bp, Artificial Sequence
  Description of Artificial Sequence: Synthetic coding sequence
atgagcggcctgggcagaagcagaagaggcggcagaagcagagtggaccaggaggagagatggagcctgagctgcagaaaggagcagggcaagttctacgaccacctgctgagagactgcatcagctgcgccagcatctgcggccagcaccccaagcagtgcgcctacttctgcgagaacaagctgagaagccccgtgaacctgccccccgagctgagaagacagagaagcggcgaggtggagaacaacagcgacaacagcggcagataccagggcctggagcacagaggcagcgaggccagccccgccctgcccggcctgaagctgagcgccgaccaggtggccctggtgtacagcaccctgggcctgtgcctgtgcgccgtgctgtgctgcttcctggtggccgtggcctgcttcctgaagaagagaggcgacccctgcagctgccagcccagaagcagacccagacagagccccgccaagagcagccaggaccacgccatggaggccggcagccccgtgagcaccagccccgagcccgtggagacctgcagcttctgcttccccgagtgcagagcccccacccaggagagcgccgtgacccccggcacccccgaccccacctgcgccggcagaaagaccaagcccccccccgtgctgaccgccggcaactgcggcgtgcacagacccccccccgagaccagcaccggcagccccagaggccagagactgctgtggacccagtag

SEQ ID NO: 104056 - DNA, 555 bp, Artificial Sequence
  Description of Artificial Sequence: Synthetic coding sequence
atgagaagaggccccagaagcctgagaggcagagacgcccccgcccccaccccctgcgtgcccgccgagtgcttcgacctgctggtgagacactgcgtggcctgcggcctgctgagaacccccagacccaagcccgccggcgccagcagccccgcccccagaaccgccctgcagccccaggagagcgtgggcgccggcgccggcgaggccgccctgcccctgcccggcctgctgttcggcgcccccgccctgctgggcctggccctggtgctggccctggtgctggtgggcctggtgagctggagaagaagacagagaagactgagaggcgccagcagcgccgaggcccccgacggcgacaaggacgcccccgagcccctggacaaggtgatcatcctgagccccggcatcagcgacgccaccgcccccgcctggcccccccccggcgaggaccccggcaccaccccccccggccacagcgtgcccgtgcccgccaccgagctgggcagcaccgagctggtgaccaccaagaccgccggccccgagcagcagtag

SEQ ID NO: 104057 - DNA, 852 bp, Artificial Sequence
  Description of Artificial Sequence: Synthetic coding sequence
atggagccccccggcgactggggcccccccccctggagaagcacccccaagaccgacgtgctgagactggtgctgtacctgaccttcctgggcgccccctgctacgcccccgccctgcccagctgcaaggaggacgagtaccccgtgggcagcgagtgctgccccaagtgcagccccggctacagagtgaaggaggcctgcggcgagctgaccggcaccgtgtgcgagccctgcccccccggcacctacatcgcccacctgaacggcctgagcaagtgcctgcagtgccagatgtgcgaccccgccatgggcctgagagccagcagaaactgcagcagaaccgagaacgccgtgtgcggctgcagccccggccacttctgcatcgtgcaggacggcgaccactgcgccgcctgcagagcctacgccaccagcagccccggccagagagtgcagaagggcggcaccgagagccaggacaccctgtgccagaactgcccccccggcaccttcagccccaacggcaccctggaggagtgccagcaccagaccaagtgcagctggctggtgaccaaggccggcgccggcaccagcagcagccactgggtgtggtggttcctgagcggcagcctggtgatcgtgatcgtgtgcagcaccgtgggcctgatcatctgcgtgaagagaagaaagcccagaggcgacgtggtgaaggtgatcgtgagcgtgcagagaaagagacaggaggccgagggcgaggccaccgtgatcgaggccctgcaggccccccccgacgtgaccaccgtggccgtggaggagaccatccccagcttcaccggcagaagccccaaccactag

SEQ ID NO: 104058 - DNA, 522 bp, Artificial Sequence
  Description of Artificial Sequence: Synthetic coding sequence
atggagccccccggcgactggggcccccccccctggagaagcacccccaagaccgacgtgctgagactggtgctgtacctgaccttcctgggcgccccctgctacgcccccgccctgcccagctgcaaggaggacgagtaccccgtgggcagcgagtgctgccccaagtgcagccccggctacagagtgaaggaggcctgcggcgagctgaccggcaccgtgtgcgagccctgcccccccggcacctacatcgcccacctgaacggcctgagcaagtgcctgcagtgccagatgtgcgaccccgacatcggcagcccctgcgacctgagaggcagaggccacctggaggccggcgcccacctgagccccggcagacagaagggcgagcccgaccccgaggtggccttcgagagcctgagcgccgagccccacgccagactgagcatggccagcgccccctgcggccaggccggcctgcacctgagagacagagccgacggcacccccggcggcagagcctag

SEQ ID NO: 104059 - DNA, 552 bp, Artificial Sequence
  Description of Artificial Sequence: Synthetic coding sequence
atggagccccccggcgactggggcccccccccctggagaagcacccccaagaccgacgtgctgagactggtgctgtacctgaccttcctgggcgccccctgctacgcccccgccctgcccagctgcaaggaggacgagtaccccgtgggcagcgagtgctgccccaagtgcagccccggctacagagtgaaggaggcctgcggcgagctgaccggcaccgtgtgcgagccctgcccccccggcacctacatcgcccacctgaacggcctgagcaagtgcctgcagtgccagatgtgcgaccccgccatgggcctgagagccagcagaaactgcagcagaaccgagaacgccgtgtgcggctgcagccccggccacttctgcatcgtgcaggacggcgaccactgcgccgcctgcagagcctacgccaccagcagccccggccagagagtgcagaagggcggcaccgagagccaggacaccctgtgccagaactgcccccccggcaccttcagccccaacggcaccctggaggagtgccagcaccagacctag

SEQ ID NO: 104060 - DNA, 696 bp, Artificial Sequence
  Description of Artificial Sequence: Synthetic coding sequence
atggagccccccggcgactggggcccccccccctggagaagcacccccaagaccgacgtgctgagactggtgctgtacctgaccttcctgggcgccccctgctacgcccccgccctgcccagctgcaaggaggacgagtaccccgtgggcagcgagtgctgccccaagtgcagccccggctacagagtgaaggaggcctgcggcgagctgaccggcaccgtgtgcgagccctgcccccccggcacctacatcgcccacctgaacggcctgagcaagtgcctgcagtgccagatgtgcgaccccgccatgggcctgagagccagcagaaactgcagcagaaccgagaacgccgtgtgcggctgcagccccggccacttctgcatcgtgcaggacggcgaccactgcgccgcctgcagagcctacgccaccagcagccccggccagagagtgcagaagggcggcaccgagagccaggacaccctgtgccagaactgcccccccggcaccttcagccccaacggcaccctggaggagtgccagcaccagaccaagtgcagctggctggtgaccaaggccggcgccggcaccagcagcagccactgggtgtggtggttcctgagcggcagcctggtgatcgtgatcgtgtgcagcaccgtgggcctgatcatctgcgtgaagagaagaaagcccagatag

SEQ ID NO: 104061 - DNA, 696 bp, Artificial Sequence; identical to SEQ ID NO: 104060
  Description of Artificial Sequence: Synthetic coding sequence

SEQ ID NO: 104062 - DNA, 696 bp, Artificial Sequence; identical to SEQ ID NO: 104060
  Description of Artificial Sequence: Synthetic coding sequence

SEQ ID NO: 104063 - DNA, 555 bp, Artificial Sequence
  Description of Artificial Sequence: Synthetic coding sequence
atgctgcagatggccggccagtgcagccagaacgagtacttcgacagcctgctgcacgcctgcatcccctgccagctgagatgcagcagcaacaccccccccctgacctgccagagatactgcaacgccagcgtgaccaacagcgtgaagggcaccaacgccatcctgtggacctgcctgggcctgagcctgatcatcagcctggccgtgttcgtgctgatgttcctgctgagaaagatcaacagcgagcccctgaaggacgagttcaagaacaccggcagcggcctgctgggcatggccaacatcgacctggagaagagcagaaccggcgacgagatcatcctgcccagaggcctggagtacaccgtggaggagtgcacctgcgaggactgcatcaagagcaagcccaaggtggacagcgaccactgcttccccctgcccgccatggaggagggcgccaccatcctggtgaccaccaagaccaacgactactgcaagagcctgcccgccgccctgagcgccaccgagatcgagaagagcatcagcgccagatag

SEQ ID NO: 104064 - DNA, 408 bp, Artificial Sequence
  Description of Artificial Sequence: Synthetic coding sequence
atgctgcagatggccggccagtgcagccagaacgagtacttcgacagcctgctgcacgcctgcatcccctgccagctgagatgcagcagcaacaccccccccctgacctgccagagatactgcaacgccagaagcggcctgctgggcatggccaacatcgacctggagaagagcagaaccggcgacgagatcatcctgcccagaggcctggagtacaccgtggaggagtgcacctgcgaggactgcatcaagagcaagcccaaggtggacagcgaccactgcttccccctgcccgccatggaggagggcgccaccatcctggtgaccaccaagaccaacgactactgcaagagcctgcccgccgccctgagcgccaccgagatcgagaagagcatcagcgccagatag

SEQ ID NO: 104065 - DNA, 417 bp, Artificial Sequence
  Description of Artificial Sequence: Synthetic coding sequence
atggccggccagtgcagccagaacgagtacttcgacagcctgctgcacgcctgcatcccctgccagctgagatgcagcagcaacaccccccccctgacctgccagagatactgcaacgccagcgtgaccaacagcgtgaagggcaccaacgccatcctgtggacctgcctgggcctgagcctgatcatcagcctggccgtgttcgtgctgatgttcctgctgagaaagatcaacagcgagcccctgaaggacgagttcaagaacaccgagatggagagcagaagcgtggcccaggccggcgtgcagtggagagacctgaacagcctgcagcccctgcccctgggcttcaagcagttcagccacctgagcctgctgagcaactgggactacagaatcagaagccccggccacggctag

SEQ ID NO: 104066 - DNA, 768 bp, Artificial Sequence
  Description of Artificial Sequence: Synthetic coding sequence
atggcccagcacggcgccatgggcgccttcagagccctgtgcggcctggccctgctgtgcgccctgagcctgggccagagacccaccggcggccccggctgcggccccggcagactgctgctgggcaccggcaccgacgccagatgctgcagagtgcacaccaccagatgctgcagagactaccccggcgaggagtgctgcagcgagtgggactgcatgtgcgtgcagcccgagttccactgcggcgacccctgctgcaccacctgcagacaccacccctgcccccccggccagggcgtgcagagccagggcaagttcagcttcggcttccagtgcatcgactgcgccagcggcaccttcagcggcggccacgagggccactgcaagccctggaccgactgctgctggagatgcagaagaagacccaagacccccgaggccgccagcagccccagaaagagcggcgccagcgacagacagagaagaagaggcggctgggagacctgcggctgcgagcccggcagaccccccggcccccccaccgccgccagccccagccccggcgccccccaggccgccggcgccctgagaagcgccctgggcagagccctgctgccctggcagcagaagtgggtgcaggagggcggcagcgaccagagacccggcccctgcagcagcgccgccgccgccggcccctgcagaagagagagagagacccagagctggccccccagcagcctggccggccccgacggcgtgggcagctag

SEQ ID NO: 104067 - DNA, 705 bp, Artificial Sequence
  Description of Artificial Sequence: Synthetic coding sequence
atggcccagcacggcgccatgggcgccttcagagccctgtgcggcctggccctgctgtgcgccctgagcctgggccagagacccaccggcggccccggctgcggccccggcagactgctgctgggcaccggcaccgacgccagatgctgcagagtgcacaccaccagatgctgcagagactaccccggcgaggagtgctgcagcgagtgggactgcatgtgcgtgcagcccgagttccactgcggcgacccctgctgcaccacctgcagacaccacccctgcccccccggccagggcgtgcagagccagggcaagttcagcttcggcttccagtgcatcgactgcgccagcggcaccttcagcggcggccacgagggccactgcaagccctggaccgactgcacccagttcggcttcctgaccgtgttccccggcaacaagacccacaacgccgtgtgcgtgcccggcagcccccccgccgagcccctgggctggctgaccgtggtgctgctggccgtggccgcctgcgtgctgctgctgaccagcgcccagctgggcctgcacatctggcagctgagaaagacccagctgctgctggaggtgccccccagcaccgaggacgccagaagctgccagttccccgaggaggagagaggcgagagaagcgccgaggagaagggcagactgggcgacctgtgggtgtag

SEQ ID NO: 104068 - DNA, 726 bp, Artificial Sequence
  Description of Artificial Sequence: Synthetic coding sequence
atggcccagcacggcgccatgggcgccttcagagccctgtgcggcctggccctgctgtgcgccctgagcctgggccagagacccaccggcggccccggctgcggccccggcagactgctgctgggcaccggcaccgacgccagatgctgcagagtgcacaccaccagatgctgcagagactaccccggcgaggagtgctgcagcgagtgggactgcatgtgcgtgcagcccgagttccactgcggcgacccctgctgcaccacctgcagacaccacccctgcccccccggccagggcgtgcagagccagggcaagttcagcttcggcttccagtgcatcgactgcgccagcggcaccttcagcggcggccacgagggccactgcaagccctggaccgactgcacccagttcggcttcctgaccgtgttccccggcaacaagacccacaacgccgtgtgcgtgcccggcagcccccccgccgagcccctgggctggctgaccgtggtgctgctggccgtggccgcctgcgtgctgctgctgaccagcgcccagctgggcctgcacatctggcagctgagaagccagtgcatgtggcccagagagacccagctgctgctggaggtgccccccagcaccgaggacgccagaagctgccagttccccgaggaggagagaggcgagagaagcgccgaggagaagggcagactgggcgacctgtgggtgtag

SEQ ID NO: 104069 - DNA, 834 bp, Artificial Sequence
  Description of Artificial Sequence: Synthetic coding sequence
atgtgcgtgggcgccagaagactgggcagaggcccctgcgccgccctgctgctgctgggcctgggcctgagcaccgtgaccggcctgcactgcgtgggcgacacctaccccagcaacgacagatgctgccacgagtgcagacccggcaacggcatggtgagcagatgcagcagaagccagaacaccgtgtgcagaccctgcggccccggcttctacaacgacgtggtgagcagcaagccctgcaagccctgcacctggtgcaacctgagaagcggcagcgagagaaagcagctgtgcaccgccacccaggacaccgtgtgcagatgcagagccggcacccagcccctggacagctacaagcccggcgtggactgcgccccctgcccccccggccacttcagccccggcgacaaccaggcctgcaagccctggaccaactgcaccctggccggcaagcacaccctgcagcccgccagcaacagcagcgacgccatctgcgaggacagagacccccccgccacccagccccaggagacccagggcccccccgccagacccatcaccgtgcagcccaccgaggcctggcccagaaccagccagggccccagcaccagacccgtggaggtgcccggcggcagagccgtggccgccatcctgggcctgggcctggtgctgggcctgctgggccccctggccatcctgctggccctgtacctgctgagaagagaccagagactgccccccgacgcccacaagccccccggcggcggcagcttcagaacccccatccaggaggagcaggccgacgcccacagcaccctggccaagatctag

SEQ ID NO: 104070 - DNA, 399 bp, Artificial Sequence
  Description of Artificial Sequence: Synthetic coding sequence
tgacccggcgccccccccctgccccccggcgcccagaccagacccagacccagaggcgtgggcgagaccaccctggccatgtggcccggcctggccggcctgagcagaagcggcagcgagagaaagcagctgtgcaccgccacccaggacaccgtgtgcagatgcagagccggcacccagcccctggacagctacaagcccggcgtggactgcgccccctgcccccccggccacttcagccccggcgacaaccaggcctgcaagccctggaccaactgcaccctggccggcaagcacaccctgcagcccgccagcaacagcagcgacgccatctgcgaggacagagacccccccgccacccagccccaggagacccagggcccccccgccagaccctag

SEQ ID NO: 104071 - DNA, 423 bp, Artificial Sequence
  Description of Artificial Sequence: Synthetic coding sequence
atgagagccctggagggccccggcctgagcctgctgtgcctggtgctggccctgcccgccctgctgcccgtgcccgccgtgagaggcgtggccgagacccccacctacccctggagagacgccgagaccggcgagagactggtgtgcgcccagtgcccccccggcaccttcgtgcagagaccctgcagaagagacagccccaccacctgcggcccctgcccccccagacactacacccagttctggaactacctggagagatgcagatactgcaacgtgctgtgcggcgagagagaggaggaggccagagcctgccacgccacccacaacagagcctgctgcggctgctgcagaagatgcgcctggcccggctgccccggctggagcggcgccagcgtgagcgccagcagcctgtgcacctag

SEQ ID NO: 104072 - DNA, 903 bp, Artificial Sequence
  Description of Artificial Sequence: Synthetic coding sequence
atgagagccctggagggccccggcctgagcctgctgtgcctggtgctggccctgcccgccctgctgcccgtgcccgccgtgagaggcgtggccgagacccccacctacccctggagagacgccgagaccggcgagagactggtgtgcgcccagtgcccccccggcaccttcgtgcagagaccctgcagaagagacagccccaccacctgcggcccctgcccccccagacactacacccagttctggaactacctggagagatgcagatactgcaacgtgctgtgcggcgagagagaggaggaggccagagcctgccacgccacccacaacagagcctgcagatgcagaaccggcttcttcgcccacgccggcttctgcctggagcacgccagctgcccccccggcgccggcgtgatcgcccccggcacccccagccagaacacccagtgccagccctgcccccccggcaccttcagcgccagcagcagcagcagcgagcagtgccagccccacagaaactgcaccgccctgggcctggccctgaacgtgcccggcagcagcagccacgacaccctgtgcaccagctgcaccggcttccccctgagcaccagagtgcccggcgccgaggagtgcgagagagccgtgatcgacttcgtggccttccaggacatcagcatcaagagactgcagagactgctgcaggccctggaggcccccgagggctggggccccacccccagagccggcagagccgccctgcagctgaagctgagaagaagactgaccgagctgctgggcgcccaggacggcgccctgctggtgagactgctgcaggccctgagagtggccagaatgcccggcctggagagaagcgtgagagagagattcctgcccgtgcactag

SEQ ID NO: 104073 - DNA, 903 bp, Artificial Sequence; identical to SEQ ID NO: 104072
  Description of Artificial Sequence: Synthetic coding sequence

SEQ ID NO: 104074 - DNA, 1788 bp, Artificial Sequence
  Description of Artificial Sequence: Synthetic coding sequence
atgagagtgctgctggccgccctgggcctgctgttcctgggcgccctgagagccttcccccaggacagacccttcgaggacacctgccacggcaaccccagccactactacgacaaggccgtgagaagatgctgctacagatgccccatgggcctgttccccacccagcagtgcccccagagacccaccgactgcagaaagcagtgcgagcccgactactacctggacgaggccgacagatgcaccgcctgcgtgacctgcagcagagacgacctggtggagaagaccccctgcgcctggaacagcagcagagtgtgcgagtgcagacccggcatgttctgcagcaccagcgccgtgaacagctgcgccagatgcttcttccacagcgtgtgccccgccggcatgatcgtgaagttccccggcaccgcccagaagaacaccgtgtgcgagcccgccagccccggcgtgagccccgcctgcgccagccccgagaactgcaaggagcccagcagcggcaccatcccccaggccaagcccacccccgtgagccccgccaccagcagcgccagcaccatgcccgtgagaggcggcaccagactggcccaggaggccgccagcaagctgaccagagcccccgacagccccagcagcgtgggcagacccagcagcgaccccggcctgagccccacccagccctgccccgagggcagcggcgactgcagaaagcagtgcgagcccgactactacctggacgaggccggcagatgcaccgcctgcgtgagctgcagcagagacgacctggtggagaagaccccctgcgcctggaacagcagcagaacctgcgagtgcagacccggcatgatctgcgccaccagcgccaccaacagcagagccagatgcgtgccctaccccatctgcgccgccgagaccgtgaccaagccccaggacatggccgagaaggacaccaccttcgaggccccccccctgggcacccagcccgactgcaaccccacccccgagaacggcgaggcccccgccagcaccagccccacccagagcctgctggtggacagccaggccagcaagaccctgcccatccccaccagcgcccccgtggccctgagcagcaccggcaagcccgtgctggacgccggccccgtgctgttctgggtgatcctggtgctggtggtggtggtgggcagcagcgccttcctgctgtgccacagaagagcctgcagaaagagaatcagacagaagctgcacctgtgctaccccgtgcagaccagccagcccaagctggagctggtggacagcagacccagaagaagcagcacccagctgagaagcggcgccagcgtgaccgagcccgtggccgaggagagaggcctgatgagccagcccctgatggagacctgccacagcgtgggcgccgcctacctggagagcctgcccctgcaggacgccagccccgccggcggccccagcagccccagagacctgcccgagcccagagtgagcaccgagcacaccaacaacaagatcgagaagatctacatcatgaaggccgacaccgtgatcgtgggcaccgtgaaggccgagctgcccgagggcagaggcctggccggccccgccgagcccgagctggaggaggagctggaggccgaccacaccccccactaccccgagcaggagaccgagccccccctgggcagctgcagcgacgtgatgctgagcgtggaggaggagggcaaggaggaccccctgcccaccgccgccagcggcaagtag

SEQ ID NO: 104075 - DNA, 399 bp, Artificial Sequence
  Description of Artificial Sequence: Synthetic coding sequence
atgagccagcccctgatggagacctgccacagcgtgggcgccgcctacctggagagcctgcccctgcaggacgccagccccgccggcggccccagcagccccagagacctgcccgagcccagagtgagcaccgagcacaccaacaacaagatcgagaagatctacatcatgaaggccgacaccgtgatcgtgggcaccgtgaaggccgagctgcccgagggcagaggcctggccggccccgccgagcccgagctggaggaggagctggaggccgaccacaccccccactaccccgagcaggagaccgagccccccctgggcagctgcagcgacgtgatgctgagcgtggaggaggagggcaaggaggaccccctgcccaccgccgccagcggcaagtag

SEQ ID NO: 104076 - DNA, 1452 bp, Artificial Sequence
  Description of Artificial Sequence: Synthetic coding sequence
atgttctgcagcaccagcgccgtgaacagctgcgccagatgcttcttccacagcgtgtgccccgccggcatgatcgtgaagttccccggcaccgcccagaagaacaccgtgtgcgagcccgccagccccggcgtgagccccgcctgcgccagccccgagaactgcaaggagcccagcagcggcaccatcccccaggccaagcccacccccgtgagccccgccaccagcagcgccagcaccatgcccgtgagaggcggcaccagactggcccaggaggccgccagcaagctgaccagagcccccgacagccccagcagcgtgggcagacccagcagcgaccccggcctgagccccacccagccctgccccgagggcagcggcgactgcagaaagcagtgcgagcccgactactacctggacgaggccggcagatgcaccgcctgcgtgagctgcagcagagacgacctggtggagaagaccccctgcgcctggaacagcagcagaacctgcgagtgcagacccggcatgatctgcgccaccagcgccaccaacagcagagccagatgcgtgccctaccccatctgcgccgccgagaccgtgaccaagccccaggacatggccgagaaggacaccaccttcgaggccccccccctgggcacccagcccgactgcaaccccacccccgagaacggcgaggcccccgccagcaccagccccacccagagcctgctggtggacagccaggccagcaagaccctgcccatccccaccagcgcccccgtggccctgagcagcaccggcaagcccgtgctggacgccggccccgtgctgttctgggtgatcctggtgctggtggtggtggtgggcagcagcgccttcctgctgtgccacagaagagcctgcagaaagagaatcagacagaagctgcacctgtgctaccccgtgcagaccagccagcccaagctggagctggtggacagcagacccagaagaagcagcaccctgagaagcggcgccagcgtgaccgagcccgtggccgaggagagaggcctgatgagccagcccctgatggagacctgccacagcgtgggcgccgcctacctggagagcctgcccctgcaggacgccagccccgccggcggccccagcagccccagagacctgcccgagcccagagtgagcaccgagcacaccaacaacaagatcgagaagatctacatcatgaaggccgacaccgtgatcgtgggcaccgtgaaggccgagctgcccgagggcagaggcctggccggccccgccgagcccgagctggaggaggagctggaggccgaccacaccccccactaccccgagcaggagaccgagccccccctgggcagctgcagcgacgtgatgctgagcgtggaggaggagggcaaggaggaccccctgcccaccgccgccagcggcaagtag

SEQ ID NO: 104077 - DNA, 1437 bp, Artificial Sequence
  Description of Artificial Sequence: Synthetic coding sequence
atggcccccctgagacccctgctgatcctggccctgctggcctgggtggccctggccgaccaggagagctgcaagggcagatgcaccgagggcttcaacgtggacaagaagtgccagtgcgacgagctgtgcagctactaccagagctgctgcaccgactacaccgccgagtgcaagccccaggtgaccagaggcgacgtgttcaccatgcccgaggacgagtacaccgtgtacgacgacggcgaggagaagaacaacgccaccgtgcacgagcaggtgggcggccccagcctgaccagcgacctgcaggcccagagcaagggcaaccccgagcagacccccgtgctgaagcccgaggaggaggcccccgcccccgaggtgggcgccagcaagcccgagggcatcgacagcagacccgagaccctgcaccccggcagaccccagccccccgccgaggaggagctgtgcagcggcaagcccttcgacgccttcaccgacctgaagaacggcagcctgttcgccttcagaggccagtactgctacgagctggacgagaaggccgtgagacccggctaccccaagctgatcagagacgtgtggggcatcgagggccccatcgacgccgccttcaccagaatcaactgccagggcaagacctacctgttcaagggcagccagtactggagattcgaggacggcgtgctggaccccgactaccccagaaacatcagcgacggcttcgacggcatccccgacaacgtggacgccgccctggccctgcccgcccacagctacagcggcagagagagagtgtacttcttcaagggcaagcagtactgggagtaccagttccagcaccagcccagccaggaggagtgcgagggcagcagcctgagcgccgtgttcgagcacttcgccatgatgcagagagacagctgggaggacatcttcgagctgctgttctggggcagaaccagcgccggcaccagacagccccagttcatcagcagagactggcacggcgtgcccggccaggtggacgccgccatggccggcagaatctacatcagcggcatggcccccagacccagcctggccaagaagcagagattcagacacagaaacagaaagggctacagaagccagagaggccacagcagaggcagaaaccagaacagcagaagacccagcagagccacctggctgagcctgttcagcagcgaggagagcaacctgggcgccaacaactacgacgactacagaatggactggctggtgcccgccacctgcgagcccatccagagcgtgttcttcttcagcggcgacaagtactacagagtgaacctgagaaccagaagagtggacaccgtggaccccccctaccccagaagcatcgcccagtactggctgggctgccccgcccccggccacctgtag

SEQ ID NO: 104078 - DNA, 639 bp, Artificial Sequence
  Description of Artificial Sequence: Synthetic coding sequence
atggccgaggccaagtactacctgatccagggcctggtgaacatgtgccagagcgccctgcaggacaagaaggacagctaccagcccgtgtgcaacatccccatcatcaccagcctgaaggaggaggagagactgatcgagagcagcaccaagcccgtggtgaagctgctgtacaacagaagcaacaacaagtacagctacaccagcaacagcgacgaccacctgctgaagaacatcgagctgttcgacaagctgagcctgagattcaacggcagagtgctgttcatcaaggacgtgatcggcgacgagatctgctgctggagcttctacggccagggcagaaagctggccgaggtgtgctgcaccagcatcgtgtacgccaccgagaagaagcagaccaaggtggagttccccgaggccagaatctacgaggagaccctgaacgtgctgctgtacgagacccccagagtgcccgacaacagcctgctggaggccaccagcagaagcagaagccaggccagccccagcgaggacgaggagaccttcgagctgagagacagagtgagaagaatccacgtgaagagatacagcacctacgacgacagacagctgggccaccagagcacccacagagactag

SEQ ID NO: 104079 - DNA, 1965 bp, Artificial Sequence
  Description of Artificial Sequence: Synthetic coding sequence
atgagcgaggccagcagcgaggacctggtgccccccctggaggccggcgccgccccctacagagaggaggaggaggccgccaagaagaagaaggagaagaagaagaagagcaagggcctggccaacgtgttctgcgtgttcaccaagggcaagaagaagaagggccagcccagcagcgccgagcccgaggacgccgccggcagcagacagggcctggacggccccccccccaccgtggaggagctgaaggccgccctggagagaggccagctggaggccgccagacccctgctggccctggagagagagctggccgccgccgccgccgccggcggcgtgagcgaggaggagctggtgagaagacagagcaaggtggaggccctgtacgagctgctgagagaccaggtgctgggcgtgctgagaagacccctggaggccccccccgagagactgagacaggccctggccgtggtggccgagcaggagagagaggacagacaggccgccgccgccggccccggcaccagcggcctggccgccaccagacccagaagatggctgcagctgtggagaagaggcgtggccgaggccgccgaggagagaatgggccagagacccgccgccggcgccgaggtgcccgagagcgtgttcctgcacctgggcagaaccatgaaggaggacctggaggccgtggtggagagactgaagcccctgttccccgccgagttcggcgtggtggccgcctacgccgagagctaccaccagcacttcgccgcccacctggccgccgtggcccagttcgagctgtgcgagagagacacctacatgctgctgctgtgggtgcagaacctgtaccccaacgacatcatcaacagccccaagctggtgggcgagctgcagggcatgggcctgggcagcctgctgccccccagacagatcagactgctggaggccaccttcctgagcagcgaggccgccaacgtgagagagctgatggacagagccctggagctggaggccagaagatgggccgaggacgtgcccccccagagactggacggccactgccacagcgagctggccatcgacatcatccagatcaccagccaggcccaggccaaggccgagagcatcaccctggacctgggcagccagatcaagagagtgctgctggtggagctgcccgccttcctgagaagctaccagagagccttcaacgagttcctggagagaggcaagcagctgaccaactacagagccaacgtgatcgccaacatcaacaactgcctgagcttcagaatgagcatggagcagaactggcaggtgccccaggacaccctgagcctgctgctgggccccctgggcgagctgaagagccacggcttcgacaccctgctgcagaacctgcacgaggacctgaagcccctgttcaagagattcacccacaccagatgggccgcccccgtggagaccctggagaacatcatcgccaccgtggacaccagactgcccgagttcagcgagctgcagggctgcttcagagaggagctgatggaggccctgcacctgcacctggtgaaggagtacatcatccagctgagcaagggcagactggtgctgaagaccgccgagcagcagcagcagctggccggctacatcctggccaacgccgacaccatccagcacttctgcacccagcacggcagccccgccacctggctgcagcccgccctgcccaccctggccgagatcatcagactgcaggaccccagcgccatcaagatcgaggtggccacctacgccacctgctaccccgacttcagcaagggccacctgagcgccatcctggccatcaagggcaacctgagcaacagcgaggtgaagagaatcagaagcatcctggacgtgagcatgggcgcccaggagcccagcagacccctgttcagcctgatcaaggtgggctag

SEQ ID NO: 104080 - DNA, 972 bp, Artificial Sequence
  Description of Artificial Sequence: Synthetic coding sequence
atggacagagccctggagctggaggccagaagatgggccgaggacgtgcccccccagagactggacggccactgccacagcgagctggccatcgacatcatccagatcaccagccaggcccaggccaaggccgagagcatcaccctggacctgggcagccagatcaagagagtgctgctggtggagctgcccgccttcctgagaagctaccagagagccttcaacgagttcctggagagaggcaagcagctgaccaactacagagccaacgtgatcgccaacatcaacaactgcctgagcttcagaatgagcatggagcagaactggcaggtgccccaggacaccctgagcctgctgctgggccccctgggcgagctgaagagccacggcttcgacaccctgctgcagaacctgcacgaggacctgaagcccctgttcaagagattcacccacaccagatgggccgcccccgtggagaccctggagaacatcatcgccaccgtggacaccagactgcccgagttcagcgagctgcagggctgcttcagagaggagctgatggaggccctgcacctgcacctggtgaaggagtacatcatccagctgagcaagggcagactggtgctgaagaccgccgagcagcagcagcagctggccggctacatcctggccaacgccgacaccatccagcacttctgcacccagcacggcagccccgccacctggctgcagcccgccctgcccaccctggccgagatcatcagactgcaggaccccagcgccatcaagatcgaggtggccacctacgccacctgctaccccgacttcagcaagggccacctgagcgccatcctggccatcaagggcaacctgagcaacagcgaggtgaagagaatcagaagcatcctggacgtgagcatgggcgcccaggagcccagcagacccctgttcagcctgatcaaggtgggctag

SEQ ID NO: 104081 - DNA, 600 bp, Artificial Sequence
  Description of Artificial Sequence: Synthetic coding sequence
atggaggccctgcacctgcacctggtgaaggagtacatcatccagctgagcaagggcagactggtgctgaagaccgccgagcagcagcagcagctggccggctacatcctggccaacgccgacaccatccagcacttctgcacccagcacggcagccccgccacctggctgcagcccgccctgcccaccctggccgagatcatcagactgcaggaccccagcgccatcaagatcgaggtggccacctacgccacctgctaccccgacttcagcaagggccacctgagcgccatcctggccatcaagggcaacctgagcaacagcgaggtgaagagaatcagaagcatcctggacgtgagcatgggcgcccaggagcccagcagacccctgttcagcctgatcaagcccagagccgccgtgagcggcatccagcagtggtggaacggcagacagaactggaagagaaagaaggagaagatgagcagcagactggccggcgccttcagagtgctgtggagagccgtgagcaccgccagcatcagaagacacatccaggtggcccccagacccctgcaggccggccccgccatgggcccctag

SEQ ID NO: 104082 - DNA, 120 bp, Artificial Sequence
  Description of Artificial Sequence: Synthetic coding sequence
atgagcgaggccagcagcgaggacctggtgccccccctggaggccggcgccgccccctacagagaggaggaggaggccgccaagaagaagaaggagaagaagaagaagagcaagggctag

SEQ ID NO: 104083 - DNA, 1965 bp, Artificial Sequence; identical to SEQ ID NO: 104079
  Description of Artificial Sequence: Synthetic coding sequence

SEQ ID NO: 104084 - DNA, 2373 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagaaactggaacgacgagtgggacaacctgatcaagatggccagcaccgacacccccatggccagaagcggcctgcagtacaacagcctggaggagatccacatcttcgtgctgtgcaacatcctgagaagacccatcatcgtgatcagcgacaagatgctgagaagcctggagagcggcagcaacttcgcccccctgaaggtgggcggcatctacctgcccctgcactggcccgcccaggagtgctacagataccccatcgtgctgggctacgacagccaccacttcgtgcccctggtgaccctgaaggacagcggccccgagatcagagccgtgcccctggtgaacagagacagaggcagattcgaggacctgaaggtgcacttcctgaccgaccccgagaacgagatgaaggagaagctgctgaaggagtacctgatggtgatcgagatccccgtgcagggctgggaccacggcaccacccacctgatcaacgccgccaagctggacgaggccaacctgcccaaggagatcaacctggtggacgactacttcgagctggtgcagcacgagtacaagaagtggcaggagaacagcgagcagggcagaagagagggccacgcccagaaccccatggagcccagcgtgccccagctgagcctgatggacgtgaagtgcgagacccccaactgccccttcttcatgagcgtgaacacccagcccctgtgccacgagtgcagcgagagaagacagaagaaccagaacaagctgcccaagctgaacagcaagcccggccccgagggcctgcccggcatggccctgggcgccagcagaggcgaggcctacgagcccctggcctggaaccccgaggagagcaccggcggcccccacagcgccccccccaccgcccccagccccttcctgttcagcgagaccaccgccatgaagtgcagaagccccggctgccccttcaccctgaacgtgcagcacaacggcttctgcgagagatgccacaacgccagacagctgcacgccagccacgcccccgaccacaccagacacctggaccccggcaagtgccaggcctgcctgcaggacgtgaccagaaccttcaacggcatctgcagcacctgcttcaagagaaccaccgccgaggccagcagcagcctgagcaccagcctgccccccagctgccaccagagaagcaagagcgaccccagcagactggtgagaagccccagcccccacagctgccacagagccggcaacgacgcccccgccggctgcctgagccaggccgccagaacccccggcgacagaaccggcaccagcaagtgcagaaaggccggctgcgtgtacttcggcacccccgagaacaagggcttctgcaccctgtgcttcatcgagtacagagagaacaagcacttcgccgccgccagcggcaaggtgagccccaccgccagcagattccagaacaccatcccctgcctgggcagagagtgcggcaccctgggcagcaccatgttcgagggctactgccagaagtgcttcatcgaggcccagaaccagagattccacgaggccaagagaaccgaggagcagctgagaagcagccagagaagagacgtgcccagaaccacccagagcaccagcagacccaagtgcgccagagccagctgcaagaacatcctggcctgcagaagcgaggagctgtgcatggagtgccagcaccccaaccagagaatgggccccggcgcccacagaggcgagcccgcccccgaggacccccccaagcagagatgcagagcccccgcctgcgaccacttcggcaacgccaagtgcaacggctactgcaacgagtgcttccagttcaagcagatgtacggctag

SEQ ID NO: 104085 - DNA, 489 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagatag

SEQ ID NO: 104086 - DNA, 81 bp, Artificial Sequence
  Description of Artificial Sequence: Synthetic coding sequence
atggccgagcaggtgctgccccaggccctgtacctgagcaacatgagaaaggccgtgaagatcagagagagaaccccctag

SEQ ID NO: 104087 - DNA, 297 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaactag

SEQ ID NO: 104088 - DNA, 813 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagaaactggaacgacgagtgggacaacctgatcaagatggccagcaccgacacccccatggccagaagcggcctgcagtacaacagcctggaggagatccacatcttcgtgctgtgcaacatcctgagaagacccatcatcgtgatcagcgacaagatgctgagaagcctggagagcggcagcaacttcgcccccctgaaggtgggcggcatctacctgcccctgcactggcccgcccaggagtgctacagataccccatcgtgctgggctacgacagccaccacttcgtgcccctggtgaccctgaaggacagcggccccgacatctag

SEQ ID NO: 104089 - DNA, 2250 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagaaactggaacgacgagtgggacaacctgatcaagatggccagcaccgacacccccatggccagaagcggcctgcagtacaacagcctggaggagatccacatcttcgtgctgtgcaacatcctgagaagacccatcatcgtgatcagcgacaagatgctgagaagcctggagagcggcagcaacttcgcccccctgaaggtgggcggcatctacctgcccctgcactggcccgcccaggagtgctacagataccccatcgtgctgggctacgacagccaccacttcgtgcccctggtgaccctgaaggacagcggccccgagatcagagccgtgcccctggtgaacagagacagaggcagattcgaggacctgaaggtgcacttcctgaccgaccccgagaacgagatgaaggagaagctgctgaaggagtacctgatggtgatcgagatccccgtgcagggctgggaccacggcaccacccacctgatcaacgccgccaagctggacgaggccaacctgcccaaggagatcaacctggtggacgactacttcgagctggtgcagcacgagtacaagaagtggcaggagaacagcgagcagggcagaagagagggccacgcccagaaccccatggagcccagcgtgccccagctgagcctgatggacgtgaagtgcgagacccccaactgccccttcttcatgagcgtgaacacccagcccctgtgccacgagtgcagcgagagaagacagaagaaccagaacaagctgcccaagctgaacagcaagcccggccccgagggcctgcccggcatggccctgggcgccagcagaggcgaggcctacgagcccctggcctggaaccccgaggagagcaccggcggcccccacagcgccccccccaccgcccccagccccttcctgttcagcgagaccaccgccatgaagtgcagaagccccggctgccccttcaccctgaacgtgcagcacaacggcttctgcgagagatgccacaacgccagacagctgcacgccagccacgcccccgaccacaccagacacctggaccccggcaagtgccaggcctgcctgcaggacgtgaccagaaccttcaacggcatctgcagcacctgcttcaagagaaccaccgccgaggccagcagcagcctgagcaccagcctgccccccagctgccaccagagaagcaagagcgaccccagcagactggtgagaagccccagcccccacagctgccacagagccggcaacgacgcccccgccggctgcctgagccaggccgccagaacccccggcgacagaaccggcaccagcaagtgcagaaaggccggctgcgtgtacttcggcacccccgagaacaagggcttctgcaccctgtgcttcatcgagtacagagagaacaagcacttcgccgccgccagcggcaaggtgagccccaccgccagcagattccagaacaccatcccctgcctgggcagagagtgcggcaccctgggcagcaccatgttcgagggctactgccagaagtgcttcatcgaggcccagaaccagagattccacgaggccaagagaaccgaggagcagctgagaagcagccagagaagagacgtgcccagaaccacccagagcaccagcagacccaagtgcgccagagccagctgcaagaacatcctggcctgcagaagcgaggagctgtgcatggagtgccagcaccagcccgaggacggcccctggggcccccccggctag

SEQ ID NO: 104090 - DNA, 459 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagccagatcagcggcatctgctag

SEQ ID NO: 104091 - DNA, 645 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagaaactggaacgacgagtgggacaacctgatcaagtggctgccccagacccacccctggcccgaggtggacttcagcaccacccactggaagaagtacacctacctgagcttcgccaccagcagcgagggccagagcctgagcttccagaccaagtgctag

SEQ ID NO: 104092 - DNA, 2010 bp, Artificial Sequence
  Description of Artificial Sequence: Synthetic coding sequence
atggccgagcaggtgctgccccaggccctgtacctgagcaacatgagaaaggccgtgaagatcagagagagaacccccgaggacatcttcaagcccaccaacggcatcatccaccacttcaagaccatgcacagatacaccctggagatgttcagaacctgccagttctgcccccagttcagagagatcatccacaaggccctgatcgacagaaacatccaggccaccctggagagccagaagaagctgaactggtgcagagaggtgagaaagctggtggccctgaagaccaacggcgacggcaactgcctgatgcacgccaccagccagtacatgtggggcgtgcaggacaccgacctggtgctgagaaaggccctgttcagcaccctgaaggagaccgacaccagaaacttcaagttcagatggcagctggagagcctgaagagccaggagttcgtggagaccggcctgtgctacgacaccagaaactggaacgacgagtgggacaacctgatcaagatggccagcaccgacacccccatggccagaagcggcctgcagtacaacagcctggaggagatccacatcttcgtgctgtgcaacatcctgagaagacccatcatcgtgatcagcgacaagatgctgagaagcctggagagcggcagcaacttcgcccccctgaaggtgggcggcatctacctgcccctgcactggcccgcccaggagtgctacagataccccatcgtgctgggctacgacagccaccacttcgtgcccctggtgaccctgaaggacagcggccccgagatcagagccgtgcccctggtgaacagagacagaggcagattcgaggacctgaaggtgcacttcctgaccgaccccgagaacgagatgaaggagaagctgctgaaggagtacctgatggtgatcgagatccccgtgcagggctgggaccacggcaccacccacctgatcaacgccgccaagctggacgaggccaacctgcccaaggagatcaacctggtggacgactacttcgagctggtgcagcacgagtacaagaagtggcaggagaacagcgagcagggcagaagagagggccacgcccagaaccccatggagcccagcgtgccccagctgagcctgatggacgtgaagtgcgagacccccaactgccccttcttcatgagcgtgaacacccagcccctgtgccacgagtgcagcgagagaagacagaagaaccagaacaagctgcccaagctgaacagcaagcccggccccgagggcctgcccggcatggccctgggcgccagcagaggcgaggcctacgagcccctggcctggaaccccgaggagagcaccggcggcccccacagcgccccccccaccgcccccagccccttcctgttcagcgagaccaccgccatgaagtgcagaagccccggctgccccttcaccctgaacgtgcagcacaacggcttctgcgagagatgccacaacgccagacagctgcacgccagccacgcccccgaccacaccagacacctggaccccggcaagtgccaggcctgcctgcaggacgtgaccagaaccttcaacggcatctgcagcacctgcttcaagagaaccaccgccgaggccagcagcagcctgagcaccagcctgccccccagctgccaccagagaagcaagagcgaccccagcagactggtgagaagccccagcccccacagctgccacagagccggcaacgacgcccccgccggctgcctgagccaggccgccagaacccccggcgacagaaccggcaccagcaagtgcagaaaggccggctgcgtgtacttcggcacccccgagaacaagggcttctgcaccctgttccacagagtgcagagaaagcagaccttctgctgctgcctgagagagagccagagccacagcgtgcaggtgcccgagcaccacagcgtgcccggcgagggcatgagacacccctggaagcaccacgtgtag

SEQ ID NO: 104093 - DNA, 834 bp, Artificial Sequence
  Description of Artificial Sequence: Synthetic coding sequence
atgatcatcctgatctacctgttcctgctgctgtgggaggacacccagggctggggcttcaaggacggcatcttccacaacagcatctggctggagagagccgccggcgtgtaccacagagaggccagaagcggcaagtacaagctgacctacgccgaggccaaggccgtgtgcgagttcgagggcggccacctggccacctacaagcagctggaggccgccagaaagatcggcttccacgtgtgcgccgccggctggatggccaagggcagagtgggctaccccatcgtgaagcccggccccaactgcggcttcggcaagaccggcatcatcgactacggcatcagactgaacagaagcgagagatgggacgcctactgctacaacccccacgccaaggagtgcggcggcgtgttcaccgaccccaagcagatcttcaagagccccggcttccccaacgagtacgaggacaaccagatctgctactggcacatcagactgaagtacggccagagaatccacctgagcttcctggacttcgacctggaggacgaccccggctgcctggccgactacgtggagatctacgacagctacgacgacgtgcacggcttcgtgggcagatactgcggcgacgagctgcccgacgacatcatcagcaccggcaacgtgatgaccctgaagttcctgagcgacgccagcgtgaccgccggcggcttccagatcaagtacgtggccatggaccccgtgagcaagagcagccagggcaagaacaccagcaccaccagcaccggcaacaagaacttcctggccggcagattcagccacctgtag

SEQ ID NO: 104094 - DNA, 567 bp, Artificial Sequence
  Description of Artificial Sequence: Synthetic coding sequence
atggccaccgacgtgttcaacagcaagaacctggccgtgcaggcccagaagaagatcctgggcaagatggtgagcaagagcatcgccaccaccctgatcgacgacaccagcagcgaggtgctggacgagctgtacagagtgaccagagagtacacccagaacaagaaggaggccgagaagatcatcaagaacctgatcaagaccgtgatcaagctggccatcctgtacagaaacaaccagttcaaccaggacgagctggccctgatggagaagttcaagaagaaggtgcaccagctggccatgaccgtggtgagcttccaccaggtggactacaccttcgacagaaacgtgctgagcagactgctgaacgagtgcagagagatgctgcaccagatcatccagagacacctgaccgccaagagccacggcagagtgaacaacgtgttcgaccacttcagcgactgcgagttcctggccgccctgtacaaccccttcggcaacttcaagccccacctgcagaagctgtgcgacggcatcaacaagatgctggacgaggagaacatctag

SEQ ID NO: 104095 - DNA, 597 bp, Artificial Sequence
  Description of Artificial Sequence: Synthetic coding sequence
atgcacagcgaggccgaggagagcaaggaggtggccaccgacgtgttcaacagcaagaacctggccgtgcaggcccagaagaagatcctgggcaagatggtgagcaagagcatcgccaccaccctgatcgacgacaccagcagcgaggtgctggacgagctgtacagagtgaccagagagtacacccagaacaagaaggaggccgagaagatcatcaagaacctgatcaagaccgtgatcaagctggccatcctgtacagaaacaaccagttcaaccaggacgagctggccctgatggagaagttcaagaagaaggtgcaccagctggccatgaccgtggtgagcttccaccaggtggactacaccttcgacagaaacgtgctgagcagactgctgaacgagtgcagagagatgctgcaccagatcatccagagacacctgaccgccaagagccacggcagagtgaacaacgtgttcgaccacttcagcgactgcgagttcctggccgccctgtacaaccccttcggcaacttcaagccccacctgcagaagctgtgcgacggcatcaacaagatgctggacgaggagaacatctag

SEQ ID NO: 104096 - DNA, 597 bp, Artificial Sequence; identical to SEQ ID NO: 104095
  Description of Artificial Sequence: Synthetic coding sequence

SEQ ID NO: 104097 - DNA, 555 bp, Artificial Sequence
  Description of Artificial Sequence: Synthetic coding sequence
atggagagcttcagcagcaagagcctggccctgcaggccgagaagaagctgctgagcaagatggccggcagaagcgtggcccacctgttcatcgacgagaccagcagcgaggtgctggacgagctgtacagagtgagcaaggagtacacccacagcagaccccaggcccagagagtgatcaaggacctgatcaaggtggccatcaaggtggccgtgctgcacagaaacggcagcttcggccccagcgagctggccctggccaccagattcagacagaagctgagacagggcgccatgaccgccctgagcttcggcgaggtggacttcaccttcgaggccgccgtgctggccggcctgctgaccgagtgcagagacgtgctgctggagctggtggagcaccacctgacccccaagagccacggcagaatcagacacgtgttcgaccacttcagcgaccccggcctgctgaccgccctgtacggccccgacttcacccagcacctgggcaagatctgcgacggcctgagaaagctgctggacgagggcaagctgtag

SEQ ID NO: 104098 - DNA, 1296 bp, Artificial Sequence
  Description of Artificial Sequence: Synthetic coding sequence
atgtacagaaccaaggtgggcctgaaggacagacagcagctgtacaagctgatcatcagccagctgctgtacgacggctacatcagcatcgccaacggcctgatcaacgagatcaagccccagagcgtgtgcgcccccagcgagcagctgctgcacctgatcaagctgggcatggagaacgacgacaccgccgtgcagtacgccatcggcagaagcgacaccgtggcccccggcaccggcatcgacctggagttcgacgccgacgtgcagaccatgagccccgaggccagcgagtacgagacctgctacgtgaccagccacaagggcccctgcagagtggccacctacagcagagacggccagctgatcgccaccggcagcgccgacgccagcatcaagatcctggacaccgagagaatgctggccaagagcgccatgcccatcgaggtgatgatgaacgagaccgcccagcagaacatggagaaccaccccgtgatcagaaccctgtacgaccacgtggacgaggtgacctgcctggccttccaccccaccgagcagatcctggccagcggcagcagagactacaccctgaagctgttcgactacagcaagcccagcgccaagagagccttcaagtacatccaggaggccgagatgctgagaagcatcagcttccaccccagcggcgacttcatcctggtgggcacccagcaccccaccctgagactgtacgacatcaacaccttccagtgcttcgtgagctgcaacccccaggaccagcacaccgacgccatctgcagcgtgaactacaacagcagcgccaacatgtacgtgaccggcagcaaggacggctgcatcaagctgtgggacggcgtgagcaacagatgcatcaccaccttcgagaaggcccacgacggcgccgaggtgtgcagcgccatcttcagcaagaacagcaagtacatcctgagcagcggcaaggacagcgtggccaagctgtgggagatcagcaccggcagaaccctggtgagatacaccggcgccggcctgagcggcagacaggtgcacagaacccaggccgtgttcaaccacaccgaggactacgtgctgctgcccgacgagagaaccatcagcctgtgctgctgggacagcagaaccgccgagagaagaaacctgctgagcctgggccacaacaacatcgtgagatgcatcgtgcacagccccaccaaccccggcttcatgacctgcagcgacgacttcagagccagattctggtacagaagaagcaccaccgactag

SEQ ID NO: 104099 - DNA, 621 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacgtgaagaccagcgagaagctgggcgagtggaacgagaaggtgacccagagcgacctgtacaagaagacccaggagaccctgagccaggccggccagaagaccagcgccgccctgagcaccgtgggcagcgccatcagcagaaagctgggcgacatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104100 - DNA, 561 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacaagaagacccaggagaccctgagccaggccggccagaagaccagcgccgccctgagcaccgtgggcagcgccatcagcagaaagctgggcgacatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104101 - DNA, 630 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacaagaagacccaggagaccctgagccaggccggccagaagaccagcgccgccctgagcaccgtgggcagcgccatcagcagaaagctgggcgacatgagagcccaccccttcagccacagcttcagcagctacagcatcagacacagcatcagcatgcccgccatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104102 - DNA, 663 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacgtgaagaccagcgagaagctgggcgagtggaacgagaaggtgacccagagcgacctgtacaagaagacccaggagaccctgagccaggccggccagaagaccagcgccgccctgagcaccgtgggcagcgccatcagcagaaagctgggcgacatgagcagctacagcatcagacacagcatcagcatgcccgccatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104103 - DNA, 603 bp, Artificial Sequence
  Description of Artificial Sequence: Synthetic coding sequence
atggacagcgccggccaggacatcaacctgaacagccccaacaagggcctgctgagcgacagcatgaccgacgtgcccgtggacaccggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacaagaagacccaggagaccctgagccaggccggccagaagaccagcgccgccctgagcaccgtgggcagcgccatcagcagaaagctgggcgacatgagcagctacagcatcagacacagcatcagcatgcccgccatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104104 - DNA, 492 bp, Artificial Sequence
  Description of Artificial Sequence: Synthetic coding sequence
atggacagcgccggccagggcgtggccgccagaacccccgccgtggagggcctgaccgaggccgaggaggaggagctgagagccgagctgaccaaggtggaggaggagatcgtgaccctgagacaggtgctggccgccaaggagagacactgcggcgagctgaagagaagactgggcctgagcaccctgggcgagctgaagcagaacctgagcagaagctggcacgacgtgcaggtgagcagcgcctacaagaagacccaggagaccctgagccaggccggccagaagaccagcgccgccctgagcaccgtgggcagcgccatcagcagaaagctgggcgacatgagaaacagcgccaccttcaagagcttcgaggacagagtgggcaccatcaagagcaaggtggtgggcgacagagagaacggcagcgacaacctgcccagcagcgccggcagcggcgacaagcccctgagcgaccccgcccccttctag

SEQ ID NO: 104105 - DNA, 3405 bp, Artificial Sequence
  Description of Artificial Sequence: Synthetic coding sequence
atgagattcggcagcaagatgatgcccatgttcctgaccgtgtacctgagcaacaacgagcagcacttcaccgaggtgcccgtgacccccgagaccatctgcagagacgtggtggacctgtgcaaggagcccggcgagagcgactgccacctggccgaggtgtggtgcggcagcgagagacccgtggccgacaacgagagaatgttcgacgtgctgcagagattcggcagccagagaaacgaggtgagattcttcctgagacacgagagaccccccggcagagacatcgtgagcggccccagaagccaggaccccagcctgaagagaaacggcgtgaaggtgcccggcgagtacagaagaaaggagaacggcgtgaacagccccagaatggacctgaccctggccgagctgcaggagatggccagcagacagcagcagcagatcgaggcccagcagcagctgctggccaccaaggagcagagactgaagttcctgaagcagcaggaccagagacagcagcagcaggtggccgagcaggagaagctgaagagactgaaggagatcgccgagaaccaggaggccaagctgaagaaggtgagagccctgaagggccacgtggagcagaagagactgagcaacggcaagctggtggaggagatcgagcagatgaacaacctgttccagcagaagcagagagagctggtgctggccgtgagcaaggtggaggagctgaccagacagctggagatgctgaagaacggcagaatcgacagccaccacgacaaccagagcgccgtggccgagctggacagactgtacaaggagctgcagctgagaaacaagctgaaccaggagcagaacgccaagctgcagcagcagagagagtgcctgaacaagagaaacagcgaggtggccgtgatggacaagagagtgaacgagctgagagacagactgtggaagaagaaggccgccctgcagcagaaggagaacctgcccgtgagcagcgacggcaacctgccccagcaggccgccagcgcccccagcagagtggccgccgtgggcccctacatccagagcagcaccatgcccagaatgcccagcagacccgagctgctggtgaagcccgccctgcccgacggcagcctggtgatccaggccagcgagggccccatgaagatccagaccctgcccaacatgagaagcggcgccgccagccagaccaagggcagcaagatccaccccgtgggccccgactggagccccagcaacgccgacctgttccccagccagggcagcgccagcgtgccccagagcaccggcaacgccctggaccaggtggacgacggcgaggtgcccctgagagagaaggagaagaaggtgagacccttcagcatgttcgacgccgtggaccagagcaacgccccccccagcttcggcaccctgagaaagaaccagagcagcgaggacatcctgagagacgcccaggtggccaacaagaacgtggccaaggtgcccccccccgtgcccaccaagcccaagcagatcaacctgccctacttcggccagaccaaccagccccccagcgacatcaagcccgacggcagcagccagcagctgagcaccgtggtgcccagcatgggcaccaagcccaagcccgccggccagcagcccagagtgctgctgagccccagcatccccagcgtgggccaggaccagaccctgagccccggcagcaagcaggagagcccccccgccgccgccgtgagacccttcaccccccagcccagcaaggacaccctgctgccccccttcagaaagccccagaccgtggccgccagcagcatctacagcatgtacacccagcagcaggcccccggcaagaacttccagcaggccgtgcagagcgccctgaccaagacccacaccagaggcccccacttcagcagcgtgtacggcaagcccgtgatcgccgccgcccagaaccagcagcagcaccccgagaacatctacagcaacagccagggcaagcccggcagccccgagcccgagaccgagcccgtgagcagcgtgcaggagaaccacgagaacgagagaatccccagacccctgagccccaccaagctgctgcccttcctgagcaacccctacagaaaccagagcgacgccgacctggaggccctgagaaagaagctgagcaacgcccccagacccctgaagaagagaagcagcatcaccgagcccgagggccccaacggccccaacatccagaagctgctgtaccagagaaccaccatcgccgccatggagaccatcagcgtgcccagctaccccagcaagagcgccagcgtgaccgccagcagcgagagccccgtggagatccagaacccctacctgcacgtggagcccgagaaggaggtggtgagcctggtgcccgagagcctgagccccgaggacgtgggcaacgccagcaccgagaacagcgacatgcccgcccccagccccggcctggactacgagcccgagggcgtgcccgacaacagccccaacctgcagaacaaccccgaggagcccaaccccgaggccccccacgtgctggacgtgtacctggaggagtaccccccctaccccccccccccctaccccagcggcgagcccgagggccccggcgaggacagcgtgagcatgagaccccccgagatcaccggccaggtgagcctgccccccggcaagagaaccaacctgagaaagaccggcagcgagagaatcgcccacggcatgagagtgaagttcaaccccctggccctgctgctggacagcagcctggagggcgagttcgacctggtgcagagaatcatctacgaggtggacgaccccagcctgcccaacgacgagggcatcaccgccctgcacaacgccgtgtgcgccggccacaccgagatcgtgaagttcctggtgcagttcggcgtgaacgtgaacgccgccgacagcgacggctggacccccctgcactgcgccgccagctgcaacaacgtgcaggtgtgcaagttcctggtggagagcggcgccgccgtgttcgccatgacctacagcgacatgcagaccgccgccgacaagtgcgaggagatggaggagggctacacccagtgcagccagttcctgtacggcgtgcaggagaagatgggcatcatgaacaagggcgtgatctacgccctgtgggactacgagccccagaacgacgacgagctgcccatgaaggagggcgactgcatgaccatcatccacagagaggacgaggacgagatcgagtggtggtgggccagactgaacgacaaggagggctacgtgcccagaaacctgctgggcctgtaccccagaatcaagcccagacagagaagcctggcctag

SEQ ID NO: 104106 - DNA, 3018 bp, Artificial Sequence
  Description of Artificial Sequence: Synthetic coding sequence
atggacctgaccctggccgagctgcaggagatggccagcagacagcagcagcagatcgaggcccagcagcagctgctggccaccaaggagcagagactgaagttcctgaagcagcaggaccagagacagcagcagcaggtggccgagcaggagaagctgaagagactgaaggagatcgccgagaaccaggaggccaagctgaagaaggtgagagccctgaagggccacgtggagcagaagagactgagcaacggcaagctggtggaggagatcgagcagatgaacaacctgttccagcagaagcagagagagctggtgctggccgtgagcaaggtggaggagctgaccagacagctggagatgctgaagaacggcagaatcgacagccaccacgacaaccagagcgccgtggccgagctggacagactgtacaaggagctgcagctgagaaacaagctgaaccaggagcagaacgccaagctgcagcagcagagagagtgcctgaacaagagaaacagcgaggtggccgtgatggacaagagagtgaacgagctgagagacagactgtggaagaagaaggccgccctgcagcagaaggagaacctgcccgtgagcagcgacggcaacctgccccagcaggccgccagcgcccccagcagagtggccgccgtgggcccctacatccagagcagcaccatgcccagaatgcccagcagacccgagctgctggtgaagcccgccctgcccgacggcagcctggtgatccaggccagcgagggccccatgaagatccagaccctgcccaacatgagaagcggcgccgccagccagaccaagggcagcaagatccaccccgtgggccccgactggagccccagcaacgccgacctgttccccagccagggcagcgccagcgtgccccagagcaccggcaacgccctggaccaggtggacgacggcgaggtgcccctgagagagaaggagaagaaggtgagacccttcagcatgttcgacgccgtggaccagagcaacgccccccccagcttcggcaccctgagaaagaaccagagcagcgaggacatcctgagagacgcccaggtggccaacaagaacgtggccaaggtgcccccccccgtgcccaccaagcccaagcagatcaacctgccctacttcggccagaccaaccagccccccagcgacatcaagcccgacggcagcagccagcagctgagcaccgtggtgcccagcatgggcaccaagcccaagcccgccggccagcagcccagagtgctgctgagccccagcatccccagcgtgggccaggaccagaccctgagccccggcagcaagcaggagagcccccccgccgccgccgtgagacccttcaccccccagcccagcaaggacaccctgctgccccccttcagaaagccccagaccgtggccgccagcagcatctacagcatgtacacccagcagcaggcccccggcaagaacttccagcaggccgtgcagagcgccctgaccaagacccacaccagaggcccccacttcagcagcgtgtacggcaagcccgtgatcgccgccgcccagaaccagcagcagcaccccgagaacatctacagcaacagccagggcaagcccggcagccccgagcccgagaccgagcccgtgagcagcgtgcaggagaaccacgagaacgagagaatccccagacccctgagccccaccaagctgctgcccttcctgagcaacccctacagaaaccagagcgacgccgacctggaggccctgagaaagaagctgagcaacgcccccagacccctgaagaagagaagcagcatcaccgagcccgagggccccaacggccccaacatccagaagctgctgtaccagagaaccaccatcgccgccatggagaccatcagcgtgcccagctaccccagcaagagcgccagcgtgaccgccagcagcgagagccccgtggagatccagaacccctacctgcacgtggagcccgagaaggaggtggtgagcctggtgcccgagagcctgagccccgaggacgtgggcaacgccagcaccgagaacagcgacatgcccgcccccagccccggcctggactacgagcccgagggcgtgcccgacaacagccccaacctgcagaacaaccccgaggagcccaaccccgaggccccccacgtgctggacgtgtacctggaggagtaccccccctaccccccccccccctaccccagcggcgagcccgagggccccggcgaggacagcgtgagcatgagaccccccgagatcaccggccaggtgagcctgccccccggcaagagaaccaacctgagaaagaccggcagcgagagaatcgcccacggcatgagagtgaagttcaaccccctggccctgctgctggacagcagcctggagggcgagttcgacctggtgcagagaatcatctacgaggtggacgaccccagcctgcccaacgacgagggcatcaccgccctgcacaacgccgtgtgcgccggccacaccgagatcgtgaagttcctggtgcagttcggcgtgaacgtgaacgccgccgacagcgacggctggacccccctgcactgcgccgccagctgcaacaacgtgcaggtgtgcaagttcctggtggagagcggcgccgccgtgttcgccatgacctacagcgacatgcagaccgccgccgacaagtgcgaggagatggaggagggctacacccagtgcagccagttcctgtacggcgtgcaggagaagatgggcatcatgaacaagggcgtgatctacgccctgtgggactacgagccccagaacgacgacgagctgcccatgaaggagggcgactgcatgaccatcatccacagagaggacgaggacgagatcgagtggtggtgggccagactgaacgacaaggagggctacgtgcccagaaacctgctgggcctgtaccccagaatcaagcccagacagagaagcctggcctag

SEQ ID NO: 104107 - DNA, 1104 bp, Artificial Sequence
  Description of Artificial Sequence: Synthetic coding sequence
atggagaccatcagcgtgcccagctaccccagcaagagcgccagcgtgaccgccagcagcgagagccccgtggagatccagaacccctacctgcacgtggagcccgagaaggaggtggtgagcctggtgcccgagagcctgagccccgaggacgtgggcaacgccagcaccgagaacagcgacatgcccgcccccagccccggcctggactacgagcccgagggcgtgcccgacaacagccccaacctgcagaacaaccccgaggagcccaaccccgaggccccccacgtgctggacgtgtacctggaggagtaccccccctaccccccccccccctaccccagcggcgagcccgagggccccggcgaggacagcgtgagcatgagaccccccgagatcaccggccaggtgagcctgccccccggcaagagaaccaacctgagaaagaccggcagcgagagaatcgcccacggcatgagagtgaagttcaaccccctggccctgctgctggacagcagcctggagggcgagttcgacctggtgcagagaatcatctacgaggtggacgaccccagcctgcccaacgacgagggcatcaccgccctgcacaacgccgtgtgcgccggccacaccgagatcgtgaagttcctggtgcagttcggcgtgaacgtgaacgccgccgacagcgacggctggacccccctgcactgcgccgccagctgcaacaacgtgcaggtgtgcaagttcctggtggagagcggcgccgccgtgttcgccatgacctacagcgacatgcagaccgccgccgacaagtgcgaggagatggaggagggctacacccagtgcagccagttcctgtacggcgtgcaggagaagatgggcatcatgaacaagggcgtgatctacgccctgtgggactacgagccccagaacgacgacgagctgcccatgaaggagggcgactgcatgaccatcatccacagagaggacgaggacgagatcgagtggtggtgggccagactgaacgacaaggagggctacgtgcccagaaacctgctgggcctgtaccccagaatcaagcccagacagagaagcctggcctag

SEQ ID NO: 104108 - DNA, 2043 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104109 - DNA, 1533 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacagaagcggcaagagcgagaacccctag

SEQ ID NO: 104110 - DNA, 1761 bp, Artificial Sequence
  Description of Artificial Sequence: Synthetic coding sequence
atgctgtacctggagaacaacgcccagacccagttcagcgagccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104111 - DNA, 1788 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggtacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104112 - DNA, 1668 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagaatctggcaggtgtag

SEQ ID NO: 104113 - DNA, 1251 bp, Artificial Sequence
  Description of Artificial Sequence: Synthetic coding sequence
atgctgtacctggagaacaacgcccagacccagttcagcgagccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacagaagcggcaagagcgagaacccctag

SEQ ID NO: 104114 - DNA, 1386 bp, Artificial Sequence
  Description of Artificial Sequence: Synthetic coding sequence
atgctgtacctggagaacaacgcccagacccagttcagcgagccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagaatctggcaggtgtag

SEQ ID NO: 104115 - DNA, 1464 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcacctgctgagcgcctgcttcagaaacgagctggtggagcccagaagagagacccccaagcagagcgacgtgttcttcagacacagcaagccccccaacagaagcgtgtacccctag

SEQ ID NO: 104116 - DNA, 1182 bp, Artificial Sequence
  Description of Artificial Sequence: Synthetic coding sequence
atgctgtacctggagaacaacgcccagacccagttcagcgagccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcacctgctgagcgcctgcttcagaaacgagctggtggagcccagaagagagacccccaagcagagcgacgtgttcttcagacacagcaagccccccaacagaagcgtgtacccctag

SEQ ID NO: 104117 - DNA, 2031 bp, Artificial Sequence
  Description of Artificial Sequence: Synthetic coding sequence
atgaacttcgagaccagcagatgcgccaccctgcagtactgccccgacccctacatccagagattcgtggagacccccgcccacttcagctggaaggagagctactacagaagcaccatgagccagagcacccagaccaacgagttcctgagccccgaggtgttccagcacatctgggacttcctggagcagcccatctgcagcgtgcagcccatcgacctgaacttcgtggacgagcccagcgaggacggcgccaccaacaagatcgagatcagcatggactgcatcagaatgcaggacagcgacctgagcgaccccatgtggccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacgccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104118 - DNA, 1506 bp, Artificial Sequence
  Description of Artificial Sequence: Synthetic coding sequence
atgctgtacctggagaacaacgcccagacccagttcagcgagtacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacggcaccaagagacccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104119 - DNA, 1749 bp, Artificial Sequence
  Description of Artificial Sequence: Synthetic coding sequence
atgctgtacctggagaacaacgcccagacccagttcagcgagccccagtacaccaacctgggcctgctgaacagcatggaccagcagatccagaacggcagcagcagcaccagcccctacaacaccgaccacgcccagaacagcgtgaccgcccccagcccctacgcccagcccagcagcaccttcgacgccctgagccccagccccgccatccccagcaacaccgactaccccggcccccacagcttcgacgtgagcttccagcagagcagcaccgccaagagcgccacctggacctacagcaccgagctgaagaagctgtactgccagatcgccaagacctgccccatccagatcaaggtgatgaccccccccccccagggcgccgtgatcagagccatgcccgtgtacaagaaggccgagcacgtgaccgaggtggtgaagagatgccccaaccacgagctgagcagagagttcaacgagggccagatcgccccccccagccacctgatcagagtggagggcaacagccacgcccagtacgtggaggaccccatcaccggcagacagagcgtgctggtgccctacgagcccccccaggtgggcaccgagttcaccaccgtgctgtacaacttcatgtgcaacagcagctgcgtgggcggcatgaacagaagacccatcctgatcatcgtgaccctggagaccagagacggccaggtgctgggcagaagatgcttcgaggccagaatctgcgcctgccccggcagagacagaaaggccgacgaggacagcatcagaaagcagcaggtgagcgacagcaccaagaacggcgacgccttcagacagaacacccacggcatccagatgaccagcatcaagaagagaagaagccccgacgacgagctgctgtacctgcccgtgagaggcagagagacctacgagatgctgctgaagatcaaggagagcctggagctgatgcagtacctgccccagcacaccatcgagacctacagacagcagcagcagcagcagcaccagcacctgctgcagaagcagaccagcatccagagccccagcagctacggcaacagcagcccccccctgaacaagatgaacagcatgaacaagctgcccagcgtgagccagctgatcaacccccagcagagaaacgccctgacccccaccaccatccccgacggcatgggcgccaacatccccatgatgggcacccacatgcccatggccggcgacatgaacggcctgagccccacccaggccctgcccccccccctgagcatgcccagcaccagccactgcacccccccccccccctaccccaccgactgcagcatcgtgagcttcctggccagactgggctgcagcagctgcctggactacttcaccacccagggcctgaccaccatctaccagatcgagcactacagcatggacgacctggccagcctgaagatccccgagcagttcagacacgccatctggaagggcatcctggaccacagacagctgcacgagttcagcagccccagccacctgctgagaacccccagcagcgccagcaccgtgagcgtgggcagcagcgagaccagaggcgagagagtgatcgacgccgtgagattcaccctgagacagaccatcagcttcccccccagagacgagtggaacgacttcaacttcgacatggacgccagaagaaacaagcagcagagaatcaaggaggagggcgagtag

SEQ ID NO: 104120 - DNA, 567 bp, Artificial Sequence
  Description of Artificial Sequence: Synthetic coding sequence
atgatcatctacagagacctgatcagccacgacgagatgttcagcgacatctacaagatcagagagatcgccgacggcctgtgcctggaggtggagggcaagatggtgagcagaaccgagggcaacatcgacgacagcctgatcggcggcaacgccagcgccgagggccccgagggcgagggcaccgagagcaccgtgatcaccggcgtggacatcgtgatgaaccaccacctgcaggagaccagcttcaccaaggaggcctacaagaagtacatcaaggactacatgaagagcatcaagggcaagctggaggagcagagacccgagagagtgaagcccttcatgaccggcgccgccgagcagatcaagcacatcctggccaacttcaagaactaccagttcttcatcggcgagaacatgaaccccgacggcatggtggccctgctggactacagagaggacggcgtgaccccctacatgatcttcttcaaggacggcctggagatggagaagtgcgtgagcaccagaaagtgggtgaagatcaacaacgtgaagaagaccttctag

SEQ ID NO: 104121 - DNA, 417 bp, Artificial Sequence
  Description of Artificial Sequence: Synthetic coding sequence
atggtgagcagaaccgagggcaacatcgacgacagcctgatcggcggcaacgccagcgccgagggccccgagggcgagggcaccgagagcaccgtgatcaccggcgtggacatcgtgatgaaccaccacctgcaggagaccagcttcaccaaggaggcctacaagaagtacatcaaggactacatgaagagcatcaagggcaagctggaggagcagagacccgagagagtgaagcccttcatgaccggcgccgccgagcagatcaagcacatcctggccaacttcaagaactaccagttcttcatcggcgagaacatgaaccccgacggcatggtggccctgctggactacagagaggacggcgtgaccccctacatgatcttcttcaaggacggcctggagatggagaagtgctag

SEQ ID NO: 104122 - DNA, 417 bp, Artificial Sequence; identical to SEQ ID NO: 104121
  Description of Artificial Sequence: Synthetic coding sequence

SEQ ID NO: 104123 - DNA, 483 bp, Artificial Sequence
  Description of Artificial Sequence: Synthetic coding sequence
atgttcagcgacatctacaagatcagagagatcgccgacggcctgtgcctggaggtggagggcaagatggtgagcagaaccgagggcaacatcgacgacagcctgatcggcggcaacgccagcgccgagggccccgagggcgagggcaccgagagcaccgtgatcaccggcgtggacatcgtgatgaaccaccacctgcaggagaccagcttcaccaaggaggcctacaagaagtacatcaaggactacatgaagagcatcaagggcaagctggaggagcagagacccgagagagtgaagcccttcatgaccggcgccgccgagcagatcaagcacatcctggccaacttcaagaactaccagttcttcatcggcgagaacatgaaccccgacggcatggtggccctgctggactacagagaggacggcgtgaccccctacatgatcttcttcaaggacggcctggagatggagaagtgctag

SEQ ID NO: 104124 - DNA, 519 bp, Artificial Sequence
  Description of Artificial Sequence: Synthetic coding sequence
atgatcatctacagagacctgatcagccacgacgagatgttcagcgacatctacaagatcagagagatcgccgacggcctgtgcctggaggtggagggcaagatggtgagcagaaccgagggcaacatcgacgacagcctgatcggcggcaacgccagcgccgagggccccgagggcgagggcaccgagagcaccgtgatcaccggcgtggacatcgtgatgaaccaccacctgcaggagaccagcttcaccaaggaggcctacaagaagtacatcaaggactacatgaagagcatcaagggcaagctggaggagcagagacccgagagagtgaagcccttcatgaccggcgccgccgagcagatcaagcacatcctggccaacttcaagaactaccagttcttcatcggcgagaacatgaaccccgacggcatggtggccctgctggactacagagaggacggcgtgaccccctacatgatcttcttcaaggacggcctggagatggagaagtgctag

SEQ ID NO: 104125 - DNA, 1164 bp, Artificial Sequence
  Description of Artificial Sequence: Synthetic coding sequence
atggaggacgacgcccccgtgatctacggcctggagttccaggccagagccctgaccccccagaccgccgagaccgacgccatcagattcctggtgggcacccagagcctgaagtacgacaaccagatccacatcatcgacttcgacgacgagaacaacatcatcaacaagaacgtgctgctgcaccaggccggcgagatctggcacatcagcgccagccccgccgacagaggcgtgctgaccacctgctacaacagaaccagcgacagcaaggtgctgacctgcgccgccgtgtggagaatgcccaaggagctggagagcggcagccacgagagccccgacgacagcagcagcaccgcccagaccctggagctgctgtgccacctggacaacaccgcccacggcaacatggcctgcgtggtgtgggagcccatgggcgacggcaagaagatcatcagcctggccgacaaccacatcctgctgtgggacctgcaggagagcagcagccaggccgtgctggccagcagcgccagcctggagggcaagggccagctgaagttcaccagcggcagatggagcccccaccacaactgcacccaggtggccaccgccaacgacaccaccctgagaggctgggacaccagaagcatgagccagatctactgcatcgagaacgcccacggccagctggtgagagacctggacttcaaccccaacaagcagtactacctggccagctgcggcgacgactgcaaggtgaagttctgggacaccagaaacgtgaccgagcccgtgaagaccctggaggagcacagccactgggtgtggaacgtgagatacaaccacagccacgaccagctggtgctgaccggcagcagcgacagcagagtgatcctgagcaacatggtgagcatcagcagcgagcccttcggccacctggtggacgacgacgacatcagcgaccaggaggaccacagaagcgaggagaagagcaaggagcccctgcaggacaacgtgatcgccacctacgaggagcacgaggacagcgtgtacgccgtggactggagcagcgccgacccctggctgttcgccagcctgagctacgacggcagactggtgatcaacagagtgcccagagccctgaagtaccacatcctgctgtag

SEQ ID NO: 104126 - DNA, 990 bp, Artificial Sequence
  Description of Artificial Sequence: Synthetic coding sequence
atggccgaggccggcaccggcgagcccagccccagcgtggagggcgagcacggcaccgagtacgacaccctgcccagcgacaccgtgagcctgagcgacagcgacagcgacctgagcctgcccggcggcgccgaggtggaggccctgagccccatgggcctgcccggcgaggaggacagcggccccgacgagccccccagcccccccagcggcctgctgcccgccaccgtgcagcccttccacctgagaggcatgagcagcaccttcagccagagaagcagagacatcttcgactgcctggagggcgccgccagaagagcccccagcagcgtggcccacaccagcatgagcgacaacggcggcttcaagagacccctggcccccagcggcagaagccccgtggagggcctgggcagagcccacagaagccccgccagccccagagtgccccccgtgcccgactacgtggcccaccccgagagatggaccaagtacagcctggaggacgtgaccgaggtgagcgagcagagcaaccaggccaccgccctggccttcctgggcagccagagcctggccgcccccaccgactgcgtgagcagcttcaaccaggaccccagcagctgcggcgagggcagagtgatcttcaccaagcccgtgagaggcgtggaggccagacacgagagaaagagagtgctgggcaaggtgggcgagcccggcagaggcggcctgggcaaccccgccaccgacagaggcgagggccccgtggagctggcccacctggccggccccggcagccccgaggccgaggagtggggcagccaccacggcggcctgcaggaggtggaggccctgagcggcagcgtgcacagcggcagcgtgcccggcctgccccccgtggagaccgtgggcttccacggcagcagaaagagaagcagagaccacttcagaaacaagagcagcagccccgaggaccccggcgccgaggtgtag

SEQ ID NO: 104127 - DNA, 798 bp, Artificial Sequence
  Description of Artificial Sequence: Synthetic coding sequence
atggccgaggccggcaccggcctgctgcccgccaccgtgcagcccttccacctgagaggcatgagcagcaccttcagccagagaagcagagacatcttcgactgcctggagggcgccgccagaagagcccccagcagcgtggcccacaccagcatgagcgacaacggcggcttcaagagacccctggcccccagcggcagaagccccgtggagggcctgggcagagcccacagaagccccgccagccccagagtgccccccgtgcccgactacgtggcccaccccgagagatggaccaagtacagcctggaggacgtgaccgaggtgagcgagcagagcaaccaggccaccgccctggccttcctgggcagccagagcctggccgcccccaccgactgcgtgagcagcttcaaccaggaccccagcagctgcggcgagggcagagtgatcttcaccaagcccgtgagaggcgtggaggccagacacgagagaaagagagtgctgggcaaggtgggcgagcccggcagaggcggcctgggcaaccccgccaccgacagaggcgagggccccgtggagctggcccacctggccggccccggcagccccgaggccgaggagtggggcagccaccacggcggcctgcaggaggtggaggccctgagcggcagcgtgcacagcggcagcgtgcccggcctgccccccgtggagaccgtgggcttccacggcagcagaaagagaagcagagaccacttcagaaacaagagcagcagccccgaggaccccggcgccgaggtgtag

SEQ ID NO: 104128 - DNA, 339 bp, Artificial Sequence
  Description of Artificial Sequence: Synthetic coding sequence
atggccgaggccggcaccggcgagcccagccccagcgtggagggcgagcacggcaccgagtacgacaccctgcccagcgacaccgtgagcctgagcgacagcgacagcgacctgagcctgcccggcggcgccgaggtggaggccctgagccccatgggcctgcccggcgaggaggacagcggccccgacgagccccccagcccccccagcggcctgctgcccgccaccgtgcagcccttccacctgagaggcatgagcagcaccttcagccagagaagcagagacatcttcgactgcctggagggcgccgccagaagagcccccagcagcgtggcctag

SEQ ID NO: 104129 - DNA, 612 bp, Artificial Sequence
  Description of Artificial Sequence: Synthetic coding sequence
atggccgaggccggcaccggcgagcccagccccagcgtggagggcgagcacggcaccgagtacgacaccctgcccagcgacaccgtgagcctgagcgacagcgacagcgacctgagcctgcccggcggcgccgaggtggaggccctgagccccatgggcctgcccggcgaggaggacagcggccccgacgagccccccagcccccccagcggcctgctgcccgccaccgtgcagcccttccacctgagaggcatgagcagcaccttcagccagagaagcagagacatcttcgactgcctggagggcgccgccagaagagcccccagcagcgtggcccacaccagcatgagcgacaacggcggcttcaagagacccctggcccccagcggcagaagccccgtggagggcctgggcagagcccacagaagccccgccagccccagagtgccccccgtgcccgactacgtggcccaccccgagagatggaccaagtacagcctggaggacgtgaccgaggtgagcgagcagagcaaccaggccaccgccctggccttcctgggcagccagagcctggccgcccccaccgactgcgtgagcagcttcaaccagtag

SEQ ID NO: 104130 - DNA, 627 bp, Artificial Sequence
  Description of Artificial Sequence: Synthetic coding sequence
atggccgaggccggcaccggcctgctgcccgccaccgtgcagcccttccacctgagaggcatgagcagcaccttcagccagagaagcagagacatcttcgactgcctggagggcgccgccagaagagcccccagcagcgtggcccacaccagcatgagcgacaacggcggcttcaagagacccctggcccccagcggcagaagccccgtggagggcctgggcagagcccacagaagccccgccagccccagagtgccccccgtgcccgactacgtggcccaccccgagagatggaccaagtacagcctggaggacgtgaccgaggtgagcgagcagagcaaccaggccaccgccctggccttcctgggcagccagagcctggccgcccccaccgactgcgtgagcagcttcaaccaggaccccagcagctgcggcgagggcagagtgatcttcaccaagcccgtgagaggcgtggaggccagacacgagagaaagagagtgctgggcaaggtgggcgagcccggcagaggcggcctgggcaaccccgccaccgacagaggcgagggccccgtggagctggcccacctggccggccccggcagccccgaggccgaggagtggggctag

SEQ ID NO: 104131 - DNA, 990 bp, Artificial Sequence; identical to SEQ ID NO: 104126
  Description of Artificial Sequence: Synthetic coding sequence

SEQ ID NO: 104132 - DNA, 333 bp, Artificial Sequence
  Description of Artificial Sequence: Synthetic coding sequence
atggccgaggccggcaccggcgagcccagccccagcgtggagggcgagcacggcaccgagtacgacaccctgcccagcgacaccgtgagcctgagcgacagcgacagcgacctgagcctgcccggcggcgccgaggtggaggccctgagccccatgggcctgcccggcgaggaggacagcggccccgacgagccccccagcccccccagcggcctgctgcccgccaccgtgcagcccttccacctgagaggcatgagcagcaccttcagccagagaagcagagacatcttcgactgcctggagggcgccgccagaagagcccccagcagctag

SEQ ID NO: 104133 - DNA, 576 bp, Artificial Sequence
  Description of Artificial Sequence: Synthetic coding sequence
atggccgaggccggcaccggcgagcccagccccagcgtggagggcgagcacggcaccgagtacgacaccctgcccagcgacaccgtgagcctgagcgacagcgacagcgacctgagcctgcccggcggcgccgaggtggaggccctgagccccatgggcctgcccggcgaggaggacagcggccccgacgagccccccagcccccccagcggcctgctgcccgccaccgtgcagcccttccacctgagaggcatgagcagcaccttcagccagagaagcagagacatcttcgactgcctggagggcgccgccagaagagcccccagcagcgtggcccacaccagcatgagcgacaacggcggcttcaagagacccctggcccccagcggcagaagccccgtggagggcctgggcagagcccacagaagccccgccagccccagagtgccccccgtgcccgactacgtggcccaccccgagagatggaccaagtacagcctggaggacgtgaccgaggtgagcgagcagagcaaccaggccaccgccctggccttcctgggcagccagagcctgtag

SEQ ID NO: 104134 - DNA, 639 bp, Artificial Sequence
  Description of Artificial Sequence: Synthetic coding sequence
atgggccccatgtggagaatgagaggcggcgccaccagaagaggcagctgctgcggcggcgacggcgccgccgacggcagaggccccggcagaagcggcagagccagaggcggcggcagccccagcggcggcggcggcggcgtgggctggagaggcagagccgacggcgccagacagcagctggaggagagattcgccgacctggccgccagccacctggaggccatcagagccagagacgagtgggacagacagaacgccagactgagacaggagaacgccagactgagactggagaacagaagactgaagagagagaacagaagcctgttcagacaggccctgagactgcccggcgagggcggcaacggcacccccgccgaggccagaagagtgcccgaggaggccagcaccaacagaagagccagagacagcggcagagaggacgagcccggcagccccagagccctgagagccagactggagaagctggaggccatgtacagaagagccctgctgcagctgcacctggagcagagaggccccagacccagcggcgacaaggaggagcagcccctgcaggagcccgacagcggcctgagaagcagagacagcgagcccagcggcccctggctgtag

SEQ ID NO: 104135 - DNA, 1047 bp, Artificial Sequence
  Description of Artificial Sequence: Synthetic coding sequence
atgggcgccagaggcgcccccagcagaagaagacaggccggcagaagactgagatacctgcccaccggcagcttccccttcctgctgctgctgctgctgctgtgcatccagctgggcggcggccagaagaagaaggagaacctgctggccgagaaggtggagcagctgatggagtggagcagcagaagaagcatcttcagaatgaacggcgacaagttcagaaagttcatcaaggccccccccagaaactacagcatgatcgtgatgttcaccgccctgcagccccagagacagtgcagcgtgtgcagacaggccaacgaggagtaccagatcctggccaacagctggagatacagcagcgccttctgcaacaagctgttcttcagcatggtggactacgacgagggcaccgacgtgttccagcagctgaacatgaacagcgcccccaccttcatgcacttcccccccaagggcagacccaagagagccgacaccttcgacctgcagagaatcggcttcgccgccgagcagctggccaagtggatcgccgacagaaccgacgtgcacatcagagtgttcagaccccccaactacagcggcaccatcgccctggccctgctggtgagcctggtgggcggcctgctgtacctgagaagaaacaacctggagttcatctacaacaagaccggctgggccatggtgagcctgtgcatcgtgttcgccatgaccagcggccagatgtggaaccacatcagaggccccccctacgcccacaagaacccccacaacggccaggtgagctacatccacggcagcagccaggcccagttcgtggccgagagccacatcatcctggtgctgaacgccgccatcaccatgggcatggtgctgctgaacgaggccgccaccagcaagggcgacgtgggcaagagaagaatcatctgcctggtgggcctgggcctggtggtgttcttcttcagcttcctgctgagcatcttcagaagcaagtaccacggctacccctacagcgacctggacttcgagtag

SEQ ID NO: 104136 - DNA, 1044 bp, Artificial Sequence
  Description of Artificial Sequence: Synthetic coding sequence
atgggcgccagaggcgcccccagcagaagaagacaggccggcagaagactgagatacctgcccaccggcagcttccccttcctgctgctgctgctgctgctgtgcatccagctgggcggcggccagaagaagaaggagaacctgctggccgagaaggtggagcagctgatggagtggagcagcagaagaagcatcttcagaatgaacggcgacaagttcagaaagttcatcaaggccccccccagaaactacagcatgatcgtgatgttcaccgccctgcagccccagagacagtgcagcgtgtgcagacaggccaacgaggagtaccagatcctggccaacagctggagatacagcagcgccttctgcaacaagctgttcttcagcatggtggactacgacgagggcaccgacgtgttccagcagctgaacatgaacagcgcccccaccttcatgcacttcccccccaagggcagacccaagagagccgacaccttcgacctgcagagaatcggcttcgccgccgagcagctggccaagtggatcgccgacagaaccgacgtgcacatcagagtgttcagaccccccaactacagcggcaccatcgccctggccctgctggtgagcctggtgggcggcctgctgtacctgagaagaaacaacctggagttcatctacaacaagaccggctgggccatggtgagcctgtgcatcgtgttcgccatgaccagcggccagatgtggaaccacatcagaggccccccctacgcccacaagaacccccacaacggccaggtgagctacatccacggcagcagccaggcccagttcgtggccgagagccacatcatcctggtgctgaacgccgccatcaccatgggcatggtgctgctgaacgaggccgccaccagcaagggcgacgtgggcaagagaagaatcatctgcctggtgggcctgggcctggtggtgttcttcttcagcttcctgctgagcatcttcagaagcaagtaccacggctacccctacagcttcctgatcaagtag

SEQ ID NO: 104137 - DNA, 1047 bp, Artificial Sequence; identical to SEQ ID NO: 104135
  Description of Artificial Sequence: Synthetic coding sequence

SEQ ID NO: 104138 - DNA, 1047 bp, Artificial Sequence; identical to SEQ ID NO: 104135
  Description of Artificial Sequence: Synthetic coding sequence

SEQ ID NO: 104139 - DNA, 534 bp, Artificial Sequence
  Description of Artificial Sequence: Synthetic coding sequence
atggcccaccccgtgcagagcgagttccccagcgcccaggagcccggcagcgccgccttcctggacctgcccgagatggagatcctgctgaccaaggccgagaacaaggacgacaagaccctgaacctgagcaagaccctgagcggccccctggacctggagcagaacagccagggcctgcccttcaaggccatcagcgagggccacctggaggcccccctgcccagaagccccagcagagccagcagcagaagagccagcagcatcgccaccaccagctacgcccaggaccaggaggcccccagagactacctgatcctggccgtggtggcctgcttctgccccgtgtggcccctgaacctgatccccctgatcatcagcatcatgagcagaagcagcatgcagcagggcaacgtggacggcgccagaagactgggcagactggccagactgctgagcatcaccctgatcatcatgggcatcgtgatcatcatggtggccgtgaccgtgaacttcaccgtgcagaagaagtag

SEQ ID NO: 104140 - DNA, 1173 bp, Artificial Sequence
  Description of Artificial Sequence: Synthetic coding sequence
atggccgtgagcgagagccagctgaagaagatggtgagcaagtacaagtacagagacctgaccgtgagagagaccgtgaacgtgatcaccctgtacaaggacctgaagcccgtgctggacagctacgtgttcaacgacggcagcagcagagagctgatgaacctgaccggcaccatccccgtgccctacagaggcaacacctacaacatccccatctgcctgtggctgctggacacctacccctacaacccccccatctgcttcgtgaagcccaccagcagcatgaccatcaagaccggcaagcacgtggacgccaacggcaagatctacctgccctacctgcacgagtggaagcacccccagagcgacctgctgggcctgatccaggtgatgatcgtggtgttcggcgacgagccccccgtgttcagcagacccatcagcgccagctaccccccctaccaggccaccggcccccccaacaccagctacatgcccggcatgcccggcggcatcagcccctaccccagcggctacccccccaaccccagcggctaccccggctgcccctacccccccggcggcccctaccccgccaccaccagcagccagtaccccagccagccccccgtgaccaccgtgggccccagcagagacggcaccatcagcgaggacaccatcagagccagcctgatcagcgccgtgagcgacaagctgagatggagaatgaaggaggagatggacagagcccaggccgagctgaacgccctgaagagaaccgaggaggacctgaagaagggccaccagaagctggaggagatggtgaccagactggaccaggaggtggccgaggtggacaagaacatcgagctgctgaagaagaaggacgaggagctgagcagcgccctggagaagatggagaaccagagcgagaacaacgacatcgacgaggtgatcatccccaccgcccccctgtacaagcagatcctgaacctgtacgccgaggagaacgccatcgaggacaccatcttctacctgggcgaggccctgagaagaggcgtgatcgacctggacgtgttcctgaagcacgtgagactgctgagcagaaagcagttccagctgagagccctgatgcagaaggccagaaagaccgccggcctgagcgacctgtactag

SEQ ID NO: 104141 - DNA, 858 bp, Artificial Sequence
  Description of Artificial Sequence: Synthetic coding sequence
atggccgtgagcgagagccagctgaagaagatggtgagcaagccccagagcgacctgctgggcctgatccaggtgatgatcgtggtgttcggcgacgagccccccgtgttcagcagacccatcagcgccagctaccccccctaccaggccaccggcccccccaacaccagctacatgcccggcatgcccggcggcatcagcccctaccccagcggctacccccccaaccccagcggctaccccggctgcccctacccccccggcggcccctaccccgccaccaccagcagccagtaccccagccagccccccgtgaccaccgtgggccccagcagagacggcaccatcagcgaggacaccatcagagccagcctgatcagcgccgtgagcgacaagctgagatggagaatgaaggaggagatggacagagcccaggccgagctgaacgccctgaagagaaccgaggaggacctgaagaagggccaccagaagctggaggagatggtgaccagactggaccaggaggtggccgaggtggacaagaacatcgagctgctgaagaagaaggacgaggagctgagcagcgccctggagaagatggagaaccagagcgagaacaacgacatcgacgaggtgatcatccccaccgcccccctgtacaagcagatcctgaacctgtacgccgaggagaacgccatcgaggacaccatcttctacctgggcgaggccctgagaagaggcgtgatcgacctggacgtgttcctgaagcacgtgagactgctgagcagaaagcagttccagctgagagccctgatgcagaaggccagaaagaccgccggcctgagcgacctgtactag

SEQ ID NO: 104142 - DNA, 972 bp, Artificial Sequence
  Description of Artificial Sequence: Synthetic coding sequence
atggccagaggccccggcctggcccccccccccctgagactgcccctgctgctgctggtgctggccgccgtgaccggccacaccgccgcccaggacaactgcacctgccccaccaacaagatgaccgtgtgcagccccgacggccccggcggcagatgccagtgcagagccctgggcagcggcatggccgtggactgcagcaccctgaccagcaagtgcctgctgctgaaggccagaatgagcgcccccaagaacgccagaaccctggtgagacccagcgagcacgccctggtggacaacgacggcctgtacgaccccgactgcgaccccgagggcagattcaaggccagacagtgcaaccagaccagcgtgtgctggtgcgtgaacagcgtgggcgtgagaagaaccgacaagggcgacctgagcctgagatgcgacgagctggtgagaacccaccacatcctgatcgacctgagacacagacccaccgccggcgccttcaaccacagcgacctggacgccgagctgagaagactgttcagagagagatacagactgcaccccaagttcgtggccgccgtgcactacgagcagcccaccatccagatcgagctgagacagaacaccagccagaaggccgccggcgacgtggacatcggcgacgccgcctactacttcgagagagacatcaagggcgagagcctgttccagggcagaggcggcctggacctgagagtgagaggcgagcccctgcaggtggagagaaccctgatctactacctggacgagatcccccccaagttcagcatgaagagactgaccgccggcctgatcgccgtgatcgtggtggtggtggtggccctggtggccggcatggccgtgctggtgatcaccaacagaagaaagagcggcaagtacaagaaggtggagatcaaggagctgggcgagctgagaaaggagcccagcctgtag

SEQ ID NO: 104143 - DNA, 1353 bp, Artificial Sequence
  Description of Artificial Sequence: Synthetic coding sequence
atgggcgccccccccggctacagacccagcgcctgggtgcacctgctgcaccagctgcccagagccgacttccagctgagacccgtgcccagcgtgttcgccccccaggagcaggagtaccagcaggccctgctgctggtggccgccctggccggcctgggcctgggcctgagcctgatcttcatcgccgtgtacctgatcagattctgctgctgcagaccccccgagccccccggcagcaagatccccagccccggcggcggctgcgtgacctggagctgcatcgtggccctgctggccggctgcaccggcatcggcatcggcttctacggcaacagcgagaccagcgacggcgtgagccagctgagcagcgccctgctgcacgccaaccacaccctgagcaccatcgaccacctggtgctggagaccgtggagagactgggcgaggccgtgagaaccgagctgaccaccctggaggaggtgctggagcccagaaccgagctggtggccgccgccagaggcgccagaagacaggccgaggccgccgcccagcagctgcagggcctggccttctggcagggcgtgcccctgagccccctgcaggtggccgagaacgtgagcttcgtggaggagtacagatggctggcctacgtgctgctgctgctgctggagctgctggtgtgcctgttcaccctgctgggcctggccaagcagagcaagtggctggtgatcgtgatgaccgtgatgagcctgctggtgctggtgctgagctggggcagcatgggcctggaggccgccaccgccgtgggcctgagcgacttctgcagcaaccccgacccctacgtgctgaacctgacccaggaggagaccggcctgagcagcgacatcctgagctactacctgctgtgcaacagagccgtgagcaaccccttccagcagagactgaccctgagccagagagccctggccaacatccacagccagctgctgggcctggagagagaggccgtgccccagttccccagcgcccagaagcccctgctgagcctggaggagaccctgaacgtgaccgagggcaacttccaccagctggtggccctgctgcactgcagaagcctgcacaaggactacggcgccgccctgagaggcctgtgcgaggacgccctggagggcctgctgttcctgctgctgttcagcctgctgagcgccggcgccctggccaccgccctgtgcagcctgcccagagcctgggccctgttcccccccagcgacgactacgacgacaccgacgacgacgaccccttcaacccccaggagagcaagagattcgtgcagtggcagagcagcatctag

SEQ ID NO: 104144 - DNA, 1383 bp, Artificial Sequence
  Description of Artificial Sequence: Synthetic coding sequence
atgggcgccccccccggctacagacccagcgcctgggtgcacctgctgcaccagctgcccagagccgacttccagctgagacccgtgcccagcgtgttcgccccccaggagcaggagtaccagcaggccctgctgctggtggccgccctggccggcctgggcctgggcctgagcctgatcttcatcgccgtgtacctgatcagattctgctgctgcagaccccccgagccccccggcagcaagatccccagccccggcggcggctgcgtgacctggagctgcatcgtggccctgctggccggctgcaccggcatcggcatcggcttctacggcaacagcgagaccagcgacggcgtgagccagctgagcagcgccctgctgcacgccaaccacaccctgagcaccatcgaccacctggtgctggagaccgtggagagactgggcgaggccgtgagaaccgagctgaccaccctggaggaggtgctggagcccagaaccgagctggtggccgccgccagaggcgccagaagacaggccgaggccgccgcccagcagctgcagggcctggccttctggcagggcgtgcccctgagccccctgcaggtggccgagaacgtgagcttcgtggaggagtacagatggctggcctacgtgctgctgctgctgctggagctgctggtgtgcctgttcaccctgctgggcctggccaagcagagcaagtggctggtgatcgtgatgaccgtgatgagcctgctggtgctggtgctgagctggggcagcatgggcctggaggccgccaccgccgtgggcctgagcgacttctgcagcaaccccgacccctacgtgctgaacctgacccaggaggagaccggcctgagcagcgacatcctgagctactacctgctgtgcaacagagccgtgagcaaccccttccagcagagactgaccctgagccagagagccctggccaacatccacagccagctgctgggcctggagagagaggccgtgccccagttccccagcgcccagaagcccctgctgagcctggaggagaccctgaacgtgaccgagggcaacttccaccagctggtggccctgctgcactgcagaagcctgcacaaggactacggcgccgccctgagaggcctgtgcgaggacgccctggagggcctgctgttcctgctgctgttcagcctgctgagcgccggcgccctggccaccgccctgtgcagcctgcccagagcctgggccctgttcccccccagaaaccccagcgccctgtgcagcggcagcagactgagcgagcccctgctgcccgccggcctggagcccggcagccccctgagaagcttccccggctgcagaagaagaccccactag

SEQ ID NO: 104145 - DNA, 1362 bp, Artificial Sequence
  Description of Artificial Sequence: Synthetic coding sequence
atgggcgccccccccggctacagacccagcgcctgggtgcacctgctgcaccagctgcccagagccgacttccagctgagacccgtgcccagcgtgttcgccccccaggagcaggagtaccagcaggaccagagcagcctggccgtgacccagagacccccccccaccacccccctgcacagactgagacccagacccagactgacccccgccctggccagaagaccccccgaggccgccagaggcgaccccagaccccagagcccccccgaggccctgctgctggtggccgccctggccggcctgggcctgggcctgagcctgatcttcatcgccgtgtacctgatcagattctgctgctgcagaccccccgagccccccggcagcaagatccccagccccggcggcggctgcgtgacctggagctgcatcgtggccctgctggccggctgcaccggcatcggcatcggcttctacggcaacagcgagaccagcgacggcgtgagccagctgagcagcgccctgctgcacgccaaccacaccctgagcaccatcgaccacctggtgctggagaccgtggagagactgggcgaggccgtgagaaccgagctgaccaccctggaggaggtgctggagcccagaaccgagctggtggccgccgccagaggcgccagaagacaggccgaggccgccgcccagcagctgcagggcctggccttctggcagggcgtgcccctgagccccctgcaggtggccgagaacgtgagcttcgtggaggagtacagatggctggcctacgtgctgctgctgctgctggagctgctggtgtgcctgttcaccctgctgggcctggccaagcagagcaagtggctggtgatcgtgatgaccgtgatgagcctgctggtgctggtgctgagctggggcagcatgggcctggaggccgccaccgccgtgggcctgagcgacttctgcagcaaccccgacccctacgtgctgaacctgacccaggaggagaccggcctgagcagcgaggccgacagcgtgcccgccagcagcggccagcaccccctgcccgccgccggccccggcgccagaagctgcgccagcgtgcccttcagcgccgaggccagcgccgtgctgggcggcgacagcgagtgcgacagaagaaagttcccccccgtgggcggcaccgccaccctgccccagcccgcccagggcctgtggtgcagccccgccggccccgtgagaagaagacccggcagacccgccctgcccgccaccctgctgcccgccgtgtgcagaagcgccggccactgccccctgcagcccgcccccagcctgggccccctgcccacccagtag

SEQ ID NO: 104146 - DNA, 1356 bp, Artificial Sequence
  Description of Artificial Sequence: Synthetic coding sequence
atgggcgccccccccggctacagacccagcgcctgggtgcacctgctgcaccagctgcccagagccgacttccagctgagacccgtgcccagcgtgttcgccccccaggagcaggagtaccagcaggccctgctgctggtggccgccctggccggcctgggcctgggcctgagcctgatcttcatcgccgtgtacctgatcagattctgctgctgcagaccccccgagccccccggcagcaagatccccagccccggcggcggctgcgtgacctggagctgcatcgtggccctgctggccggctgcaccggcatcggcatcggcttctacggcaacagcgagaccagcgacggcgtgagccagctgagcagcgccctgctgcacgccaaccacaccctgagcaccatcgaccacctggtgctggagaccgtggagagactgggcgaggccgtgagaaccgagctgaccaccctggaggaggtgctggagcccagaaccgagctggtggccgccgccagaggcgccagaagacaggccgaggccgccgcccagcagctgcagggcctggccttctggcagggcgtgcccctgagccccctgcaggtggccgagaacgtgagcttcgtggaggagtacagatggctggcctacgtgctgctgctgctgctggagctgctggtgtgcctgttcaccctgctgggcctggccaagcagagcaagtggctggtgatcgtgatgaccgtgatgagcctgctggtgctggtgctgagctggggcagcatgggcctggaggccgccaccgccgtgggcctgagcgacttctgcagcaaccccgacccctacgtgctgaacctgacccaggaggagaccggcctgagcagcgacatcctgagctactacctgctgtgcaacagagccgtgagcaaccccttccagcagagactgaccctgagccagagagccctggccaacatccacagccagctgctgggcctggagagagaggccgtgccccagttccccagcgcccagaagcccctgctgagcctggaggagaccctgaacgtgaccgagggcaacttccaccagctggtggccctgctgcactgcagaagcctgcacaaggactacggcgccgccctgagaggcctgtgcgaggacgccctggagggcctgctgttcctgctgctgttcagcctgctgagcgccggcgccctggccaccgccctgtgcagcctgcccagagcctgggccctgttcccccccagcgacgactacgacgacaccgacgacgacgaccccttcaacccccagcaggagagcaagagattcgtgcagtggcagagcagcatctag

SEQ ID NO: 104147 - DNA, 1155 bp, Artificial Sequence
  Description of Artificial Sequence: Synthetic coding sequence
atgaccagaagaggcagaagaagaagcagccacttcctgggcccccccgccggcgccgccggctgcacccagagaagaagcagagagctggccgccgccgccatgagccaccagaccggcatccaggccagcgaggacgtgaaggagatcttcgccagagccagaaacggcaagtacagactgctgaagatcagcatcgagaacgagcagctggtgatcggcagctacagccagcccagcgacagctgggacaaggactacgacagcttcgtgctgcccctgctggaggacaagcagccctgctacatcctgttcagactggacagccagaacgcccagggctacgagtggatcttcatcgcctggagccccgaccacagccacgtgagacagaagatgctgtacgccgccaccagagccaccctgaagaaggagttcggcggcggccacatcaaggacgaggtgttcggcaccgtgaaggaggacgtgagcctgcacggctacaagaagtacctgctgagccagagcagccccgcccccctgaccgccgccgaggaggagctgagacagatcaagatcaacgaggtgcagaccgacgtgggcgtggacaccaagcaccagaccctgcagggcgtggccttccccatcagcagagaggccttccaggccctggagaagctgaacaacagacagctgaactacgtgcagctggagatcgacatcaagaacgagatcatcatcctggccaacaccaccaacaccgagctgaaggacctgcccaagagaatccccaaggacagcgccagataccacttcttcctgtacaagcacagccacgagggcgactacctggagagcatcgtgttcatctacagcatgcccggctacacctgcagcatcagagagagaatgctgtacagcagctgcaagagcagactgctggagatcgtggagagacagctgcagatggacgtgatcagaaagatcgagatcgacaacggcgacgagctgaccgccgacttcctgtacgaggaggtgcaccccaagcagcacgcccacaagcagagcttcgccaagcccaagggccccgccggcaagagaggcatcagaagactgatcagaggccccgccgagaccgaggccaccaccgactag

SEQ ID NO: 104148 - DNA, 1053 bp, Artificial Sequence
  Description of Artificial Sequence: Synthetic coding sequence
atgagccaccagaccggcatccaggccagcgaggacgtgaaggagatcttcgccagagccagaaacggcaagtacagactgctgaagatcagcatcgagaacgagcagctggtgatcggcagctacagccagcccagcgacagctgggacaaggactacgacagcttcgtgctgcccctgctggaggacaagcagccctgctacatcctgttcagactggacagccagaacgcccagggctacgagtggatcttcatcgcctggagccccgaccacagccacgtgagacagaagatgctgtacgccgccaccagagccaccctgaagaaggagttcggcggcggccacatcaaggacgaggtgttcggcaccgtgaaggaggacgtgagcctgcacggctacaagaagtacctgctgagccagagcagccccgcccccctgaccgccgccgaggaggagctgagacagatcaagatcaacgaggtgcagaccgacgtgggcgtggacaccaagcaccagaccctgcagggcgtggccttccccatcagcagagaggccttccaggccctggagaagctgaacaacagacagctgaactacgtgcagctggagatcgacatcaagaacgagatcatcatcctggccaacaccaccaacaccgagctgaaggacctgcccaagagaatccccaaggacagcgccagataccacttcttcctgtacaagcacagccacgagggcgactacctggagagcatcgtgttcatctacagcatgcccggctacacctgcagcatcagagagagaatgctgtacagcagctgcaagagcagactgctggagatcgtggagagacagctgcagatggacgtgatcagaaagatcgagatcgacaacggcgacgagctgaccgccgacttcctgtacgaggaggtgcaccccaagcagcacgcccacaagcagagcttcgccaagcccaagggccccgccggcaagagaggcatcagaagactgatcagaggccccgccgagaccgaggccaccaccgactag

SEQ ID NO: 104149 - DNA, 1074 bp, Artificial Sequence
  Description of Artificial Sequence: Synthetic coding sequence
atgagccaccagaccggcatccaggccagcgaggacgtgaaggagatcttcgccagagccagaaacggcaagtacagactgctgaagatcagcatcgagaacgagcagctggtgatcggcagctacagccagcccagcgacagctgggacaaggactacgacagcttcgtgctgcccctgctggaggacaagcagccctgctacatcctgttcagactggacagccagaacgcccagggctacgagtggatcttcatcgcctggagccccgaccacagccacgtgagacagaagatgctgtacgccgccaccagagccaccctgaagaaggagttcggcggcggccacatcaaggacgaggtgttcggcaccgtgaaggaggacgtgagcctgcacggctacaagaagtacctgctgagccagagcagccccgcccccctgaccgccgccgaggaggagctgagacagatcaagatcaacgagagccccgaggaccacatcggcgtgcagaccgacgtgggcgtggacaccaagcaccagaccctgcagggcgtggccttccccatcagcagagaggccttccaggccctggagaagctgaacaacagacagctgaactacgtgcagctggagatcgacatcaagaacgagatcatcatcctggccaacaccaccaacaccgagctgaaggacctgcccaagagaatccccaaggacagcgccagataccacttcttcctgtacaagcacagccacgagggcgactacctggagagcatcgtgttcatctacagcatgcccggctacacctgcagcatcagagagagaatgctgtacagcagctgcaagagcagactgctggagatcgtggagagacagctgcagatggacgtgatcagaaagatcgagatcgacaacggcgacgagctgaccgccgacttcctgtacgaggaggtgcaccccaagcagcacgcccacaagcagagcttcgccaagcccaagggccccgccggcaagagaggcatcagaagactgatcagaggccccgccgagaccgaggccaccaccgactag

SEQ ID NO: 104150 - DNA, 1050 bp, Artificial Sequence
  Description of Artificial Sequence: Synthetic coding sequence
atggcccaccagaccggcatccacgccaccgaggagctgaaggagttcttcgccaaggccagagccggcagcgtgagactgatcaaggtggtgatcgaggacgagcagctggtgctgggcgccagccaggagcccgtgggcagatgggaccaggactacgacagagccgtgctgcccctgctggacgcccagcagccctgctacctgctgtacagactggacagccagaacgcccagggcttcgagtggctgttcctggcctggagccccgacaacagccccgtgagactgaagatgctgtacgccgccaccagagccaccgtgaagaaggagttcggcggcggccacatcaaggacgagctgttcggcaccgtgaaggacgacctgagcttcgccggctaccagaagcacctgagcagctgcgccgcccccgcccccctgaccagcgccgagagagagctgcagcagatcagaatcaacgaggtgaagaccgagatcagcgtggagagcaagcaccagaccctgcagggcctggccttccccctgcagcccgaggcccagagagccctgcagcagctgaagcagaagatggtgaactacatccagatgaagctggacctggagagagagaccatcgagctggtgcacaccgagcccaccgacgtggcccagctgcccagcagagtgcccagagacgccgccagataccacttcttcctgtacaagcacacccacgagggcgaccccctggagagcgtggtgttcatctacagcatgcccggctacaagtgcagcatcaaggagagaatgctgtacagcagctgcaagagcagactgctggacagcgtggagcaggacttccacctggagatcgccaagaagatcgagatcggcgacggcgccgagctgaccgccgagttcctgtacgacgaggtgcaccccaagcagcacgccttcaagcaggccttcgccaagcccaagggccccggcggcaagagaggccacaagagactgatcagaggccccggcgagaacggcgacgacagctag

SEQ ID NO: 104151 - DNA, 483 bp, Artificial Sequence
  Description of Artificial Sequence: Synthetic coding sequence
atggaggagggcagcagcagccccgtgagccccgtggacagcctgggcaccagcgaggaggagctggagagacagcccaagagattcggcagaaagagaagatacagcaagaagagcagcgaggacggcagccccacccccggcaagagaggcaagaagggcagccccagcgcccagagcttcgaggagctgcagagccagagaatcctggccaacgtgagagagagacagagaacccagagcctgaacgaggccttcgccgccctgagaaagatcatccccaccctgcccagcgacaagctgagcaagatccagaccctgaagctggccgccagatacatcgacttcctgtaccaggtgctgcagagcgacgagatggacaacaagatgaccagctgcagctacgtggcccacgagagactgagctacgccttcagcgtgtggagaatggagggcgcctggagcatgagcgccagccactag

SEQ ID NO: 104152 - DNA, 1476 bp, Artificial Sequence
  Description of Artificial Sequence: Synthetic coding sequence
atgaaccccgccgccgaggccgagttcaacatcctgctggccaccgacagctacaaggtgacccactacaagcagtacccccccaacaccagcaaggtgtacagctacttcgagtgcagagagaagaagaccgagaacagcaagctgagaaaggtgaagtacgaggagaccgtgttctacggcctgcagtacatcctgaacaagtacctgaagggcaaggtggtgaccaaggagaagatccaggaggccaaggacgtgtacaaggagcacttccaggacgacgtgttcaacgagaagggctggaactacatcctggagaagtacgacggccacctgcccatcgagatcaaggccgtgcccgagggcttcgtgatccccagaggcaacgtgctgttcaccgtggagaacaccgaccccgagtgctactggctgaccaactggatcgagaccatcctggtgcagagctggtaccccatcaccgtggccaccaacagcagagagcagaagaagatcctggccaagtacctgctggagaccagcggcaacctggacggcctggagtacaagctgcacgacttcggctacagaggcgtgagcagccaggagaccgccggcatcggcgccagcgcccacctggtgaacttcaagggcaccgacaccgtggccggcctggccctgatcaagaagtactacggcaccaaggaccccgtgcccggctacagcgtgcccgccgccgagcacagcaccatcaccgcctggggcaaggaccacgagaaggacgccttcgagcacatcgtgacccagttcagcagcgtgcccgtgagcgtggtgagcgacagctacgacatctacaacgcctgcgagaagatctggggcgaggacctgagacacctgatcgtgagcagaagcacccaggcccccctgatcatcagacccgacagcggcaaccccctggacaccgtgctgaaggtgctggagatcctgggcaagaagttccccgtgaccgagaacagcaagggctacaagctgctgcccccctacctgagagtgatccagggcgacggcgtggacatcaacaccctgcaggagatcgtggagggcatgaagcagaagatgtggagcatcgagaacatcgccttcggcagcggcggcggcctgctgcagaagctgaccagagacctgctgaactgcagcttcaagtgcagctacgtggtgaccaacggcctgggcatcaacgtgttcaaggaccccgtggccgaccccaacaagagaagcaagaagggcagactgagcctgcacagaacccccgccggcaacttcgtgaccctggaggagggcaagggcgacctggaggagtacggccaggacctgctgcacaccgtgttcaagaacggcaaggtgaccaagagctacagcttcgacgagatcagaaagaacgcccagctgaacatcgagctggaggccgcccaccactag

SEQ ID NO: 104153 - DNA, 672 bp, Artificial Sequence
  Description of Artificial Sequence: Synthetic coding sequence
atgaagctgcactacgtggccgtgctgaccctggccatcctgatgttcctgacctggctgcccgagagcctgagctgcaacaaggccctgtgcgccagcgacgtgagcaagtgcctgatccaggagctgtgccagtgcagacccggcgagggcaactgcagctgctgcaaggagtgcatgctgtgcctgggcgccctgtgggacgagtgctgcgactgcgtgggcatgtgcaaccccagaaactacagcgacaccccccccaccagcaagagcaccgtggaggagctgcacgagcccatccccagcctgttcagagccctgaccgagggcgacacccagctgaactggaacatcgtgagcttccccgtggccgaggagctgagccaccacgagaacctggtgagcttcctggagaccgtgaaccagccccaccaccagaacgtgagcgtgcccagcaacaacgtgcacgccccctacagcagcgacaaggagcacatgtgcaccgtggtgtacttcgacgactgcatgagcatccaccagtgcaagatcagctgcgagagcatgggcgccagcaagtacagatggttccacaacgcctgctgcgagtgcatcggccccgagtgcatcgactacggcagcaagaccgtgaagtgcatgaactgcatgttctag

SEQ ID NO: 104154 - DNA, 2451 bp, Artificial Sequence
  Description of Artificial Sequence: Synthetic coding sequence
atggccgtgagcctggacgacgacgtgcccctgatcctgaccctggacgagggcggcagcgcccccctggcccccagcaacggcctgggccaggaggagctgcccagcaagaacggcggcagctacgccatccacgacagccaggcccccagcctgagcagcggcggcgagagcagccccagcagccccgcccacaactgggagatgaactaccaggaggccgccatctacctgcaggagggcgagaacaacgacaagttcttcacccaccccaaggacgccaaggccctggccgcctacctgttcgcccacaaccacctgttctacctgatggagctggccaccgccctgctgctgctgctgctgagcctgtgcgaggcccccgccgtgcccgccctgagactgggcatctacgtgcacgccaccctggagctgttcgccctgatggtggtggtgttcgagctgtgcatgaagctgagatggctgggcctgcacaccttcatcagacacaagagaaccatggtgaagaccagcgtgctggtggtgcagttcgtggaggccatcgtggtgctggtgagacagatgagccacgtgagagtgaccagagccctgagatgcatcttcctggtggactgcagatactgcggcggcgtgagaagaaacctgagacagatcttccagagcctgccccccttcatggacatcctgctgctgctgctgttcttcatgatcatcttcgccatcctgggcttctacctgttcagccccaaccccagcgacccctacttcagcaccctggagaacagcatcgtgagcctgttcgtgctgctgaccaccgccaacttccccgacgtgatgatgcccagctacagcagaaacccctggagctgcgtgttcttcatcgtgtacctgagcatcgagctgtacttcatcatgaacctgctgctggccgtggtgttcgacaccttcaacgacatcgagaagagaaagttcaagagcctgctgctgcacaagagaaccgccatccagcacgcctacagactgctgatcagccagagaagacccgccggcatcagctacagacagttcgagggcctgatgagattctacaagcccagaatgagcgccagagagagatacctgaccttcaaggccctgaaccagaacaacacccccctgctgagcctgaaggacttctacgacatctacgaggtggccgccctgaagtggaaggccaagaagaacagagagcactggttcgacgagctgcccagaaccgccctgctgatcttcaagggcatcaacatcctggtgaagagcaaggccttccagtacttcatgtacctggtggtggccgtgaacggcgtgtggatcctggtggagaccttcatgctgaagggcggcaacttcttcagcaagcacgtgccctggagctacctggtgttcctgaccatctacggcgtggagctgttcctgaaggtggccggcctgggccccgtggagtacctgagcagcggctggaacctgttcgacttcagcgtgaccgtgttcgccttcctgggcctgctggccctggccctgaacatggagcccttctacttcatcgtggtgctgagacccctgcagctgctgagactgttcaagctgaaggagagatacagaaacgtgctggacaccatgttcgagctgctgcccagaatggccagcctgggcctgaccctgctgatcttctactacagcttcgccatcgtgggcatggagttcttctgcggcatcgtgttccccaactgctgcaacaccagcaccgtggccgacgcctacagatggagaaaccacaccgtgggcaacagaaccgtggtggaggagggctactactacctgaacaacttcgacaacatcctgaacagcttcgtgaccctgttcgagctgaccgtggtgaacaactggtacatcatcatggagggcgtgaccagccagaccagccactggagcagactgtacttcatgaccttctacatcgtgaccatggtggtgatgaccatcatcgtggccttcatcctggaggccttcgtgttcagaatgaactacagcagaaagaaccaggacagcgaggtggacggcggcatcaccctggagaaggagatcagcaaggaggagctggtggccgtgctggagctgtacagagaggccagaggcgccagcagcgacgtgaccagactgctggagaccctgagccagatggagagataccagcagcacagcatggtgttcctgggcagaagaagcagaaccaagagcgacctgagcctgaagatgtaccaggaggagatccaggagtggtacgaggagcacgccagagagcaggagcagcagagacagctgagcagcagcgccgcccccgccgcccagcagccccccggcagcagacagagaagccagaccgtgacctag

SEQ ID NO: 104155 - DNA, 2247 bp, Artificial Sequence
  Description of Artificial Sequence: Synthetic coding sequence
atgaactaccaggaggccgccatctacctgcaggagggcgagaacaacgacaagttcttcacccaccccaaggacgccaaggccctggccgcctacctgttcgcccacaaccacctgttctacctgatggagctggccaccgccctgctgctgctgctgctgagcctgtgcgaggcccccgccgtgcccgccctgagactgggcatctacgtgcacgccaccctggagctgttcgccctgatggtggtggtgttcgagctgtgcatgaagctgagatggctgggcctgcacaccttcatcagacacaagagaaccatggtgaagaccagcgtgctggtggtgcagttcgtggaggccatcgtggtgctggtgagacagatgagccacgtgagagtgaccagagccctgagatgcatcttcctggtggactgcagatactgcggcggcgtgagaagaaacctgagacagatcttccagagcctgccccccttcatggacatcctgctgctgctgctgttcttcatgatcatcttcgccatcctgggcttctacctgttcagccccaaccccagcgacccctacttcagcaccctggagaacagcatcgtgagcctgttcgtgctgctgaccaccgccaacttccccgacgtgatgatgcccagctacagcagaaacccctggagctgcgtgttcttcatcgtgtacctgagcatcgagctgtacttcatcatgaacctgctgctggccgtggtgttcgacaccttcaacgacatcgagaagagaaagttcaagagcctgctgctgcacaagagaaccgccatccagcacgcctacagactgctgatcagccagagaagacccgccggcatcagctacagacagttcgagggcctgatgagattctacaagcccagaatgagcgccagagagagatacctgaccttcaaggccctgaaccagaacaacacccccctgctgagcctgaaggacttctacgacatctacgaggtggccgccctgaagtggaaggccaagaagaacagagagcactggttcgacgagctgcccagaaccgccctgctgatcttcaagggcatcaacatcctggtgaagagcaaggccttccagtacttcatgtacctggtggtggccgtgaacggcgtgtggatcctggtggagaccttcatgctgaagggcggcaacttcttcagcaagcacgtgccctggagctacctggtgttcctgaccatctacggcgtggagctgttcctgaaggtggccggcctgggccccgtggagtacctgagcagcggctggaacctgttcgacttcagcgtgaccgtgttcgccttcctgggcctgctggccctggccctgaacatggagcccttctacttcatcgtggtgctgagacccctgcagctgctgagactgttcaagctgaaggagagatacagaaacgtgctggacaccatgttcgagctgctgcccagaatggccagcctgggcctgaccctgctgatcttctactacagcttcgccatcgtgggcatggagttcttctgcggcatcgtgttccccaactgctgcaacaccagcaccgtggccgacgcctacagatggagaaaccacaccgtgggcaacagaaccgtggtggaggagggctactactacctgaacaacttcgacaacatcctgaacagcttcgtgaccctgttcgagctgaccgtggtgaacaactggtacatcatcatggagggcgtgaccagccagaccagccactggagcagactgtacttcatgaccttctacatcgtgaccatggtggtgatgaccatcatcgtggccttcatcctggaggccttcgtgttcagaatgaactacagcagaaagaaccaggacagcgaggtggacggcggcatcaccctggagaaggagatcagcaaggaggagctggtggccgtgctggagctgtacagagaggccagaggcgccagcagcgacgtgaccagactgctggagaccctgagccagatggagagataccagcagcacagcatggtgttcctgggcagaagaagcagaaccaagagcgacctgagcctgaagatgtaccaggaggagatccaggagtggtacgaggagcacgccagagagcaggagcagcagagacagctgagcagcagcgccgcccccgccgcccagcagccccccggcagcagacagagaagccagaccgtgacctag

SEQ ID NO: 104156 - DNA, 2667 bp, Artificial Sequence
  Description of Artificial Sequence: Synthetic coding sequence
atggagagctgctacatcgcccaggccggcctggagctgctgggcagcagcagcagccccaccctgaccagccagagcgccgagatcaccgaggacgccagcaacggcggcgtgagcgagcagcacccctggcccagcggcttcgagagagagctgaagcccgagaccatcagcagccccggctaccacatcctgagagccaccggcgaggagaacatggccgtgagcctggacgacgacgtgcccctgatcctgaccctggacgagggcggcagcgcccccctggcccccagcaacggcctgggccaggaggagctgcccagcaagaacggcggcagctacgccatccacgacagccaggcccccagcctgagcagcggcggcgagagcagccccagcagccccgcccacaactgggagatgaactaccaggaggccgccatctacctgcaggagggcgagaacaacgacaagttcttcacccaccccaaggacgccaaggccctggccgcctacctgttcgcccacaaccacctgttctacctgatggagctggccaccgccctgctgctgctgctgctgagcctgtgcgaggcccccgccgtgcccgccctgagactgggcatctacgtgcacgccaccctggagctgttcgccctgatggtggtggtgttcgagctgtgcatgaagctgagatggctgggcctgcacaccttcatcagacacaagagaaccatggtgaagaccagcgtgctggtggtgcagttcgtggaggccatcgtggtgctggtgagacagatgagccacgtgagagtgaccagagccctgagatgcatcttcctggtggactgcagatactgcggcggcgtgagaagaaacctgagacagatcttccagagcctgccccccttcatggacatcctgctgctgctgctgttcttcatgatcatcttcgccatcctgggcttctacctgttcagccccaaccccagcgacccctacttcagcaccctggagaacagcatcgtgagcctgttcgtgctgctgaccaccgccaacttccccgacgtgatgatgcccagctacagcagaaacccctggagctgcgtgttcttcatcgtgtacctgagcatcgagctgtacttcatcatgaacctgctgctggccgtggtgttcgacaccttcaacgacatcgagaagagaaagttcaagagcctgctgctgcacaagagaaccgccatccagcacgcctacagactgctgatcagccagagaagacccgccggcatcagctacagacagttcgagggcctgatgagattctacaagcccagaatgagcgccagagagagatacctgaccttcaaggccctgaaccagaacaacacccccctgctgagcctgaaggacttctacgacatctacgaggtggccgccctgaagtggaaggccaagaagaacagagagcactggttcgacgagctgcccagaaccgccctgctgatcttcaagggcatcaacatcctggtgaagagcaaggccttccagtacttcatgtacctggtggtggccgtgaacggcgtgtggatcctggtggagaccttcatgctgaagggcggcaacttcttcagcaagcacgtgccctggagctacctggtgttcctgaccatctacggcgtggagctgttcctgaaggtggccggcctgggccccgtggagtacctgagcagcggctggaacctgttcgacttcagcgtgaccgtgttcgccttcctgggcctgctggccctggccctgaacatggagcccttctacttcatcgtggtgctgagacccctgcagctgctgagactgttcaagctgaaggagagatacagaaacgtgctggacaccatgttcgagctgctgcccagaatggccagcctgggcctgaccctgctgatcttctactacagcttcgccatcgtgggcatggagttcttctgcggcatcgtgttccccaactgctgcaacaccagcaccgtggccgacgcctacagatggagaaaccacaccgtgggcaacagaaccgtggtggaggagggctactactacctgaacaacttcgacaacatcctgaacagcttcgtgaccctgttcgagctgaccgtggtgaacaactggtacatcatcatggagggcgtgaccagccagaccagccactggagcagactgtacttcatgaccttctacatcgtgaccatggtggtgatgaccatcatcgtggccttcatcctggaggccttcgtgttcagaatgaactacagcagaaagaaccaggacagcgaggtggacggcggcatcaccctggagaaggagatcagcaaggaggagctggtggccgtgctggagctgtacagagaggccagaggcgccagcagcgacgtgaccagactgctggagaccctgagccagatggagagataccagcagcacagcatggtgttcctgggcagaagaagcagaaccaagagcgacctgagcctgaagatgtaccaggaggagatccaggagtggtacgaggagcacgccagagagcaggagcagcagagacagctgagcagcagcgccgcccccgccgcccagcagccccccggcagcagacagagaagccagaccgtgacctag

SEQ ID NO: 104157 - DNA, 2667 bp, Artificial Sequence; identical to SEQ ID NO: 104156
  Description of Artificial Sequence: Synthetic coding sequence

SEQ ID NO: 104158 - DNA, 258 bp, Artificial Sequence
  Description of Artificial Sequence: Synthetic coding sequence
atggccgtgagcctggacgacgacgtgcccctgatcctgaccctggacgagggcggcagcgcccccctggcccccagcaacggcctgggccaggaggagctgcccagcaagaacggcggcagctacgccatccacgacagccaggcccccagcctgagcagcggcggcgagagcagccccagcagccccgcccacaactgggagatgaactaccaggaggccgccatctacctgcaggagggcgagaacaacgactag

SEQ ID NO: 104159 - DNA, 303 bp, Artificial Sequence
  Description of Artificial Sequence: Synthetic coding sequence
atggccgtgagcctggacgacgacgtgcccctgatcctgaccctggacgagggcggcagcgcccccctggcccccagcaacggcctgggccaggaggagctgcccagcaagagaagatgctgcatgctgtgcagcagcaagcagaagccctggatcccctgcagagtgatcagcgacgtggcctgcaaggccgccagctgcttcgagggcgccagcggcccctgcgacatcagcatgtgggagtgctacagagtgtgcaagcagatggccgccgccatgcccagcaccacccccagaccctag

SEQ ID NO: 104160 - DNA, 2259 bp, Artificial Sequence
  Description of Artificial Sequence: Synthetic coding sequence
atggccgagccccaggccgagagcgagcccctgctgggcggcgccagaggcggcggcggcgactggcccgccggcctgaccacctacagaagcatccaggtgggccccggcgccgccgccagatgggacctgtgcatcgaccaggccgtggtgttcatcgaggacgccatccagtacagaagcatcaaccacagagtggacgccagcagcatgtggctgtacagaagatactacagcaacgtgtgccagagaaccctgagcttcaccatcttcctgatcctgttcctggccttcatcgagacccccagcagcctgaccagcaccgccgacgtgagatacagagccgccccctgggagcccccctgcggcctgaccgagagcgtggaggtgctgtgcctgctggtgttcgccgccgacctgagcgtgaagggctacctgttcggctgggcccacttccagaagaacctgtggctgctgggctacctggtggtgctggtggtgagcctggtggactggaccgtgagcctgagcctggtgtgccacgagcccctgagaatcagaagactgctgagacccttcttcctgctgcagaacagcagcatgatgaagaagaccctgaagtgcatcagatggagcctgcccgagatggccagcgtgggcctgctgctggccatccacctgtgcctgttcaccatgttcggcatgctgctgttcgccggcggcaagcaggacgacggccaggacagagagagactgacctacttccagaacctgcccgagagcctgaccagcctgctggtgctgctgaccaccgccaacaaccccgacgtgatgatccccgcctacagcaagaacagagcctacgccatcttcttcatcgtgttcaccgtgatcggcagcctgttcctgatgaacctgctgaccgccatcatctacagccagttcagaggctacctgatgaagagcctgcagaccagcctgttcagaagaagactgggcaccagagccgccttcgaggtgctgagcagcatggtgggcgagggcggcgccttcccccaggccgtgggcgtgaagccccagaacctgctgcaggtgctgcagaaggtgcagctggacagcagccacaagcaggccatgatggagaaggtgagaagctacggcagcgtgctgctgagcgccgaggagttccagaagctgttcaacgagctggacagaagcgtggtgaaggagcacccccccagacccgagtaccagagccccttcctgcagagcgcccagttcctgttcggccactactacttcgactacctgggcaacctgatcgccctggccaacctggtgagcatctgcgtgttcctggtgctggacgccgacgtgctgcccgccgagagagacgacttcatcctgggcatcctgaactgcgtgttcatcgtgtactacctgctggagatgctgctgaaggtgttcgccctgggcctgagaggctacctgagctaccccagcaacgtgttcgacggcctgctgaccgtggtgctgctggtgctggagatcagcaccctggccgtgtacagactgccccaccccggctggagacccgagatggtgggcctgctgagcctgtgggacatgaccagaatgctgaacatgctgatcgtgttcagattcctgagaatcatccccagcatgaagctgatggccgtggtggccagcaccgtgctgggcctggtgcagaacatgagagccttcggcggcatcctggtggtggtgtactacgtgttcgccatcatcggcatcaacctgttcagaggcgtgatcgtggccctgcccggcaacagcagcctggcccccgccaacggcagcgccccctgcggcagcttcgagcagctggagtactgggccaacaacttcgacgacttcgccgccgccctggtgaccctgtggaacctgatggtggtgaacaactggcaggtgttcctggacgcctacagaagatacagcggcccctggagcaagatctacttcgtgctgtggtggctggtgagcagcgtgatctgggtgaacctgttcctggccctgatcctggagaacttcctgcacaagtgggaccccagaagccacctgcagcccctggccggcacccccgaggccacctaccagatgaccgtggagctgctgttcagagacatcctggaggagcccggcgaggacgagctgaccgagagactgagccagcacccccacctgtggctgtgcagatag

SEQ ID NO: 104161 - DNA, 1407 bp, Artificial Sequence
  Description of Artificial Sequence: Synthetic coding sequence
atgtggctgtacagaagatactacagcaacgtgtgccagagaaccctgagcttcaccatcttcctgatcctgttcctggccttcatcgagacccccagcagcctgaccagcaccgccgacgtgagatacagagccgccccctgggagcccccctgcggcctgaccgagagcgtggaggtgctgtgcctgctggtgttcgccgccgacctgagcgtgaagggctacctgttcggctgggcccacttccagaagaacctgtggctgctgggctacctggtggtgctggtggtgagcctggtggactggaccgtgagcctgagcctggtgtgccacgagcccctgagaatcagaagactgctgagacccttcttcctgctgcagaacagcagcatgatgaagaagaccctgaagtgcatcagatggagcctgcccgagatggccagcgtgggcctgctgctggccatccacctgtgcctgttcaccatgttcggcatgctgctgttcgccggcggcaagcaggacgacggccaggacagagagagactgacctacttccagaacctgcccgagagcctgaccagcctgctggtgctgctgaccaccgccaacaaccccgacgtgatgatccccgcctacagcaagaacagagcctacgccatcttcttcatcgtgttcaccgtgatcggcagcctgttcctgatgaacctgctgaccgccatcatctacagccagttcagaggctacctgatgaagagcctgcagaccagcctgttcagaagaagactgggcaccagagccgccttcgaggtgctgagcagcatggtgggcgagggcggcgccttcccccaggccaccagaagaggccccagcaccagcctgagattctgcagagcccccagcagcagcagcgccaccaccaccctgaccacctggggcaccagcagcccctggcagacctggtgccccttcgcctgcagctggtgctggatgcagatgtgctgcctgctgagcgtgatgaccagcagctggggcttcagcaccgccagcagcctgtgcaccacctgctggagatgctgcagcagaagcctgccctgggcctgcgagggcacctgccccacccccgccacctgcctgaccggcagcagccccctgagctgctggagacccgagatggtgggcctgctgagcctgtgggacatgaccagaatgctgaacatgctgatcgtgttcagattcctgagaatcatccccagcatgaagctgatggccgtggtggccagcaccgtgctgggcctggtgcagaacatgagagccttcggcggcatcctggtgcccggcccctgccagtggctgggcgccctgtgggagctgagagccgccggcgtgctgggccagcagctgagatag

SEQ ID NO: 104162 - DNA, 1584 bp, Artificial Sequence
  Description of Artificial Sequence: Synthetic coding sequence
atgatcctgagcagctacaacaccatccagagcgtgttctgctgctgctgctgctgcagcgtgcagaagagacagatgagaacccagatcagcctgagcaccgacgaggagctgcccgagaagtacacccagagaagaagaccctggctgagccagctgagcaacaagaagcagagcaacaccggcagagtgcagcccagcaagagaaagcccctgccccccctgccccccagcgaggtggccgaggagaagatccaggtgaaggccctgtacgacttcctgcccagagagccctgcaacctggccctgagaagagccgaggagtacctgatcctggagaagtacaacccccactggtggaaggccagagacagactgggcaacgagggcctgatccccagcaactacgtgaccgagaacaagatcaccaacctggagatctacgagtggtaccacagaaacatcaccagaaaccaggccgagcacctgctgagacaggagagcaaggagggcgccttcatcgtgagagacagcagacacctgggcagctacaccatcagcgtgttcatgggcgccagaagaagcaccgaggccgccatcaagcactaccagatcaagaagaacgacagcggccagtggtacgtggccgagagacacgccttccagagcatccccgagctgatctggtaccaccagcacaacgccgccggcctgatgaccagactgagataccccgtgggcctgatgggcagctgcctgcccgccaccgccggcttcagctacgagaagtgggagatcgaccccagcgagctggccttcatcaaggagatcggcagcggccagttcggcgtggtgcacctgggcgagtggagaagccacatccaggtggccatcaaggccatcaacgagggcagcatgagcgaggaggacttcatcgaggaggccaaggtgatgatgaagctgagccacagcaagctggtgcagctgtacggcgtgtgcatccagagaaagcccctgtacatcgtgaccgagttcatggagaacggctgcctgctgaactacctgagagagaacaagggcaagctgagaaaggagatgctgctgagcgtgtgccaggacatctgcgagggcatggagtacctggagagaaacggctacatccacagagacctggccgccagaaactgcctggtgagcagcacctgcatcgtgaagatcagcgacttcggcatgaccagatacgtgctggacgacgagtacgtgagcagcttcggcgccaagttccccatcaagtggagcccccccgaggtgttcctgttcaacaagtacagcagcaagagcgacgtgtggagcttcggcgtgctgatgtgggaggtgttcaccgagggcaagatgcccttcgagaacaagagcaacctgcaggtggtggaggccatcagcgagggcttcagactgtacagaccccacctggcccccatgagcatctacgaggtgatgtacagctgctggcacgagaagcccgagggcagacccaccttcgccgagctgctgagagccgtgaccgagatcgccgagacctggtag

SEQ ID NO: 104163 - DNA, 342 bp, Artificial Sequence
  Description of Artificial Sequence: Synthetic coding sequence
atgggcggcctggagccctgcagcagactgctgctgctgcccctgctgctggccgtgagcggcctgagacccgtgcaggcccaggcccagagcgactgcagctgcagcaccgtgagccccggcgtgctggccggcatcgtgatgggcgacctggtgctgaccgtgctgatcgccctggccgtgtacttcctgggcagactggtgcccagaggcagaggcgccgccgaggccgccaccagaaagcagagaatcaccgagaccgagagcccctaccaggagctgcagggccagagaagcgacgtgtacagcgacctgaacacccagagaccctactacaagtag

SEQ ID NO: 104164 - DNA, 339 bp, Artificial Sequence
  Description of Artificial Sequence: Synthetic coding sequence
atgggcggcctggagccctgcagcagactgctgctgctgcccctgctgctggccgtgagcggcctgagacccgtgcaggcccaggcccagagcgactgcagctgcagcaccgtgagccccggcgtgctggccggcatcgtgatgggcgacctggtgctgaccgtgctgatcgccctggccgtgtacttcctgggcagactggtgcccagaggcagaggcgccgccgaggccaccagaaagcagagaatcaccgagaccgagagcccctaccaggagctgcagggccagagaagcgacgtgtacagcgacctgaacacccagagaccctactacaagtag

SEQ ID NO: 104165 - DNA, 309 bp, Artificial Sequence
  Description of Artificial Sequence: Synthetic coding sequence
atgggcggcctggagccctgcagcagactgctgctgctgcccctgctgctggccgtgagcgactgcagctgcagcaccgtgagccccggcgtgctggccggcatcgtgatgggcgacctggtgctgaccgtgctgatcgccctggccgtgtacttcctgggcagactggtgcccagaggcagaggcgccgccgaggccgccaccagaaagcagagaatcaccgagaccgagagcccctaccaggagctgcagggccagagaagcgacgtgtacagcgacctgaacacccagagaccctactacaagtag

SEQ ID NO: 104166 - DNA, 339 bp, Artificial Sequence; identical to SEQ ID NO: 104164
  Description of Artificial Sequence: Synthetic coding sequence

SEQ ID NO: 104167 - DNA, 2673 bp, Artificial Sequence
  Description of Artificial Sequence: Synthetic coding sequence
atggccctgagaagaagcatgggcagacccggcctgccccccctgcccctgccccccccccccagactgggcctgctgctggccgccctggccagcctgctgctgcccgagagcgccgccgccggcctgaagctgatgggcgcccccgtgaagctgaccgtgagccagggccagcccgtgaagctgaactgcagcgtggagggcatggaggagcccgacatccagtgggtgaaggacggcgccgtggtgcagaacctggaccagctgtacatccccgtgagcgagcagcactggatcggcttcctgagcctgaagagcgtggagagaagcgacgccggcagatactggtgccaggtggaggacggcggcgagaccgagatcagccagcccgtgtggctgaccgtggagggcgtgcccttcttcaccgtggagcccaaggacctggccgtgccccccaacgcccccttccagctgagctgcgaggccgtgggcccccccgagcccgtgaccatcgtgtggtggagaggcaccaccaagatcggcggccccgcccccagccccagcgtgctgaacgtgaccggcgtgacccagagcaccatgttcagctgcgaggcccacaacctgaagggcctggccagcagcagaaccgccaccgtgcacctgcaggccctgcccgccgcccccttcaacatcaccgtgaccaagctgagcagcagcaacgccagcgtggcctggatgcccggcgccgacggcagagccctgctgcagagctgcaccgtgcaggtgacccaggcccccggcggctgggaggtgctggccgtggtggtgcccgtgccccccttcacctgcctgctgagagacctggtgcccgccaccaactacagcctgagagtgagatgcgccaacgccctgggccccagcccctacgccgactgggtgcccttccagaccaagggcctggcccccgccagcgccccccagaacctgcacgccatcagaaccgacagcggcctgatcctggagtgggaggaggtgatccccgaggcccccctggagggccccctgggcccctacaagctgagctgggtgcaggacaacggcacccaggacgagctgaccgtggagggcaccagagccaacctgaccggctgggacccccagaaggacctgatcgtgagagtgtgcgtgagcaacgccgtgggctgcggcccctggagccagcccctggtggtgagcagccacgacagagccggccagcagggccccccccacagcagaaccagctgggtgcccgtggtgctgggcgtgctgaccgccctggtgaccgccgccgccctggccctgatcctgctgagaaagagaagaaaggagaccagattcggccaggccttcgacagcgtgatggccagaggcgagcccgccgtgcacttcagagccgccagaagcttcaacagagagagacccgagagaatcgaggccaccctggacagcctgggcatcagcgacgagctgaaggagaagctggaggacgtgctgatccccgagcagcagttcaccctgggcagaatgctgggcaagggcgagttcggcagcgtgagagaggcccagctgaagcaggaggacggcagcttcgtgaaggtggccgtgaagatgctgaaggccgacatcatcgccagcagcgacatcgaggagttcctgagagaggccgcctgcatgaaggagttcgaccacccccacgtggccaagctggtgggcgtgagcctgagaagcagagccaagggcagactgcccatccccatggtgatcctgcccttcatgaagcacggcgacctgcacgccttcctgctggccagcagaatcggcgagaaccccttcaacctgcccctgcagaccctgatcagattcatggtggacatcgcctgcggcatggagtacctgagcagcagaaacttcatccacagagacctggccgccagaaactgcatgctggccgaggacatgaccgtgtgcgtggccgacttcggcctgagcagaaagatctacagcggcgactactacagacagggctgcgccagcaagctgcccgtgaagtggctggccctggagagcctggccgacaacctgtacaccgtgcagagcgacgtgtgggccttcggcgtgaccatgtgggagatcatgaccagaggccagaccccctacgccggcatcgagaacgccgagatctacaactacctgatcggcggcaacagactgaagcagccccccgagtgcatggaggacgtgtacgacctgatgtaccagtgctggagcgccgaccccaagcagagacccagcttcacctgcctgagaatggagctggagaacatcctgggccagctgagcgtgctgagcgccagccaggaccccctgtacatcaacatcgagagagccgaggagcccaccgccggcggcagcctggagctgcccggcagagaccagccctacagcggcgccggcgacggcagcggcatgggcgccgtgggcggcacccccagcgactgcagatacatcctgacccccggcggcctggccgagcagcccggccaggccgagcaccagcccgagagccccctgaacgagacccagagactgctgctgctgcagcagggcctgctgccccacagcagctgctag

SEQ ID NO: 104168 - DNA, 2529 bp, Artificial Sequence
  Description of Artificial Sequence: Synthetic coding sequence
atggaggagcccgacatccagtgggtgaaggacggcgccgtggtgcagaacctggaccagctgtacatccccgtgagcgagcagcactggatcggcttcctgagcctgaagagcgtggagagaagcgacgccggcagatactggtgccaggtggaggacggcggcgagaccgagatcagccagcccgtgtggctgaccgtggagggcgtgcccttcttcaccgtggagcccaaggacctggccgtgccccccaacgcccccttccagctgagctgcgaggccgtgggcccccccgagcccgtgaccatcgtgtggtggagaggcaccaccaagatcggcggccccgcccccagccccagcgtgctgaacgtgaccggcgtgacccagagcaccatgttcagctgcgaggcccacaacctgaagggcctggccagcagcagaaccgccaccgtgcacctgcaggccctgcccgccgcccccttcaacatcaccgtgaccaagctgagcagcagcaacgccagcgtggcctggatgcccggcgccgacggcagagccctgctgcagagctgcaccgtgcaggtgacccaggcccccggcggctgggaggtgctggccgtggtggtgcccgtgccccccttcacctgcctgctgagagacctggtgcccgccaccaactacagcctgagagtgagatgcgccaacgccctgggccccagcccctacgccgactgggtgcccttccagaccaagggcctggcccccgccagcgccccccagaacctgcacgccatcagaaccgacagcggcctgatcctggagtgggaggaggtgatccccgaggcccccctggagggccccctgggcccctacaagctgagctgggtgcaggacaacggcacccaggacgagctgaccgtggagggcaccagagccaacctgaccggctgggacccccagaaggacctgatcgtgagagtgtgcgtgagcaacgccgtgggctgcggcccctggagccagcccctggtggtgagcagccacgacagagccggccagcagggccccccccacagcagaaccagctgggtgcccgtggtgctgggcgtgctgaccgccctggtgaccgccgccgccctggccctgatcctgctgagaaagagaagaaaggagaccagattcggccaggccttcgacagcgtgatggccagaggcgagcccgccgtgcacttcagagccgccagaagcttcaacagagagagacccgagagaatcgaggccaccctggacagcctgggcatcagcgacgagctgaaggagaagctggaggacgtgctgatccccgagcagcagttcaccctgggcagaatgctgggcaagggcgagttcggcagcgtgagagaggcccagctgaagcaggaggacggcagcttcgtgaaggtggccgtgaagatgctgaaggccgacatcatcgccagcagcgacatcgaggagttcctgagagaggccgcctgcatgaaggagttcgaccacccccacgtggccaagctggtgggcgtgagcctgagaagcagagccaagggcagactgcccatccccatggtgatcctgcccttcatgaagcacggcgacctgcacgccttcctgctggccagcagaatcggcgagaaccccttcaacctgcccctgcagaccctgatcagattcatggtggacatcgcctgcggcatggagtacctgagcagcagaaacttcatccacagagacctggccgccagaaactgcatgctggccgaggacatgaccgtgtgcgtggccgacttcggcctgagcagaaagatctacagcggcgactactacagacagggctgcgccagcaagctgcccgtgaagtggctggccctggagagcctggccgacaacctgtacaccgtgcagagcgacgtgtgggccttcggcgtgaccatgtgggagatcatgaccagaggccagaccccctacgccggcatcgagaacgccgagatctacaactacctgatcggcggcaacagactgaagcagccccccgagtgcatggaggacgtgtacgacctgatgtaccagtgctggagcgccgaccccaagcagagacccagcttcacctgcctgagaatggagctggagaacatcctgggccagctgagcgtgctgagcgccagccaggaccccctgtacatcaacatcgagagagccgaggagcccaccgccggcggcagcctggagctgcccggcagagaccagccctacagcggcgccggcgacggcagcggcatgggcgccgtgggcggcacccccagcgactgcagatacatcctgacccccggcggcctggccgagcagcccggccaggccgagcaccagcccgagagccccctgaacgagacccagagactgctgctgctgcagcagggcctgcacaccgtggccgtgagcccccaggccgagggcatcggcgccatctggcccgccctggtggccaccgagctggccgactag

SEQ ID NO: 104169 - DNA, 741 bp, Artificial Sequence
  Description of Artificial Sequence: Synthetic coding sequence
atgaccatggacaagagcgagctggtgcagaaggccaagctggccgagcaggccgagagatacgacgacatggccgccgccatgaaggccgtgaccgagcagggccacgagctgagcaacgaggagagaaacctgctgagcgtggcctacaagaacgtggtgggcgccagaagaagcagctggagagtgatcagcagcatcgagcagaagaccgagagaaacgagaagaagcagcagatgggcaaggagtacagagagaagatcgaggccgagctgcaggacatctgcaacgacgtgctggagctgctggacaagtacctgatccccaacgccacccagcccgagagcaaggtgttctacctgaagatgaagggcgactacttcagatacctgagcgaggtggccagcggcgacaacaagcagaccaccgtgagcaacagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgaacgaggagagctacaaggacagcaccctgatcatgcagctgctgagagacaacctgaccctgtggaccagcgagaaccagggcgacgagggcgacgccggcgagggcgagaactag

SEQ ID NO: 104170 - DNA, 741 bp, Artificial Sequence; identical to SEQ ID NO: 104169
  Description of Artificial Sequence: Synthetic coding sequence

SEQ ID NO: 104171 - DNA, 303 bp, Artificial Sequence
  Description of Artificial Sequence: Synthetic coding sequence
atgaccatggacaagagcgagctggtgcagaaggccaagctggccgagcaggccgagagatacgacgacatggccgccgccatgaaggccgtgaccgagcagggccacgagctgagcaacgaggagagaaacctgctgagcgtggcctacaagaacgtggtgggcgccagaagaagcagctggagagtgatcagcagcatcgagcagaagaccgagagaaacgagaagaagcagcagatgggcaaggagtacagagagaagatcgaggccgagctgcaggacatctgcaacgacgtgctgtag

SEQ ID NO: 104172 - DNA, 225 bp, Artificial Sequence
  Description of Artificial Sequence: Synthetic coding sequence
atgaccatggacaagagcgagctggtgcagaaggccaagctggccgagcaggccgagagatacgacgacatggccgccgccatgaaggccgtgaccgagcagggccacgagctgagcaacgaggagagaaacctgctgagcgtggcctacaagaacgtggtgggcgccagaagaagcagctggagagtgatcagcagcatcgagcagaagaccgagagaaactag

SEQ ID NO: 104173 - DNA, 768 bp, Artificial Sequence
  Description of Artificial Sequence: Synthetic coding sequence
atggacgacagagaggacctggtgtaccaggccaagctggccgagcaggccgagagatacgacgagatggtggagagcatgaagaaggtggccggcatggacgtggagctgaccgtggaggagagaaacctgctgagcgtggcctacaagaacgtgatcggcgccagaagagccagctggagaatcatcagcagcatcgagcagaaggaggagaacaagggcggcgaggacaagctgaagatgatcagagagtacagacagatggtggagaccgagctgaagctgatctgctgcgacatcctggacgtgctggacaagcacctgatccccgccgccaacaccggcgagagcaaggtgttctactacaagatgaagggcgactaccacagatacctggccgagttcgccaccggcaacgacagaaaggaggccgccgagaacagcctggtggcctacaaggccgccagcgacatcgccatgaccgagctgccccccacccaccccatcagactgggcctggccctgaacttcagcgtgttctactacgagatcctgaacagccccgacagagcctgcagactggccaaggccgccttcgacgacgccatcgccgagctggacaccctgagcgaggagagctacaaggacagcaccctgatcatgcagctgctgagagacaacctgaccctgtggaccagcgacatgcagggcgacggcgaggagcagaacaaggaggccctgcaggacgtggaggacgagaaccagtag

SEQ ID NO: 104174 - DNA, 702 bp, Artificial Sequence
  Description of Artificial Sequence: Synthetic coding sequence
atggtggagagcatgaagaaggtggccggcatggacgtggagctgaccgtggaggagagaaacctgctgagcgtggcctacaagaacgtgatcggcgccagaagagccagctggagaatcatcagcagcatcgagcagaaggaggagaacaagggcggcgaggacaagctgaagatgatcagagagtacagacagatggtggagaccgagctgaagctgatctgctgcgacatcctggacgtgctggacaagcacctgatccccgccgccaacaccggcgagagcaaggtgttctactacaagatgaagggcgactaccacagatacctggccgagttcgccaccggcaacgacagaaaggaggccgccgagaacagcctggtggcctacaaggccgccagcgacatcgccatgaccgagctgccccccacccaccccatcagactgggcctggccctgaacttcagcgtgttctactacgagatcctgaacagccccgacagagcctgcagactggccaaggccgccttcgacgacgccatcgccgagctggacaccctgagcgaggagagctacaaggacagcaccctgatcatgcagctgctgagagacaacctgaccctgtggaccagcgacatgcagggcgacggcgaggagcagaacaaggaggccctgcaggacgtggaggacgagaaccagtag

SEQ ID NO: 104175 - DNA, 744 bp, Artificial Sequence
  Description of Artificial Sequence: Synthetic coding sequence
atggtggacagagagcagctggtgcagaaggccagactggccgagcaggccgagagatacgacgacatggccgccgccatgaagaacgtgaccgagctgaacgagcccctgagcaacgaggagagaaacctgctgagcgtggcctacaagaacgtggtgggcgccagaagaagcagctggagagtgatcagcagcatcgagcagaagaccagcgccgacggcaacgagaagaagatcgagatggtgagagcctacagagagaagatcgagaaggagctggaggccgtgtgccaggacgtgctgagcctgctggacaactacctgatcaagaactgcagcgagacccagtacgagagcaaggtgttctacctgaagatgaagggcgactactacagatacctggccgaggtggccaccggcgagaagagagccaccgtggtggagagcagcgagaaggcctacagcgaggcccacgagatcagcaaggagcacatgcagcccacccaccccatcagactgggcctggccctgaactacagcgtgttctactacgagatccagaacgcccccgagcaggcctgccacctggccaagaccgccttcgacgacgccatcgccgagctggacaccctgaacgaggacagctacaaggacagcaccctgatcatgcagctgctgagagacaacctgaccctgtggaccagcgaccagcaggacgacgacggcggcgagggcaacaactag

SEQ ID NO: 104176 - DNA, 624 bp, Artificial Sequence
  Description of Artificial Sequence: Synthetic coding sequence
atggtggacagagagcagctggtgcagaaggccagactggccgagcaggccgagagatacgacgacatggccgccgccatgaagaacgtgaccgagctgaacgagcccctgagcaacgaggagagaaacctgctgagcgtggcctacaagaacgtggtgggcgccagaagaagcagctggagagtgatcagcagcatcgagcagaagaccagcgccgacggcaacgagaagaagatcgagatggtgagagcctacagagagaagatcgagaaggagctggaggccgaggtggccaccggcgagaagagagccaccgtggtggagagcagcgagaaggcctacagcgaggcccacgagatcagcaaggagcacatgcagcccacccaccccatcagactgggcctggccctgaactacagcgtgttctactacgagatccagaacgcccccgagcaggcctgccacctggccaagaccgccttcgacgacgccatcgccgagctggacaccctgaacgaggacagctacaaggacagcaccctgatcatgcagctgctgagagacaacctgaccctgtggaccagcgaccagcaggacgacgacggcggcgagggcaacaactag

SEQ ID NO: 104177 - DNA, 678 bp, Artificial Sequence
  Description of Artificial Sequence: Synthetic coding sequence
atggccgccgccatgaagaacgtgaccgagctgaacgagcccctgagcaacgaggagagaaacctgctgagcgtggcctacaagaacgtggtgggcgccagaagaagcagctggagagtgatcagcagcatcgagcagaagaccagcgccgacggcaacgagaagaagatcgagatggtgagagcctacagagagaagatcgagaaggagctggaggccgtgtgccaggacgtgctgagcctgctggacaactacctgatcaagaactgcagcgagacccagtacgagagcaaggtgttctacctgaagatgaagggcgactactacagatacctggccgaggtggccaccggcgagaagagagccaccgtggtggagagcagcgagaaggcctacagcgaggcccacgagatcagcaaggagcacatgcagcccacccaccccatcagactgggcctggccctgaactacagcgtgttctactacgagatccagaacgcccccgagcaggcctgccacctggccaagaccgccttcgacgacgccatcgccgagctggacaccctgaacgaggacagctacaaggacagcaccctgatcatgcagctgctgagagacaacctgaccctgtggaccagcgaccagcaggacgacgacggcggcgagggcaacaactag

SEQ ID NO: 104178 - DNA, 738 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagcagcagatggccagagagtacagagagaagatcgagaccgagctgagagacatctgcaacgacgtgctgagcctgctggagaagttcctgatccccaacgccagccaggccgagagcaaggtgttctacctgaagatgaagggcgactactacagatacctggccgaggtggccgccggcgacgacaagaagggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgaggccggcgagggcggcgagaactag

SEQ ID NO: 104179 - DNA, 507 bp, Artificial Sequence
  Description of Artificial Sequence: Synthetic coding sequence
atggccagagagtacagagagaagatcgagaccgagctgagagacatctgcaacgacgtgctgagcctgctggagaagttcctgatccccaacgccagccaggccgagagcaaggtgttctacctgaagatgaagggcgactactacagatacctggccgaggtggccgccggcgacgacaagaagggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgaggccggcgagggcggcgagaactag

SEQ ID NO: 104180 - DNA, 738 bp, Artificial Sequence; identical to SEQ ID NO: 104178
  Description of Artificial Sequence: Synthetic coding sequence

SEQ ID NO: 104181 - DNA, 738 bp, Artificial Sequence; identical to SEQ ID NO: 104178
  Description of Artificial Sequence: Synthetic coding sequence

SEQ ID NO: 104182 - DNA, 738 bp, Artificial Sequence; identical to SEQ ID NO: 104178
  Description of Artificial Sequence: Synthetic coding sequence

SEQ ID NO: 104183 - DNA, 738 bp, Artificial Sequence; identical to SEQ ID NO: 104178
  Description of Artificial Sequence: Synthetic coding sequence

SEQ ID NO: 104184 - DNA, 738 bp, Artificial Sequence; identical to SEQ ID NO: 104178
  Description of Artificial Sequence: Synthetic coding sequence

SEQ ID NO: 104185 - DNA, 297 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagcagcagatggccagagagtacagagagaagatcgagaccgagctgagagacatctgcaacgacgtgctgtag

SEQ ID NO: 104186 - DNA, 738 bp, Artificial Sequence; identical to SEQ ID NO: 104178
  Description of Artificial Sequence: Synthetic coding sequence

SEQ ID NO: 104187 - DNA, 279 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagcagcagatggccagagagtacagagagaagatcgagaccgagctgagagactag

SEQ ID NO: 104188 - DNA, 738 bp, Artificial Sequence; identical to SEQ ID NO: 104178
  Description of Artificial Sequence: Synthetic coding sequence

SEQ ID NO: 104189 - DNA, 507 bp, Artificial Sequence; identical to SEQ ID NO: 104179
  Description of Artificial Sequence: Synthetic coding sequence

SEQ ID NO: 104190 - DNA, 378 bp, Artificial Sequence
  Description of Artificial Sequence: Synthetic coding sequence
atgaagggcgactactacagatacctggccgaggtggccgccggcgacgacaagaagggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgaggccggcgagggcggcgagaactag

SEQ ID NO: 104191 - DNA, 414 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagcagcagatggccagagagtacagagagaagatcgagaccgagctgagagacatctgcaacgacgtgctgagcctgctggagaagttcctgatccccaacgccagccaggccgagagcaaggtgttctacctgaagatgaagggcgactactacagatacctggccgaggtggccgccggcgacgactag

SEQ ID NO: 104192 - DNA, 741 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagcagcagatggccagagagtacagagagaagatcgagaccgagctgagagacatctgcaacgacgtgctgagcctgctggagaagttcctgatccccaacgccagccaggccgagagcaaggtgttctacctgaagatgaagggcgactactacagatacctggccgaggtggccgccggcgacgacaagaaggtgagattcggcgtgagctaccccggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgagtag

SEQ ID NO: 104193 - DNA, 513 bp, Artificial Sequence
  Description of Artificial Sequence: Synthetic coding sequence
atgagccagccctgcagaaagctgtggagacacaactacgagaccagcagctgcatcgagttcctgaagagcctgctggagaagttcctgatccccaacgccagccaggccgagagcaaggtgttctacctgaagatgaagggcgactactacagatacctggccgaggtggccgccggcgacgacaagaagggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgaggccggcgagggcggcgagaactag

SEQ ID NO: 104194 - DNA, 378 bp, Artificial Sequence; identical to SEQ ID NO: 104190
  Description of Artificial Sequence: Synthetic coding sequence

SEQ ID NO: 104195 - DNA, 228 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgggcgccagaagaagcagctggagagtggtgagcagcatcgagcagaagaccgagggcgccgagaagaagtag

SEQ ID NO: 104196 - DNA, 393 bp, Artificial Sequence
  Description of Artificial Sequence: Synthetic coding sequence
gtgttctacctgaagatgaagggcgactactacagatacctggccgaggtggccgccggcgacgacaagaagggcatcgtggaccagagccagcaggcctaccaggaggccttcgagatcagcaagaaggagatgcagcccacccaccccatcagactgggcctggccctgaacttcagcgtgttctactacgagatcctgaacagccccgagaaggcctgcagcctggccaagaccgccttcgacgaggccatcgccgagctggacaccctgagcgaggagagctacaaggacagcaccctgatcatgcagctgctgagagacaacctgaccctgtggaccagcgacacccagggcgacgaggccgaggccggcgagggcggcgagaactag

SEQ ID NO: 104197 - DNA, 159 bp, Artificial Sequence
  Description of Artificial Sequence: Synthetic coding sequence
atggacaagaacgagctggtgcagaaggccaagctggccgagcaggccgagagatacgacgacatggccgcctgcatgaagagcgtgaccgagcagggcgccgagctgagcaacgaggagagaaacctgctgagcgtggcctacaagaacgtggtgtag

SEQ ID NO: 104198 - DNA, 1224 bp, Artificial Sequence
  Description of Artificial Sequence: Synthetic coding sequence
atgcccacccccgacgccaccaccccccaggccaagggcttcagaagagccgtgagcgagctggacgccaagcaggccgaggccatcatggtgagaggccagagccccagattcatcggcagaagacagagcctgatcgaggacgccagaaaggagagagaggccgccgtggccgccgccgccgccgccgtgcccagcgagcccggcgaccccctggaggccgtggccttcgaggagaaggagggcaaggccgtgctgaacctgctgttcagccccagagccaccaagcccagcgccctgagcagagccgtgaaggtgttcgagaccttcgaggccaagatccaccacctggagaccagacccgcccagagacccagagccggcggcccccacctggagtacttcgtgagactggaggtgagaagaggcgacctggccgccctgctgagcggcgtgagacaggtgagcgaggacgtgagaagccccgccggccccaaggtgccctggttccccagaaaggtgagcgagctggacaagtgccaccacctggtgaccaagttcgaccccgacctggacctggaccaccccggcttcagcgaccaggtgtacagacagagaagaaagctgatcgccgagatcgccttccagtacagacacggcgaccccatccccagagtggagtacaccgccgaggagatcgccacctgggactgctgccacgagctgctgggccacgtgcccatgctggccgacagaaccttcgcccagttcagccaggacatcggcctggccagcctgggcgccagcgacgaggagatcgagaagctgagcaccctgtactggttcaccgtggagttcggcctgtgcaagcagaacggcgaggtgaaggcctacggcgccggcctgctgagcagctacggcgagctgctgcactgcctgagcgaggagcccgagatcagagccttcgaccccgaggccgccgccgtgcagccctaccaggaccagacctaccagagcgtgtacttcgtgagcgagagcttcagcgacgccaaggacaagctgagaagctacgccagcagaatccagagacccttcagcgtgaagttcgacccctacaccctggccatcgacgtgctggacagcccccaggccgtgagaagaagcctggagggcgtgcaggacgagctggacaccctggcccacgccctgagcgccatcggctag

SEQ ID NO: 104199 - DNA, 1494 bp, Artificial Sequence
  Description of Artificial Sequence: Synthetic coding sequence
atgcccacccccgacgccaccaccccccaggccaagggcttcagaagagccgtgagcgagctggacgccaagcaggccgaggccatcatgagccccagattcatcggcagaagacagagcctgatcgaggacgccagaaaggagagagaggccgccgtggccgccgccgccgccgccgtgcccagcgagcccggcgaccccctggaggccgtggccttcgaggagaaggagggcaaggccgtgctgaacctgctgttcagccccagagccaccaagcccagcgccctgagcagagccgtgaaggtgttcgagaccttcgaggccaagatccaccacctggagaccagacccgcccagagacccagagccggcggcccccacctggagtacttcgtgagactggaggtgagaagaggcgacctggccgccctgctgagcggcgtgagacaggtgagcgaggacgtgagaagccccgccggccccaaggtgccctggttccccagaaaggtgagcgagctggacaagtgccaccacctggtgaccaagttcgaccccgacctggacctggaccaccccggcttcagcgaccaggtgtacagacagagaagaaagctgatcgccgagatcgccttccagtacagacacggcgaccccatccccagagtggagtacaccgccgaggagatcgccacctggaaggaggtgtacaccaccctgaagggcctgtacgccacccacgcctgcggcgagcacctggaggccttcgccctgctggagagattcagcggctacagagaggacaacatcccccagctggaggacgtgagcagattcctgaaggagagaaccggcttccagctgagacccgtggccggcctgctgagcgccagagacttcctggccagcctggccttcagagtgttccagtgcacccagtacatcagacacgccagcagccccatgcacagccccgagcccgactgctgccacgagctgctgggccacgtgcccatgctggccgacagaaccttcgcccagttcagccaggacatcggcctggccagcctgggcgccagcgacgaggagatcgagaagctgagcaccctgtactggttcaccgtggagttcggcctgtgcaagcagaacggcgaggtgaaggcctacggcgccggcctgctgagcagctacggcgagctgctgcactgcctgagcgaggagcccgagatcagagccttcgaccccgaggccgccgccgtgcagccctaccaggaccagacctaccagagcgtgtacttcgtgagcgagagcttcagcgacgccaaggacaagctgagaagctacgccagcagaatccagagacccttcagcgtgaagttcgacccctacaccctggccatcgacgtgctggacagcccccaggccgtgagaagaagcctggagggcgtgcaggacgagctggacaccctggcccacgccctgagcgccatcggctag

SEQ ID NO: 104200 - DNA, 1575 bp, Artificial Sequence
  Description of Artificial Sequence: Synthetic coding sequence
atgcccacccccgacgccaccaccccccaggccaagggcttcagaagagccgtgagcgagctggacgccaagcaggccgaggccatcatgggcgcccccggccccagcctgaccggcagcccctggcccggcaccgccgcccccgccgccagctacacccccacccccagaagccccagattcatcggcagaagacagagcctgatcgaggacgccagaaaggagagagaggccgccgtggccgccgccgccgccgccgtgcccagcgagcccggcgaccccctggaggccgtggccttcgaggagaaggagggcaaggccgtgctgaacctgctgttcagccccagagccaccaagcccagcgccctgagcagagccgtgaaggtgttcgagaccttcgaggccaagatccaccacctggagaccagacccgcccagagacccagagccggcggcccccacctggagtacttcgtgagactggaggtgagaagaggcgacctggccgccctgctgagcggcgtgagacaggtgagcgaggacgtgagaagccccgccggccccaaggtgccctggttccccagaaaggtgagcgagctggacaagtgccaccacctggtgaccaagttcgaccccgacctggacctggaccaccccggcttcagcgaccaggtgtacagacagagaagaaagctgatcgccgagatcgccttccagtacagacacggcgaccccatccccagagtggagtacaccgccgaggagatcgccacctggaaggaggtgtacaccaccctgaagggcctgtacgccacccacgcctgcggcgagcacctggaggccttcgccctgctggagagattcagcggctacagagaggacaacatcccccagctggaggacgtgagcagattcctgaaggagagaaccggcttccagctgagacccgtggccggcctgctgagcgccagagacttcctggccagcctggccttcagagtgttccagtgcacccagtacatcagacacgccagcagccccatgcacagccccgagcccgactgctgccacgagctgctgggccacgtgcccatgctggccgacagaaccttcgcccagttcagccaggacatcggcctggccagcctgggcgccagcgacgaggagatcgagaagctgagcaccctgtactggttcaccgtggagttcggcctgtgcaagcagaacggcgaggtgaaggcctacggcgccggcctgctgagcagctacggcgagctgctgcactgcctgagcgaggagcccgagatcagagccttcgaccccgaggccgccgccgtgcagccctaccaggaccagacctaccagagcgtgtacttcgtgagcgagagcttcagcgacgccaaggacaagctgagaagctacgccagcagaatccagagacccttcagcgtgaagttcgacccctacaccctggccatcgacgtgctggacagcccccaggccgtgagaagaagcctggagggcgtgcaggacgagctggacaccctggcccacgccctgagcgccatcggctag

SEQ ID NO: 104201 - DNA, 1587 bp, Artificial Sequence
  Description of Artificial Sequence: Synthetic coding sequence
atgcccacccccgacgccaccaccccccaggccaagggcttcagaagagccgtgagcgagctggacgccaagcaggccgaggccatcatggtgagaggccagggcgcccccggccccagcctgaccggcagcccctggcccggcaccgccgcccccgccgccagctacacccccacccccagaagccccagattcatcggcagaagacagagcctgatcgaggacgccagaaaggagagagaggccgccgtggccgccgccgccgccgccgtgcccagcgagcccggcgaccccctggaggccgtggccttcgaggagaaggagggcaaggccgtgctgaacctgctgttcagccccagagccaccaagcccagcgccctgagcagagccgtgaaggtgttcgagaccttcgaggccaagatccaccacctggagaccagacccgcccagagacccagagccggcggcccccacctggagtacttcgtgagactggaggtgagaagaggcgacctggccgccctgctgagcggcgtgagacaggtgagcgaggacgtgagaagccccgccggccccaaggtgccctggttccccagaaaggtgagcgagctggacaagtgccaccacctggtgaccaagttcgaccccgacctggacctggaccaccccggcttcagcgaccaggtgtacagacagagaagaaagctgatcgccgagatcgccttccagtacagacacggcgaccccatccccagagtggagtacaccgccgaggagatcgccacctggaaggaggtgtacaccaccctgaagggcctgtacgccacccacgcctgcggcgagcacctggaggccttcgccctgctggagagattcagcggctacagagaggacaacatcccccagctggaggacgtgagcagattcctgaaggagagaaccggcttccagctgagacccgtggccggcctgctgagcgccagagacttcctggccagcctggccttcagagtgttccagtgcacccagtacatcagacacgccagcagccccatgcacagccccgagcccgactgctgccacgagctgctgggccacgtgcccatgctggccgacagaaccttcgcccagttcagccaggacatcggcctggccagcctgggcgccagcgacgaggagatcgagaagctgagcaccctgtactggttcaccgtggagttcggcctgtgcaagcagaacggcgaggtgaaggcctacggcgccggcctgctgagcagctacggcgagctgctgcactgcctgagcgaggagcccgagatcagagccttcgaccccgaggccgccgccgtgcagccctaccaggaccagacctaccagagcgtgtacttcgtgagcgagagcttcagcgacgccaaggacaagctgagaagctacgccagcagaatccagagacccttcagcgtgaagttcgacccctacaccctggccatcgacgtgctggacagcccccaggccgtgagaagaagcctggagggcgtgcaggacgagctggacaccctggcccacgccctgagcgccatcggctag

SEQ ID NO: 104202 - DNA, 3564 bp, Artificial Sequence
  Description of Artificial Sequence: Synthetic coding sequence
atgcccctgagacactggggcatggccagaggcagcaagcccgtgggcgacggcgcccagcccatggccgccatgggcggcctgaaggtgctgctgcactgggccggccccggcggcggcgagccctgggtgaccttcagcgagagcagcctgaccgccgaggaggtgtgcatccacatcgcccacaaggtgggcatcacccccccctgcttcaacctgttcgccctgttcgacgcccaggcccaggtgtggctgccccccaaccacatcctggagatccccagagacgccagcctgatgctgtacttcagaatcagattctacttcagaaactggcacggcatgaaccccagagagcccgccgtgtacagatgcggcccccccggcaccgaggccagcagcgaccagaccgcccagggcatgcagctgctggaccccgccagcttcgagtacctgttcgagcagggcaagcacgagttcgtgaacgacgtggccagcctgtgggagctgagcaccgaggaggagatccaccacttcaagaacgagagcctgggcatggccttcctgcacctgtgccacctggccctgagacacggcatccccctggaggaggtggccaagaagaccagcttcaaggactgcatccccagaagcttcagaagacacatcagacagcacagcgccctgaccagactgagactgagaaacgtgttcagaagattcctgagagacttccagcccggcagactgagccagcagatggtgatggtgaagtacctggccaccctggagagactggcccccagattcggcaccgagagagtgcccgtgtgccacctgagactgctggcccaggccgagggcgagccctgctacatcagagacagcggcgtggcccccaccgaccccggccccgagagcgccgccggcccccccacccacgaggtgctggtgaccggcaccggcggcatccagtggtggcccgtggaggaggaggtgaacaaggaggagggcagcagcggcagcagcggcagaaacccccaggccagcctgttcggcaagaaggccaaggcccacaaggccgtgggccagcccgccgacagacccagagagcccctgtgggcctacttctgcgacttcagagacatcacccacgtggtgctgaaggagcactgcgtgagcatccacagacaggacaacaagtgcctggagctgagcctgcccagcagagccgccgccctgagcttcgtgagcctggtggacggctacttcagactgaccgccgacagcagccactacctgtgccacgaggtggccccccccagactggtgatgagcatcagagacggcatccacggccccctgctggagcccttcgtgcaggccaagctgagacccgaggacggcctgtacctgatccactggagcaccagccacccctacagactgatcctgaccgtggcccagagaagccaggcccccgacggcatgcagagcctgagactgagaaagttccccatcgagcagcaggacggcgccttcgtgctggagggctggggcagaagcttccccagcgtgagagagctgggcgccgccctgcagggctgcctgctgagagccggcgacgactgcttcagcctgagaagatgctgcctgccccagcccggcgagaccagcaacctgatcatcatgagaggcgccagagccagccccagaaccctgaacctgagccagctgagcttccacagagtggaccagaaggagatcacccagctgagccacctgggccagggcaccagaaccaacgtgtacgagggcagactgagagtggagggcagcggcgaccccgaggagggcaagatggacgacgaggaccccctggtgcccggcagagacagaggccaggagctgagagtggtgctgaaggtgctggaccccagccaccacgacatcgccctggccttctacgagaccgccagcctgatgagccaggtgagccacacccacctggccttcgtgcacggcgtgtgcgtgagaggccccgagaacatcatggtgaccgagtacgtggagcacggccccctggacgtgtggctgagaagagagagaggccacgtgcccatggcctggaagatggtggtggcccagcagctggccagcgccctgagctacctggagaacaagaacctggtgcacggcaacgtgtgcggcagaaacatcctgctggccagactgggcctggccgagggcaccagccccttcatcaagctgagcgaccccggcgtgggcctgggcgccctgagcagagaggagagagtggagagaatcccctggctggcccccgagtgcctgcccggcggcgccaacagcctgagcaccgccatggacaagtggggcttcggcgccaccctgctggagatctgcttcgacggcgaggcccccctgcagagcagaagccccagcgagaaggagcacttctaccagagacagcacagactgcccgagcccagctgcccccagctggccaccctgaccagccagtgcctgacctacgagcccacccagagacccagcttcagaaccatcctgagagacctgaccagactgcagccccacaacctggccgacgtgctgaccgtgaaccccgacagccccgccagcgaccccaccgtgttccacaagagatacctgaagaagatcagagacctgggcgagggccacttcggcaaggtgagcctgtactgctacgaccccaccaacgacggcaccggcgagatggtggccgtgaaggccctgaaggccgactgcggcccccagcacagaagcggctggaagcaggagatcgacatcctgagaaccctgtaccacgagcacatcatcaagtacaagggctgctgcgaggaccagggcgagaagagcctgcagctggtgatggagtacgtgcccctgggcagcctgagagactacctgcccagacacagcatcggcctggcccagctgctgctgttcgcccagcagatctgcgagggcatggcctacctgcacgcccagcactacatccacagagacctggccgccagaaacgtgctgctggacaacgacagactggtgaagatcggcgacttcggcctggccaaggccgtgcccgagggccacgagtactacagagtgagagaggacggcgacagccccgtgttctggtacgcccccgagtgcctgaaggagtacaagttctactacgccagcgacgtgtggagcttcggcgtgaccctgtacgagctgctgacccactgcgacagcagccagagcccccccaccaagttcctggagctgatcggcatcgcccagggccagatgaccgtgctgagactgaccgagctgctggagagaggcgagagactgcccagacccgacaagtgcccctgcgaggtgtaccacctgatgaagaactgctgggagaccgaggccagcttcagacccaccttcgagaacctgatccccatcctgaagaccgtgcacgagaagtaccagggccaggcccccagcgtgttcagcgtgtgctag

SEQ ID NO: 104203 - DNA, 3564 bp, Artificial Sequence; identical to SEQ ID NO: 104202
  Description of Artificial Sequence: Synthetic coding sequence

SEQ ID NO: 104204 - DNA, 357 bp, Artificial Sequence
  Description of Artificial Sequence: Synthetic coding sequence
atgcccctgagacactggggcatggccagaggcagcaagcccgtgggcgacggcgcccagcccatggccgccatgggcggcctgaaggtgctgctgcactgggccggccccggcggcggcgagccctgggtgaccttcagcgagagcagcctgaccgccgaggaggtgtgcatccacatcgcccacaaggtgggcatcacccccccctgcttcaacctgttcgccctgttcgacgcccaggcccaggtgtggctgccccccaaccacatcctggagatccccagagacgccagcctgatgctgtacttcagaatcagattctacttcagaaactggcacggcatgaaccccagatag

SEQ ID NO: 104205 - DNA, 2805 bp, Artificial Sequence
  Description of Artificial Sequence: Synthetic coding sequence
atggtgatggtgaagtacctggccaccctggagagactggcccccagattcggcaccgagagagtgcccgtgtgccacctgagactgctggcccaggccgagggcgagccctgctacatcagagacagcggcgtggcccccaccgaccccggccccgagagcgccgccggcccccccacccacgaggtgctggtgaccggcaccggcggcatccagtggtggcccgtggaggaggaggtgaacaaggaggagggcagcagcggcagcagcggcagaaacccccaggccagcctgttcggcaagaaggccaaggcccacaaggccgtgggccagcccgccgacagacccagagagcccctgtgggcctacttctgcgacttcagagacatcacccacgtggtgctgaaggagcactgcgtgagcatccacagacaggacaacaagtgcctggagctgagcctgcccagcagagccgccgccctgagcttcgtgagcctggtggacggctacttcagactgaccgccgacagcagccactacctgtgccacgaggtggccccccccagactggtgatgagcatcagagacggcatccacggccccctgctggagcccttcgtgcaggccaagctgagacccgaggacggcctgtacctgatccactggagcaccagccacccctacagactgatcctgaccgtggcccagagaagccaggcccccgacggcatgcagagcctgagactgagaaagttccccatcgagcagcaggacggcgccttcgtgctggagggctggggcagaagcttccccagcgtgagagagctgggcgccgccctgcagggctgcctgctgagagccggcgacgactgcttcagcctgagaagatgctgcctgccccagcccggcgagaccagcaacctgatcatcatgagaggcgccagagccagccccagaaccctgaacctgagccagctgagcttccacagagtggaccagaaggagatcacccagctgagccacctgggccagggcaccagaaccaacgtgtacgagggcagactgagagtggagggcagcggcgaccccgaggagggcaagatggacgacgaggaccccctggtgcccggcagagacagaggccaggagctgagagtggtgctgaaggtgctggaccccagccaccacgacatcgccctggccttctacgagaccgccagcctgatgagccaggtgagccacacccacctggccttcgtgcacggcgtgtgcgtgagaggccccgagaacatcatggtgaccgagtacgtggagcacggccccctggacgtgtggctgagaagagagagaggccacgtgcccatggcctggaagatggtggtggcccagcagctggccagcgccctgagctacctggagaacaagaacctggtgcacggcaacgtgtgcggcagaaacatcctgctggccagactgggcctggccgagggcaccagccccttcatcaagctgagcgaccccggcgtgggcctgggcgccctgagcagagaggagagagtggagagaatcccctggctggcccccgagtgcctgcccggcggcgccaacagcctgagcaccgccatggacaagtggggcttcggcgccaccctgctggagatctgcttcgacggcgaggcccccctgcagagcagaagccccagcgagaaggagcacttctaccagagacagcacagactgcccgagcccagctgcccccagctggccaccctgaccagccagtgcctgacctacgagcccacccagagacccagcttcagaaccatcctgagagacctgaccagactgcagccccacaacctggccgacgtgctgaccgtgaaccccgacagccccgccagcgaccccaccgtgttccacaagagatacctgaagaagatcagagacctgggcgagggccacttcggcaaggtgagcctgtactgctacgaccccaccaacgacggcaccggcgagatggtggccgtgaaggccctgaaggccgactgcggcccccagcacagaagcggctggaagcaggagatcgacatcctgagaaccctgtaccacgagcacatcatcaagtacaagggctgctgcgaggaccagggcgagaagagcctgcagctggtgatggagtacgtgcccctgggcagcctgagagactacctgcccagacacagcatcggcctggcccagctgctgctgttcgcccagcagatctgcgagggcatggcctacctgcacgcccagcactacatccacagagacctggccgccagaaacgtgctgctggacaacgacagactggtgaagatcggcgacttcggcctggccaaggccgtgcccgagggccacgagtactacagagtgagagaggacggcgacagccccgtgttctggtacgcccccgagtgcctgaaggagtacaagttctactacgccagcgacgtgtggagcttcggcgtgaccctgtacgagctgctgacccactgcgacagcagccagagcccccccaccaagttcctggagctgatcggcatcgcccagggccagatgaccgtgctgagactgaccgagctgctggagagaggcgagagactgcccagacccgacaagtgcccctgcgaggtgtaccacctgatgaagaactgctgggagaccgaggccagcttcagacccaccttcgagaacctgatccccatcctgaagaccgtgcacgagaagtaccagggccaggcccccagcgtgttcagcgtgtgctag

SEQ ID NO: 104206 - DNA, 1986 bp, Artificial Sequence
  Description of Artificial Sequence: Synthetic coding sequence
atgctgcccgaggccggcagcctgtggctgctgaagctgctgagagacatccagctggcccagttctactggcccatcctggaggagctgaacgtgaccagacccgagcacttcgacttcgtgaagcccgaggacctggacggcatcggcatgggcagacccgcccagagaagactgagcgaggccctgaagagactgagaagcggccccaagagcaagaactgggtgtacaagatcctgggcggcttcgcccccgagcacaaggagcccaccctgcccagcgacagccccagacacctgcccgagcccgagggcggcctgaagtgcctgatccccgagggcgccgtgtgcagaggcgagctgctgggcagcggctgcttcggcgtggtgcacagaggcctgtggaccctgcccagcggcaagagcgtgcccgtggccgtgaagagcctgagagtgggccccgagggccccatgggcaccgagctgggcgacttcctgagagaggtgagcgtgatgatgaacctggagcacccccacgtgctgagactgcacggcctggtgctgggccagcccctgcagatggtgatggagctggcccccctgggcagcctgcacgccagactgaccgcccccgcccccaccccccccctgctggtggccctgctgtgcctgttcctgagacagctggccggcgccatggcctacctgggcgccagaggcctggtgcacagagacctggccaccagaaacctgctgctggccagccccagaaccatcaaggtggccgacttcggcctggtgagacccctgggcggcgccagaggcagatacgtgatgggcggccccagacccatcccctacgcctggtgcgcccccgagagcctgagacacggcgccttcagcagcgccagcgacgtgtggatgttcggcgtgaccctgtgggagatgttcagcggcggcgaggagccctgggccggcgtgcccccctacctgatcctgcagagactggaggacagagccagactgcccagaccccccctgtgcagcagagccctgtacagcctggccctgagatgctgggccccccaccccgccgacagacccagcttcagccacctggagggcctgctgcaggaggccggccccagcgaggcctgctgcgtgagagacgtgaccgagcccggcgccctgagaatggagaccggcgaccccatcaccgtgatcgagggcagccccgacagcaccatctggaagggccagaacggcagaaccttcaaggtgggcagcttccccgccagcgccgtgaccctggccgacgccggcggcctgcccgccaccagacccgtgcacagaggcacccccgccagaggcgaccagcaccccggcagcatcgacggcgacagaaagaaggccaacctgtgggacgccccccccgccagaggccagagaagaaacatgcccctggagagaatgaagggcatcagcagaagcctggagagcgtgctgagcctgggccccagacccaccggcggcggcagcagcccccccgagatcagacaggccagagccgtgccccagggcccccccggcctgccccccagaccccccctgagcagcagcagcccccagcccagccagcccagcagagagagactgccctggcccaagagaaagcccccccacaaccaccccatgggcatgcccggcgccagaaaggccgccgccctgagcggcggcctgctgagcgaccccgagctgcagagaaagatcatggaggtggagctgagcgtgcacggcgtgacccaccaggagtgccagaccgccctgggcgccaccggcggcgacgtggtgagcgccatcagaaacctgaaggtggaccagctgttccacctgagcagcagaagcagagccgactgctggagaatcctggagcactaccagtgggacctgagcgccgccagcagatacgtgctggccagaccctag

SEQ ID NO: 104207 - DNA, 1986 bp, Artificial Sequence; identical to SEQ ID NO: 104206
  Description of Artificial Sequence: Synthetic coding sequence

SEQ ID NO: 104208 - DNA, 1587 bp, Artificial Sequence
  Description of Artificial Sequence: Synthetic coding sequence
atgcagcccgaggagggcaccggctggctgctggagctgctgagcgaggtgcagctgcagcagtacttcctgagactgagagacgacctgaacgtgaccagactgagccacttcgagtacgtgaagaacgaggacctggagaagatcggcatgggcagacccggccagagaagactgtgggaggccgtgaagagaagaaaggccctgtgcaagagaaagagctggatgagcaaggtgttcagcggcaagagactggaggccgagttccccccccaccacagccagagcaccttcagaaagaccagccccgcccccggcggccccgccggcgagggccccctgcagagcctgacctgcctgatcggcgagaaggacctgagactgctggagaagctgggcgacggcagcttcggcgtggtgagaagaggcgagtgggacgcccccagcggcaagaccgtgagcgtggccgtgaagtgcctgaagcccgacgtgctgagccagcccgaggccatggacgacttcatcagagaggtgaacgccatgcacagcctggaccacagaaacctgatcagactgtacggcgtggtgctgaccccccccatgaagatggtgaccgagctggcccccctgggcagcctgctggacagactgagaaagcaccagggccacttcctgctgggcaccctgagcagatacgccgtgcaggtggccgagggcatgggctacctggagagcaagagattcatccacagagacctggccgccagaaacctgctgctggccaccagagacctggtgaagatcggcgacttcggcctgatgagagccctgccccagaacgacgaccactacgtgatgcaggagcacagaaaggtgcccttcgcctggtgcgcccccgagagcctgaagaccagaaccttcagccacgccagcgacacctggatgttcggcgtgaccctgtgggagatgttcacctacggccaggagccctggatcggcctgaacggcagccagatcctgcacaagatcgacaaggagggcgagagactgcccagacccgaggactgcccccaggacatctacaacgtgatggtgcagtgctgggcccacaagcccgaggacagacccaccttcgtggccctgagagacttcctgctggaggcccagcccaccgacatgagagccctgcaggacttcgaggagcccgacaagctgcacatccagatgaacgacgtgatcaccgtgatcgagggcagagccgagaactactggtggagaggccagaacaccagaaccctgtgcgtgggccccttccccagaaacgtggtgaccagcgtggccggcctgagcgcccaggacatcagccagcccctgcagaacagcttcatccacaccggccacggcgacagcgaccccagacactgctggggcttccccgacagaatcgacgagtgccccttcagcgccttcagccccggccacccccccgccgagacctgcggccaggtgctgtggaccggcagaagagaggcctgcgccagcgaccccagactgcaccccgtgagcagcagaaccaagggcctgtag

SEQ ID NO: 104209 - DNA, 3117 bp, Artificial Sequence
  Description of Artificial Sequence: Synthetic coding sequence
atgcagcccgaggagggcaccggctggctgctggagctgctgagcgaggtgcagctgcagcagtacttcctgagactgagagacgacctgaacgtgaccagactgagccacttcgagtacgtgaagaacgaggacctggagaagatcggcatgggcagacccggccagagaagactgtgggaggccgtgaagagaagaaaggccctgtgcaagagaaagagctggatgagcaaggtgttcagcggcaagagactggaggccgagttccccccccaccacagccagagcaccttcagaaagaccagccccgcccccggcggccccgccggcgagggccccctgcagagcctgacctgcctgatcggcgagaaggacctgagactgctggagaagctgggcgacggcagcttcggcgtggtgagaagaggcgagtgggacgcccccagcggcaagaccgtgagcgtggccgtgaagtgcctgaagcccgacgtgctgagccagcccgaggccatggacgacttcatcagagaggtgaacgccatgcacagcctggaccacagaaacctgatcagactgtacggcgtggtgctgaccccccccatgaagatggtgaccgagctggcccccctgggcagcctgctggacagactgagaaagcaccagggccacttcctgctgggcaccctgagcagatacgccgtgcaggtggccgagggcatgggctacctggagagcaagagattcatccacagagacctggccgccagaaacctgctgctggccaccagagacctggtgaagatcggcgacttcggcctgatgagagccctgccccagaacgacgaccactacgtgatgcaggagcacagaaaggtgcccttcgcctggtgcgcccccgagagcctgaagaccagaaccttcagccacgccagcgacacctggatgttcggcgtgaccctgtgggagatgttcacctacggccaggagccctggatcggcctgaacggcagccagatcctgcacaagatcgacaaggagggcgagagactgcccagacccgaggactgcccccaggacatctacaacgtgatggtgcagtgctgggcccacaagcccgaggacagacccaccttcgtggccctgagagacttcctgctggaggcccagcccaccgacatgagagccctgcaggacttcgaggagcccgacaagctgcacatccagatgaacgacgtgatcaccgtgatcgagggcagagccgagaactactggtggagaggccagaacaccagaaccctgtgcgtgggccccttccccagaaacgtggtgaccagcgtggccggcctgagcgcccaggacatcagccagcccctgcagaacagcttcatccacaccggccacggcgacagcgaccccagacactgctggggcttccccgacagaatcgacgagctgtacctgggcaaccccatggacccccccgacctgctgagcgtggagctgagcaccagcagacccccccagcacctgggcggcgtgaagaagcccacctacgaccccgtgagcgaggaccaggaccccctgagcagcgacttcaagagactgggcctgagaaagcccggcctgcccagaggcctgtggctggccaagcccagcgccagagtgcccggcaccaaggccagcagaggcagcggcgccgaggtgaccctgatcgacttcggcgaggagcccgtggtgcccgccctgagaccctgcgcccccagcctggcccagctggccatggacgcctgcagcctgctggacgagacccccccccagagccccaccagagccctgcccagacccctgcaccccacccccgtggtggactgggacgccagacccctgccccccccccccgcctacgacgacgtggcccaggacgaggacgacttcgagatctgcagcatcaacagcaccctggtgggcgccggcgtgcccgccggccccagccagggccagaccaactacgccttcgtgcccgagcaggccagaccccccccccccctggaggacaacctgttcctgcccccccagggcggcggcaagccccccagcagcgcccagaccgccgagatcttccaggccctgcagcaggagtgcatgagacagctgcaggcccccgccggcagccccgcccccagccccagccccggcggcgacgacaagccccaggtgccccccagagtgcccatcccccccagacccaccagaccccacgtgcagctgagccccgccccccccggcgaggaggagaccagccagtggcccggccccgccagcccccccagagtgccccccagagagcccctgagcccccagggcagcagaacccccagccccctggtgccccccggcagcagccccctgccccccagactgagcagcagccccggcaagaccatgcccaccacccagagcttcgccagcgaccccaagtacgccaccccccaggtgatccaggcccccggccccagagccggcccctgcatcctgcccatcgtgagagacggcaagaaggtgagcagcacccactactacctgctgcccgagagacccagctacctggagagataccagagattcctgagagaggcccagagccccgaggagcccacccccctgcccgtgcccctgctgctgcccccccccagcacccccgcccccgccgcccccaccgccaccgtgagacccatgccccaggccgccctggaccccaaggccaacttcagcaccaacaacagcaaccccggcgccagaccccccccccccagagccaccgccagactgccccagagaggctgccccggcgacggccccgaggccggcagacccgccgacaagatccagatggccatggtgcacggcgtgaccaccgaggagtgccaggccgccctgcagtgccacggctggagcgtgcagagagccgcccagtacctgaaggtggagcagctgttcggcctgggcctgagacccagaggcgagtgccacaaggtgctggagatgttcgactggaacctggagcaggccggctgccacctgctgggcagctggggccccgcccaccacaagagatag

SEQ ID NO: 104210 - DNA, 3261 bp, Artificial Sequence
  Description of Artificial Sequence: Synthetic coding sequence
atgctggaggccagaccccccagaacccagggcagcgacgccgccggcgccgccgccggcagaggcctgagagccctgctgctgagcctgaccgccgccgccggcatctggggcagcatgggcgagagaagcgcctaccagagactggccggcggcgaggagggcccccagagactgggcggcggcagaatgcagcccgaggagggcaccggctggctgctggagctgctgagcgaggtgcagctgcagcagtacttcctgagactgagagacgacctgaacgtgaccagactgagccacttcgagtacgtgaagaacgaggacctggagaagatcggcatgggcagacccggccagagaagactgtgggaggccgtgaagagaagaaaggccctgtgcaagagaaagagctggatgagcaaggtgttcagcggcaagagactggaggccgagttccccccccaccacagccagagcaccttcagaaagaccagccccgcccccggcggccccgccggcgagggccccctgcagagcctgacctgcctgatcggcgagaaggacctgagactgctggagaagctgggcgacggcagcttcggcgtggtgagaagaggcgagtgggacgcccccagcggcaagaccgtgagcgtggccgtgaagtgcctgaagcccgacgtgctgagccagcccgaggccatggacgacttcatcagagaggtgaacgccatgcacagcctggaccacagaaacctgatcagactgtacggcgtggtgctgaccccccccatgaagatggtgaccgagctggcccccctgggcagcctgctggacagactgagaaagcaccagggccacttcctgctgggcaccctgagcagatacgccgtgcaggtggccgagggcatgggctacctggagagcaagagattcatccacagagacctggccgccagaaacctgctgctggccaccagagacctggtgaagatcggcgacttcggcctgatgagagccctgccccagaacgacgaccactacgtgatgcaggagcacagaaaggtgcccttcgcctggtgcgcccccgagagcctgaagaccagaaccttcagccacgccagcgacacctggatgttcggcgtgaccctgtgggagatgttcacctacggccaggagccctggatcggcctgaacggcagccagatcctgcacaagatcgacaaggagggcgagagactgcccagacccgaggactgcccccaggacatctacaacgtgatggtgcagtgctgggcccacaagcccgaggacagacccaccttcgtggccctgagagacttcctgctggaggcccagcccaccgacatgagagccctgcaggacttcgaggagcccgacaagctgcacatccagatgaacgacgtgatcaccgtgatcgagggcagagccgagaactactggtggagaggccagaacaccagaaccctgtgcgtgggccccttccccagaaacgtggtgaccagcgtggccggcctgagcgcccaggacatcagccagcccctgcagaacagcttcatccacaccggccacggcgacagcgaccccagacactgctggggcttccccgacagaatcgacgagctgtacctgggcaaccccatggacccccccgacctgctgagcgtggagctgagcaccagcagacccccccagcacctgggcggcgtgaagagagagcccccccccagacccccccagcccgccttcttcacccagaagcccacctacgaccccgtgagcgaggaccaggaccccctgagcagcgacttcaagagactgggcctgagaaagcccggcctgcccagaggcctgtggctggccaagcccagcgccagagtgcccggcaccaaggccagcagaggcagcggcgccgaggtgaccctgatcgacttcggcgaggagcccgtggtgcccgccctgagaccctgcgcccccagcctggcccagctggccatggacgcctgcagcctgctggacgagacccccccccagagccccaccagagccctgcccagacccctgcaccccacccccgtggtggactgggacgccagacccctgccccccccccccgcctacgacgacgtggcccaggacgaggacgacttcgagatctgcagcatcaacagcaccctggtgggcgccggcgtgcccgccggccccagccagggccagaccaactacgccttcgtgcccgagcaggccagaccccccccccccctggaggacaacctgttcctgcccccccagggcggcggcaagccccccagcagcgcccagaccgccgagatcttccaggccctgcagcaggagtgcatgagacagctgcaggcccccgccggcagccccgcccccagccccagccccggcggcgacgacaagccccaggtgccccccagagtgcccatcccccccagacccaccagaccccacgtgcagctgagccccgccccccccggcgaggaggagaccagccagtggcccggccccgccagcccccccagagtgccccccagagagcccctgagcccccagggcagcagaacccccagccccctggtgccccccggcagcagccccctgccccccagactgagcagcagccccggcaagaccatgcccaccacccagagcttcgccagcgaccccaagtacgccaccccccaggtgatccaggcccccggccccagagccggcccctgcatcctgcccatcgtgagagacggcaagaaggtgagcagcacccactactacctgctgcccgagagacccagctacctggagagataccagagattcctgagagaggcccagagccccgaggagcccacccccctgcccgtgcccctgctgctgcccccccccagcacccccgcccccgccgcccccaccgccaccgtgagacccatgccccaggccgccctggaccccaaggccaacttcagcaccaacaacagcaaccccggcgccagaccccccccccccagagccaccgccagactgccccagagaggctgccccggcgacggccccgaggccggcagacccgccgacaagatccagatggtggagcagctgttcggcctgggcctgagacccagaggcgagtgccacaaggtgctggagatgttcgactggaacctggagcaggccggctgccacctgctgggcagctggggccccgcccaccacaagagatag

SEQ ID NO: 104211 - DNA, 3117 bp, Artificial Sequence; identical to SEQ ID NO: 104209
  Description of Artificial Sequence: Synthetic coding sequence

SEQ ID NO: 104212 - DNA, 294 bp, Artificial Sequence
  Description of Artificial Sequence: Synthetic coding sequence
atgcagcccgaggagggcaccggctggctgctggagctgctgagcgaggtgcagctgcagcagtacttcctgagactgagagacgacctgaacgtgaccagactgagccacttcgagtacgtgaagaacgaggacctggagaagatcggcatgggcagacccggccagagaagactgtgggaggccgtgaagagaagaaaggccctgtgcaagagaaagagctggatgagcaaggtgttcagcggcaagagactggaggccgagttccccccccaccacagccagagcacctag

SEQ ID NO: 104213 - DNA, 1827 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagcggcgagggccaggacatctgggacatgctggacaagggcaaccccttccagttctacctgaccagagtgagcggcgtgaagcccaagtacaacagcggcgccctgcacatcaaggacatcctgagccccctgttcggcaccctggtgagcagcgcccagttcaactactgcttcgacgtggactggctggtgaagcagtacccccccgagttcagaaagaagcccatcctgctggtgcacggcgacaagagagaggccaaggcccacctgcacgcccaggccaagccctacgagaacatcagcctgtgccaggccaagctggacatcgccttcggcacccaccacaccaagatgatgctgctgctgtacgaggagggcctgagagtggtgatccacaccagcaacctgatccacgccgactggcaccagaagacccagggcatctggctgagccccctgtaccccagaatcgccgacggcacccacaagagcggcgagagccccacccacttcaaggccgacctgatcagctacctgatggcctacaacgcccccagcctgaaggagtggatcgacgtgatccacaagcacgacctgagcgagaccaacgtgtacctgatcggcagcacccccggcagattccagggcagccagaaggacaactggggccacttcagactgaagaagctgctgaaggaccacgccagcagcatgcccaacgccgagagctggcccgtggtgggccagttcagcagcgtgggcagcctgggcgccgacgagagcaagtggctgtgcagcgagttcaaggagagcatgctgaccctgggcaaggagagcaagacccccggcaagagcagcgtgcccctgtacctgatctaccccagcgtggagaacgtgagaaccagcctggagggctaccccgccggcggcagcctgccctacagcatccagaccgccgagaagcagaactggctgcacagctacttccacaagtggagcgccgagaccagcggcagaagcaacgccatgccccacatcaagacctacatgagacccagccccgacttcagcaagatcgcctggttcctggtgaccagcgccaacctgagcaaggccgcctggggcgccctggagaagaacggcacccagctgatgatcagaagctacgagctgggcgtgctgttcctgcccagcgccttcggcctggacagcttcaaggtgaagcagaagttcttcgccggcagccaggagcccatggccaccttccccgtgccctacgacctgccccccgagctgtacggcagcaaggacagaccctggatctggaacatcccctacgtgaaggcccccgacacccacggcaacatgtgggtgcccagctag

SEQ ID NO: 104214 - DNA, 1110 bp, Artificial Sequence
  Description of Artificial Sequence: Synthetic coding sequence
atggtgatcagcgagagactgagactgaccagcatgcccagacccagcctgaccagaaccagcctgagcgccagaaagatgatgctgctgctgtacgaggagggcctgagagtggtgatccacaccagcaacctgatccacgccgactggcaccagaagacccagggcatctggctgagccccctgtaccccagaatcgccgacggcacccacaagagcggcgagagccccacccacttcaaggccgacctgatcagctacctgatggcctacaacgcccccagcctgaaggagtggatcgacgtgatccacaagcacgacctgagcgagaccaacgtgtacctgatcggcagcacccccggcagattccagggcagccagaaggacaactggggccacttcagactgaagaagctgctgaaggaccacgccagcagcatgcccaacgccgagagctggcccgtggtgggccagttcagcagcgtgggcagcctgggcgccgacgagagcaagtggctgtgcagcgagttcaaggagagcatgctgaccctgggcaaggagagcaagacccccggcaagagcagcgtgcccctgtacctgatctaccccagcgtggagaacgtgagaaccagcctggagggctaccccgccggcggcagcctgccctacagcatccagaccgccgagaagcagaactggctgcacagctacttccacaagtggagcgccgagaccagcggcagaagcaacgccatgccccacatcaagacctacatgagacccagccccgacttcagcaagatcgcctggttcctggtgaccagcgccaacctgagcaaggccgcctggggcgccctggagaagaacggcacccagctgatgatcagaagctacgagctgggcgtgctgttcctgcccagcgccttcggcctggacagcttcaaggtgaagcagaagttcttcgccggcagccaggagcccatggccaccttccccgtgccctacgacctgccccccgagctgtacggcagcaaggacagaccctggatctggaacatcccctacgtgaaggcccccgacacccacggcaacatgtgggtgcccagctag

SEQ ID NO: 104215 - DNA, 1827 bp, Artificial Sequence; identical to SEQ ID NO: 104213
  Description of Artificial Sequence: Synthetic coding sequence

SEQ ID NO: 104216 - DNA, 897 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagcggcgagggccaggacatctgggacatgctggacaagggcaaccccttccagttctacctgaccagagtgagcggcgtgaagcccaagtacaacagcggcgccctgcacatcaaggacatcctgagccccctgttcggcaccctggtgagcagcgcccagttcaactactgcttcgacgtggactggctggtgaagcagtacccccccgagttcagaaagaagcccatcctgctggtgcacggcgacaagagagaggccaaggcccacctgcacgcccaggccaagccctacgagaacatcagcctgtgccaggccaagctggacatcgccttcggcacccaccacaccaagatgatgctgctgctgtacgaggagggcctgagagtggtgatccacaccagcaacctgatccacgccgactggcaccagaagacccagggcacccacctgtag

SEQ ID NO: 104217 - DNA, 441 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagtag

SEQ ID NO: 104218 - DNA, 447 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagctag

SEQ ID NO: 104219 - DNA, 840 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagcggcgagggccaggacatctgggacatgctggacaagggcaaccccttccagttctacctgaccagagtgagcggcgtgaagcccaagtacaacagcggcgccctgcacatcaaggacatcctgagccccctgttcggcaccctggtgagcagcgcccagttcaactactgcttcgacgtggactggctggtgaagcagtacccccccgagttcagaaagaagcccatcctgctggtgcacggcgacaagagagaggccaaggcccacctgcacgcccaggccaagccctacgagaacatcagcctgtgccaggccaagctggacatcgccttcggcacccaccacaccaagatgatgctgctgctgtacgaggagggcctgagagtggtgatctag

SEQ ID NO: 104220 - DNA, 486 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagcggcgagggccaggacatctgggacatgctggacaagggctag

SEQ ID NO: 104221 - DNA, 456 bp, Artificial Sequence
  Description of Artificial Sequence: Synthetic coding sequence
atgagccaggagggcgactacggcagatggaccatcagcagcagcgacgagagcgaggaggagaagcccaagcccgacaagcccagcaccagcagcctgctgtgcgccagacagggcgccgccaacgagcccagatacacctgcagcgaggcccagaaggccgcccacaagagaaagatcagccccgtgaagttcagcaacaccgacagcgtgctgccccccaagagacagaagagcggcagccaggaggacctgggctggtgcctgagcagcagcgacgacgagctgcagcccgagatgccccagaagcaggccgagaaggtggtgatcaagaaggagaaggacatcagcgcccccaacgacggcaccgcccagagaaccgagaaccacggcgcccccgcctgccacagactgaaggaggaggaggacgagtacgagaccagcggcgagggctag

SEQ ID NO: 104222 - DNA, 1113 bp, Artificial Sequence
  Description of Artificial Sequence: Synthetic coding sequence
atggtgggcaagctgaagcagaacctgctgctggcctgcctggtgatcagcagcgtgaccgtgttctacctgggccagcacgccatggagtgccaccacagaatcgaggagagaagccagcccgtgaagctggagagcaccagaaccaccgtgagaaccggcctggacctgaaggccaacaagaccttcgcctaccacaaggacatgcccctgatcttcatcggcggcgtgcccagaagcggcaccaccctgatgagagccatgctggacgcccaccccgacatcagatgcggcgaggagaccagagtgatccccagaatcctggccctgaagcagatgtggagcagaagcagcaaggagaagatcagactggacgaggccggcgtgaccgacgaggtgctggacagcgccatgcaggccttcctgctggagatcatcgtgaagcacggcgagcccgccccctacctgtgcaacaaggaccccttcgccctgaagagcctgacctacctgagcagactgttccccaacgccaagttcctgctgatggtgagagacggcagagccagcgtgcacagcatgatcagcagaaaggtgaccatcgccggcttcgacctgaacagctacagagactgcctgaccaagtggaacagagccatcgagaccatgtacaaccagtgcatggaggtgggctacaagaagtgcatgctggtgcactacgagcagctggtgctgcaccccgagagatggatgagaaccctgctgaagttcctgcagatcccctggaaccacagcgtgctgcaccacgaggagatgatcggcaaggccggcggcgtgagcctgagcaaggtggagagaagcaccgaccaggtgatcaagcccgtgaacgtgggcgccctgagcaagtgggtgggcaagatcccccccgacgtgctgcaggacatggccgtgatcgcccccatgctggccaagctgggctacgacccctacgccaacccccccaactacggcaagcccgaccccaagatcatcgagaacaccagaagagtgtacaagggcgagttccagctgcccgacttcctgaaggagaagccccagaccgagcaggtggagtag

SEQ ID NO: 104223 - DNA, 129 bp, Artificial Sequence
  Description of Artificial Sequence: Synthetic coding sequence
atggtgggcaagctgaagcagaacctgctgctggcctgcctggtgatcagcagcgtgaccgtgttctacctgggccagcacgccatggagtgccaccacagaatcgaggagagaagccagcccgtgtag

SEQ ID NO: 104224 - DNA, 423 bp, Artificial Sequence
  Description of Artificial Sequence: Synthetic coding sequence
atggtgggcaagctgaagcagaacctgctgctggcctgcctggtgatcagcagcgtgaccgtgttctacctgggccagcacgccatggagtgccaccacagaatcgaggagagaagccagcccgtgaagctggagagcaccagaaccaccgtgagaaccggcctggacctgaaggccaacaagaccttcgcctaccacaaggacatgcccctgatcttcatcggcggcgtgcccagaagcggcaccaccctgatgagagccatgctggacgcccaccccgacatcagatgcggcgaggagaccagagtgatccccagaatcctggccctgaagcagatgtggagcagaagcagcaaggagaagatcagactggacgaggccggcgtgaccgacgaggtgctggacagcgccatgcaggcctag

SEQ ID NO: 104225 - DNA, 1083 bp, Artificial Sequence
  Description of Artificial Sequence: Synthetic coding sequence
atggtgggcaagctgaagcagaacctgctgctggcctgcctggtgatcagcagcgtgaccgtgttctacctgggccagcacgccatggagtgccaccacagaatcgaggagagaagccagcccgtgaagctggagagcaccagaaccaccgtgagaaccggcctggacctgaaggccaacaagaccttcgcctaccacaaggacatgcccctgatcttcatcggcggcgtgcccagaagcggcaccaccctgatgagagccatgctggacgcccaccccgacatcagatgcggcgaggagaccagagtgatccccagaatcctggccctgaagcagatgtggagcagaagcagcaaggagaagatcagactggacgaggccggcgtgaccgacgaggtgctggacagcgccatgcaggccttcctgctggagatcatcgtgaagcacggcgagcccgccccctacctgtgcaacaaggaccccttcgccctgaagagcctgacctacctgagcagactgttccccaacgccaagttcctgctgatggtgagagacggcagagccagcgtgcacagcatgatcagcagaaaggtgaccatcgccggcttcgacctgaacagctacagagactgcctgaccaagtggaacagagccatcgagaccatgtacaaccagtgcatggaggtgggctacaagaagtgcatgctggtgcactacgagcagctggtgctgcaccccgagagatggatgagaaccctgctgaagttcctgcagatcccctggaaccacagcgtgctgcaccacgaggagatgatcggcaaggccggcggcgtgagcctgagcaaggtggagagaagcaccgaccaggtgatcaagcccgtgaacgtgggcgccctgagcaagtgggtgggcaagatcccccccgacgtgctgcaggacatggccgtgatcgcccccatgctggccaagctgggctacgacccctacgccaacccccccaactacggcaagcccgaccccaagatcatcgagaacaccagaagagagagactgctgcccttccagcagaagggcaacagctag

SEQ ID NO: 104226 - DNA, 1134 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagacccgagcaggaggagctggtgatggtgggcaccaaccacgtggagtacagatacggcaaggccatgcccctgatcttcgtgggcggcgtgcccagaagcggcaccaccctgatgagagccatgctggacgcccaccccgaggtgagatgcggcgaggagaccagaatcatccccagagtgctggccatgagacaggcctggagcaagagcggcagagagaagctgagactggacgaggccggcgtgaccgacgaggtgctggacgccgccatgcaggccttcatcctggaggtgatcgccaagcacggcgagcccgccagagtgctgtgcaacaaggaccccttcaccctgaagagcagcgtgtacctgagcagactgttccccaacagcaagttcctgctgatggtgagagacggcagagccagcgtgcacagcatgatcaccagaaaggtgaccatcgccggcttcgacctgagcagctacagagactgcctgaccaagtggaacaaggccatcgaggtgatgtacgcccagtgcatggaggtgggcaaggagaagtgcctgcccgtgtactacgagcagctggtgctgcaccccagaagaagcctgaagctgatcctggacttcctgggcatcgcctggagcgacgccgtgctgcaccacgaggacctgatcggcaagcccggcggcgtgagcctgagcaagatcgagagaagcaccgaccaggtgatcaagcccgtgaacctggaggccctgagcaagtggaccggccacatccccggcgacgtggtgagagacatggcccagatcgcccccatgctggcccagctgggctacgacccctacgccaacccccccaactacggcaaccccgaccccttcgtgatcaacaacacccagagagtgctgaagggcgactacaagacccccgccaacctgaagggctacttccaggtgaaccagaacagcaccagcagccacctgggcagcagctag

SEQ ID NO: 104227 - DNA, 1134 bp, Artificial Sequence; identical to SEQ ID NO: 104226
  Description of Artificial Sequence: Synthetic coding sequence

SEQ ID NO: 104228 - DNA, 1134 bp, Artificial Sequence; identical to SEQ ID NO: 104226
  Description of Artificial Sequence: Synthetic coding sequence

SEQ ID NO: 104229 - DNA, 195 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagacccgagcaggaggagctggtgatggtgggcaccaaccacgtggagtacagatactag

SEQ ID NO: 104230 - DNA, 429 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagacccgagcaggaggagctggtgatggtgggcaccaaccacgtggagtacagatacggcaaggccatgcccctgatcttcgtgggcggcgtgcccagaagcggcaccaccctgatgagagccatgctggacgcccaccccgaggtgagatgcggcgaggagaccagaatcatccccagagtgctggccatgagacaggcctggagcaagagcggcagagagaagctgagactggacgaggccggcgtgaccgacgaggtgctggacgccgccatgcaggccttcatcctgtag

SEQ ID NO: 104231 - DNA, 144 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagaccctag

SEQ ID NO: 104232 - DNA, 147 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagacccgagtag

SEQ ID NO: 104233 - DNA, 363 bp, Artificial Sequence
  Description of Artificial Sequence: Synthetic coding sequence
atgagactgagcgtgagaagagtgctgctggccgccggctgcgccctggtgctggtgctggccgtgcagctgggccagcaggtgctggagtgcagagccgtgctggccggcctgagaagccccagaggcgccatgagacccgagcaggaggagctggtgatggtgggcaccaaccacgtggagtacagatacggcaaggccatgcccctgatcttcgtgggcggcgtgcccagaagcggcaccaccctgatgagagccatgctggacgcccaccccgaggtgagatgcggcgaggagaccagaatcatccccagagtgctggccatgagacaggcctggagcaagagcggcagagagaagtag

SEQ ID NO: 104234 - DNA, 933 bp, Artificial Sequence
  Description of Artificial Sequence: Synthetic coding sequence
atgcccctgatcttcgtgggcggcgtgcccagaagcggcaccaccctgatgagagccatgctggacgcccaccccgaggtgagatgcggcgaggagaccagaatcatccccagagtgctggccatgagacaggcctggagcaagagcggcagagagaagctgagactggacgaggccggcgtgaccgacgaggtgctggacgccgccatgcaggccttcatcctggaggtgatcgccaagcacggcgagcccgccagagtgctgtgcaacaaggaccccttcaccctgaagagcagcgtgtacctgagcagactgttccccaacagcaagttcctgctgatggtgagagacggcagagccagcgtgcacagcatgatcaccagaaaggtgaccatcgccggcttcgacctgagcagctacagagactgcctgaccaagtggaacaaggccatcgaggtgatgtacgcccagtgcatggaggtgggcaaggagaagtgcctgcccgtgtactacgagcagctggtgctgcaccccagaagaagcctgaagctgatcctggacttcctgggcatcgcctggagcgacgccgtgctgcaccacgaggacctgatcggcaagcccggcggcgtgagcctgagcaagatcgagagaagcaccgaccaggtgatcaagcccgtgaacctggaggccctgagcaagtggaccggccacatccccggcgacgtggtgagagacatggcccagatcgcccccatgctggcccagctgggctacgacccctacgccaacccccccaactacggcaaccccgaccccttcgtgatcaacaacacccagagagtgctgaagggcgactacaagacccccgccaacctgaagggctacttccaggtgaaccagaacagcaccagcagccacctgggcagcagctag

SEQ ID NO: 104235 - DNA, 1587 bp, Artificial Sequence
  Description of Artificial Sequence: Synthetic coding sequence
atgggcgacgcccccagccccgaggagaagctgcacctgatcaccagaaacctgcaggaggtgctgggcgaggagaagctgaaggagatcctgaaggagagagagctgaagatctactggggcaccgccaccaccggcaagccccacgtggcctacttcgtgcccatgagcaagatcgccgacttcctgaaggccggctgcgaggtgaccatcctgttcgccgacctgcacgcctacctggacaacatgaaggccccctgggagctgctggagctgagagtgagctactacgagaacgtgatcaaggccatgctggagagcatcggcgtgcccctggagaagctgaagttcatcaagggcaccgactaccagctgagcaaggagtacaccctggacgtgtacagactgagcagcgtggtgacccagcacgacagcaagaaggccggcgccgaggtggtgaagcaggtggagcaccccctgctgagcggcctgctgtaccccggcctgcaggccctggacgaggagtacctgaaggtggacgcccagttcggcggcatcgaccagagaaagatcttcaccttcgccgagaagtacctgcccgccctgggctacagcaagagagtgcacctgatgaaccccatggtgcccggcctgaccggcagcaagatgagcagcagcgaggaggagagcaagatcgacctgctggacagaaaggaggacgtgaagaagaagctgaagaaggccttctgcgagcccggcaacgtggagaacaacggcgtgctgagcttcatcaagcacgtgctgttccccctgaagagcgagttcgtgatcctgagagacgagaagtggggcggcaacaagacctacaccgcctacgtggacctggagaaggacttcgccgccgaggtggtgcaccccggcgacctgaagaacagcgtggaggtggccctgaacaagctgctggaccccatcagagagaagttcaacacccccgccctgaagaagctggccagcgccgcctaccccgaccccagcaagcagaagcccatggccaagggccccgccaagaacagcgagcccgaggaggtgatccccagcagactggacatcagagtgggcaagatcatcaccgtggagaagcaccccgacgccgacagcctgtacgtggagaagatcgacgtgggcgaggccgagcccagaaccgtggtgagcggcctggtgcagttcgtgcccaaggaggagctgcaggacagactggtggtggtgctgtgcaacctgaagccccagaagatgagaggcgtggagagccagggcatgctgctgtgcgccagcatcgagggcatcaacagacaggtggagcccctggacccccccgccggcagcgcccccggcgagcacgtgttcgtgaagggctacgagaagggccagcccgacgaggagctgaagcccaagaagaaggtgttcgagaagctgcaggccgacttcaagatcagcgaggagtgcatcgcccagtggaagcagaccaacttcatgaccaagctgggcagcatcagctgcaagagcctgaagggcggcaacatcagctag

SEQ ID NO: 104236 - DNA, 1434 bp, Artificial Sequence
  Description of Artificial Sequence: Synthetic coding sequence
atggccgcccccatcctgagaagcttcagctggggcagatggagcggcaccctgaacctgagcgtgctgctgcccctgggcctgagaaaggcccacagcggcgcccagggcctgctggccgcccagaaggccagaggcctgttcaaggacttcttccccgagaccggcaccaagatcgagctgcccgagctgttcgacagaggcaccgccagcttcccccagaccatctactgcggcttcgaccccaccgccgacagcctgcacgtgggccacctgctggccctgctgggcctgttccacctgcagagagccggccacaacgtgatcgccctggtgggcggcgccaccgccagactgggcgaccccagcggcagaaccaaggagagagaggccctggagaccgagagagtgagagccaacgccagagccctgagactgggcctggaggccctggccgccaaccaccagcagctgttcaccgacggcagaagctggggcagcttcaccgtgctggacaacagcgcctggtaccagaagcagcacctggtggacttcctggccgccgtgggcggccacttcagaatgggcaccctgctgagcagacagagcgtgcagctgagactgaagagccccgagggcatgagcctggccgagttcttctaccaggtgctgcaggcctacgacttctactacctgttccagagatacggctgcagagtgcagctgggcggcagcgaccagctgggcaacatcatgagcggctacgagttcatcaacaagctgaccggcgaggacgtgttcggcatcaccgtgcccctgatcaccagcaccaccggcgccaagctgggcaagagcgccggcaacgccgtgtggctgaacagagacaagaccagccccttcgagctgtaccagttcttcgtgagacagcccgacgacagcgtggagagatacctgaagctgttcaccttcctgcccctgcccgagatcgaccacatcatgcagctgcacgtgaaggagcccgagagaagaggcccccagaagagactggccgccgaggtgaccaagctggtgcacggcagagagggcctggacagcgccaagagatgcacccaggccctgtaccacagcagcatcgacgccctggaggtgatgagcgaccaggagctgaaggagctgttcaaggaggcccccttcagcgagttcttcctggaccccggcaccagcgtgctggacacctgcagaaaggccaacgccatccccgacggccccagaggctacagaatgatcaccgagggcggcgtgagcatcaaccaccagcaggtgaccaaccccgagagcgtgctgatcgtgggccagcacatcctgaagaacggcctgagcctgctgaagatcggcaagagaaacttctacatcatcaagtggctgcagctgtag

SEQ ID NO: 104237 - DNA, 723 bp, Artificial Sequence
  Description of Artificial Sequence: Synthetic coding sequence
atggccgagtacctggccagcatcttcggcaccgagaaggacaaggtgaactgcagcttctacttcaagatcggcgcctgcagacacggcgacagatgcagcagactgcacaacaagcccaccttcagccagaccatcgccctgctgaacatctacagaaacccccagaacagcagccagagcgccgacggcctgagatgcgccgtgagcgacgtggagatgcaggagcactacgacgagttcttcgaggaggtgttcaccgagatggaggagaagtacggcgaggtggaggagatgaacgtgtgcgacaacctgggcgaccacctggtgggcaacgtgtacgtgaagttcagaagagaggaggacgccgagaaggccgtgatcgacctgaacaacagatggttcaacggccagcccatccacgccgagctgagccccgtgaccgacttcagagaggcctgctgcagacagtacgagatgggcgagtgcaccagaggcggcttctgcaacttcatgcacctgaagcccatcagcagagagctgagaagagagctgtacggcagaagaagaaagaagcacagaagcagaagcagaagcagagagagaagaagcagaagcagagacagaggcagaggcggcggcggcggcggcggcggcggcggcggcggcagagagagagacagaagaagaagcagagacagagagagaagcggcagattctag

SEQ ID NO: 104238 - DNA, 723 bp, Artificial Sequence
  Description of Artificial Sequence: Synthetic coding sequence
atggccgagtacctggccagcatcttcggcaccgagaaggacaaggtgaactgcagcttctacttcaagatcggcgcctgcagacacggcgacagatgcagcagactgcacaacaagcccaccttcagccagaccatcctgatccagaacatctacagaaacccccagaacagcgcccagaccgccgacggcagccactgcgccgtgagcgacgtggagatgcaggagcactacgacgagttcttcgaggaggtgttcaccgagatggaggagaagtacggcgaggtggaggagatgaacgtgtgcgacaacctgggcgaccacctggtgggcaacgtgtacgtgaagttcagaagagaggaggacgccgagaaggccgtgatcgacctgaacaacagatggttcaacggccagcccatccacgccgagctgagccccgtgaccgacttcagagaggcctgctgcagacagtacgagatgggcgagtgcaccagaggcggcttctgcaacttcatgcacctgaagcccatcagcagagagctgagaagagagctgtacggcagaagaagaaagaagcacagaagcagaagcagaagcagagagagaagaagcagaagcagagacagaggcagaggcggcggcggcggcggcggcggcggcggcggcggcagagagagagacagaagaagaagcagagacagagagagaagcggcagattctag

SEQ ID NO: 104239 - DNA, 504 bp, Artificial Sequence
  Description of Artificial Sequence: Synthetic coding sequence
atgcaggagcactacgacgagttcttcgaggaggtgttcaccgagatggaggagaagtacggcgaggtggaggagatgaacgtgtgcgacaacctgggcgaccacctggtgggcaacgtgtacgtgaagttcagaagagaggaggacgccgagaaggccgtgatcgacctgaacaacagatggttcaacggccagcccatccacgccgagctgagccccgtgaccgacttcagagaggcctgctgcagacagtacgagatgggcgagtgcaccagaggcggcttctgcaacttcatgcacctgaagcccatcagcagagagctgagaagagagctgtacggcagaagaagaaagaagcacagaagcagaagcagaagcagagagagaagaagcagaagcagagacagaggcagaggcggcggcggcggcggcggcggcggcggcggcggcagagagagagacagaagaagaagcagagacagagagagaagcggcagattctag

SEQ ID NO: 104240 - DNA, 504 bp, Artificial Sequence; identical to SEQ ID NO: 104239
  Description of Artificial Sequence: Synthetic coding sequence

SEQ ID NO: 104241 - DNA, 1218 bp, Artificial Sequence
  Description of Artificial Sequence: Synthetic coding sequence
atgttcgtgcaggaggagaagatcttcgccggcaaggtgctgagactgcacatctgcgccagcgacggcgccgagtggctggaggaggccaccgaggacaccagcgtggagaagctgaaggagagatgcctgaagcactgcgcccacggcagcctggaggaccccaagagcatcacccaccacaagctgatccacgccgccagcgagagagtgctgagcgacgccagaaccatcctggaggagaacatccaggaccaggacgtgctgctgctgatcaagaagagagcccccagccccctgcccaagatggccgacgtgagcgccgaggagaagaagaagcaggaccagaaggcccccgacaaggaggccatcctgagagccaccgccaacctgcccagctacaacatggacagagccgccgtgcagaccaacatgagagacttccagaccgagctgagaaagatcctggtgagcctgatcgaggtggcccagaagctgctggccctgaaccccgacgccgtggagctgttcaagaaggccaacgccatgctggacgaggacgaggacgagagagtggacgaggccgccctgagacagctgaccgagatgggcttccccgagaacagagccaccaaggccctgcagctgaaccacatgagcgtgccccaggccatggagtggctgatcgagcacgccgaggaccccaccatcgacacccccctgcccggccaggccccccccgaggccgagggcgccaccgccgccgccagcgaggccgccgccggcgccagcgccaccgacgaggaggccagagacgagctgaccgagatcttcaagaagatcagaagaaagagagagttcagagccgacgccagagccgtgatcagcctgatggagatgggcttcgacgagaaggaggtgatcgacgccctgagagtgaacaacaaccagcagaacgccgcctgcgagtggctgctgggcgacagaaagcccagccccgaggagctggacaagggcatcgaccccgacagccccctgttccaggccatcctggacaaccccgtggtgcagctgggcctgaccaaccccaagaccctgctggccttcgaggacatgctggagaaccccctgaacagcacccagtggatgaacgaccccgagaccggccccgtgatgctgcagatcagcagaatcttccagaccctgaacagaacctag

SEQ ID NO: 104242 - DNA, 540 bp, Artificial Sequence
  Description of Artificial Sequence: Synthetic coding sequence
atggccgccagccaggtgctgggcgagaagatcaacatcctgagcggcgagaccgtgaaggccggcgacagagaccccctgggcaacgactgccccgagcaggacagactgccccagagaagctggagacagaagtgcgccagctacgtgctggccctgagaccctggagcttcagcgccagcctgacccccgtggccctgggcagcgccctggcctacagaagccacggcgtgctggaccccagactgctggtgggctgcgccgtggccgtgctggccgtgcacggcgccggcaacctggtgaacacctactacgacttcagcaagggcatcgaccacaagaagagcgacgacagaaccctggtggacagaatcctggagccccaggacgtggtgagattcggcgtgttcctgtacaccctgggctgcgtgtgcgccgcctgcctgtactacctgagccccctgaagctggagcacctggccctgatctacttcggcggcctgagcggcagcttcctgtacaccggcgtgctgatctag

SEQ ID NO: 104243 - DNA, 1017 bp, Artificial Sequence
  Description of Artificial Sequence: Synthetic coding sequence
atggccgccagccaggtgctgggcgagaagatcaacatcctgagcggcgagaccgtgaaggccggcgacagagaccccctgggcaacgactgccccgagcaggacagactgccccagagaagctggagacagaagtgcgccagctacgtgctggccctgagaccctggagcttcagcgccagcctgacccccgtggccctgggcagcgccctggcctacagaagccacggcgtgctggaccccagactgctggtgggctgcgccgtggccgtgctggccgtgcacggcgccggcaacctggtgaacacctactacgacttcagcaagggcatcgaccacaagaagagcgacgacagaaccctggtggacagaatcctggagccccaggacgtggtgagattcggcgtgttcctgtacaccctgggctgcgtgtgcgccgcctgcctgtactacctgagccccctgaagctggagcacctggccctgatctacttcggcggcctgagcggcagcttcctgtacaccggcggcatcggcttcaagtacgtggccctgggcgacctgatcatcctgatcaccttcggccccctggccgtgatgttcgcctacgccatccaggtgggcagcctggccatcttccccctggtgtacgccatccccctggccctgagcaccgaggccatcctgcacagcaacaacaccagagacatggagagcgacagagaggccggcatcgtgaccctggccatcctgatcggccccaccttcagctacatcctgtacaacaccctgctgttcctgccctacctggtgttcagcatcctggccacccactgcaccatcagcctggccctgcccctgctgaccatccccatggccttcagcctggagagacagttcagaagccaggccttcaacaagctgccccagagaaccgccaagctgaacctgctgctgggcctgttctacgtgttcggcatcatcctggcccccgccggcagcctgcccaagatctag

SEQ ID NO: 104244 - DNA, 3405 bp, Artificial Sequence
  Description of Artificial Sequence: Synthetic coding sequence
atgagcgagccccacagagtgcagttcaccagcctgcccggcagcctgaaccccgccttcctgaagaagagcagaaaggaggaggccggcgccggcgagcagcaccaggactgcgagcccgccgccgccgccgtgagaatcaccctgaccctgttcgagcccgaccacaagagatgccccgagttcttctaccccgagctggtgaagaacatcagaggcaaggtgaagggcctgcagcccggcgacaagaagaaggacctgagcgaccccttcaacgacgaggagaaggagagacacaaggtggaggccctggccagaaagttcgaggagaagtacggcggcaagaagagaagaaaggacagaatccaggacctgatcgacatgggctacggctacgacgagagcgacagcttcatcgacaacagcgaggcctacgacgagctggtgcccgccagcctgaccaccaagtacggcggcttctacatcaacagcggcaccctgcagttcagacaggccagcgagagcgaggacgacttcatcaaggagaagaagaagaagagccccaagaagagaaagctgaaggagggcggcgagaagatcaagaagaagaagaaggacgacacctacgacaaggagaagaagagcaagaagagcaagttcagcaaggccggcttcaccgccctgaacgccagcaaggagaagaagaagaagaagtacagcggcgccctgagcgtgaaggagatgctgaagaagttccagaaggagaaggaggcccagaagaagagagaggaggagcacaagcccgtggccgtgcccagcgccgaggcccagggcctgagagagctggagggcgccagcgaccccctgctgagcctgttcggcagcaccagcgacaacgacctgctgcaggccgccaccgccatggacagcctgaccgacctggacctggagcacctgctgagcgagagccccgagggcagccccttcagagacatggacgacggcagcgacagcctgggcgtgggcctggaccaggagttcagacagcccagcagcctgcccgagggcctgcccgcccccctggagaagagagtgaaggagctggcccaggccgccagagccgccgagggcgagagcagacagaagttcttcacccaggacatcaacggcatcctgctggacatcgaggcccagaccagagagctgagcagccaggtgagaagcggcgtgtacgcctacctggccagcttcctgccctgcagcaaggacgccctgctgaagagagccagaaagctgcacctgtacgagcagggcggcagactgaaggagcccctgcagaagctgaaggaggccatcggcagagccatgcccgagcagatggccaagtaccaggacgagtgccaggcccacacccaggccaaggtggccaagatgctggaggaggagaaggacaaggagcagagagacagaatctgcagcgacgaggaggaggacgaggagaagggcggcagaagaatcatgggccccagaaagaagttccagtggaacgacgagatcagagagctgctgtgccaggtggtgaagatcaagctggagagccaggacctggagagaaacaacaaggcccaggcctgggaggactgcgtgaagggcttcctggacgccgaggtgaagcccctgtggcccaagggctggatgcaggccagaaccctgttcaaggagagcagaagaggccacggccacctgaccagcatcctggccaagaagaaggtgatggcccccagcaagatcaaggtgaaggagagcagcaccaagcccgacaagaaggtgagcgtgcccagcggccagatcggcggccccatcgccctgcccagcgaccaccagaccggcggcctgagcatcggcgccagcagcagagagctgcccagccaggccagcggcggcctggccaaccccccccccgtgaacctggaggacagcctggacgaggacctgatcagaaaccccgccagcagcgtggaggccgtgagcaaggagctggccgccctgaacagcagagccgccggcaacagcgagttcaccctgcccgcccccagcaaggcccccgccgagaaggtgggcggcgtgctgtgcaccgaggagaagagaaacttcgccaagcccagccccagcgcccccccccccgccagcagcctgcagagccccctgaacttcctggccgagcaggccctggccctgggccagagcagccaggagaagaagcccgagagcagcggctacaaggagctgagctgccaggcccccctgaacaagggcctgcccgaggtgcaccagagcaaggccaagcaccacagcctgcccagaaccagccacggcccccaggtggccgtgcccgtgcccggcccccaggtgaaggtgttccacgccggcacccagcagcagaagaacttcaccccccccagccccttcgccaacaagctgcagggccccaaggccagccccacccagtgccacagaagcctgctgcagctggtgaagaccgccgccaagggccagggcttccaccccagcgcccccgccaccagcggcggcctgagcgccagcagcagcagcagccacaagacccccgccagcagcagcagcgccctgagccaccccgccaagccccacagcgtgagcagcgccggcagcagctacaagaacaaccccttcgccagcagcatcagcaagcacggcgtgagcagcggcagcagcagcagcggcggcacccccgtgcagagcagcgtgagcggcagcctggtgcccggcatccagccccccagcgtgggccaggccaccagcagacccgtgcccagcagcgccggcaagaagatgcccgtgagccagaagctgaccctggtggccccccccggcggccccaacggcgacagcagcggcggcacccagggcgtggccaagctgctgaccagccccagcctgaagcccagcgccgtgagcagcgtgaccagcagcaccagcctgagcaagggcgccagcggcaccgtgctgctggccggcagcagcctgatggccagcccctacaagagcagcagccccaagctgagcggcgccatgagcagcaacagcctgggcatcatcacccccgtgcccatccccgtgcacgtgctgagcttcagcgccgacagcagcgccaaggccggcgtgagcaaggacgccatcgtgaccggccccgcccccggcagcttccaccacggcctgggccacagcctgctggccggcctgcacagcagccccccccacgccgcccccctgccccacgccgccgtgcccacccacatcccccagagcctgcccggcgccagccagctgcacggcaagggccccgccgtgcccagaaagctgtag

SEQ ID NO: 104245 - DNA, 3405 bp, Artificial Sequence; identical to SEQ ID NO: 104244
  Description of Artificial Sequence: Synthetic coding sequence

SEQ ID NO: 104246 - DNA, 3315 bp, Artificial Sequence
  Description of Artificial Sequence: Synthetic coding sequence
atgagcgagccccacagagtgcagttcaccagcctgcccggcagcctgaaccccgccttcctgaagaagagcagaaaggaggaggccggcgccggcgagcagcaccaggactgcgagcccgccgccgccgccgtgagaatcaccctgaccctgttcgagcccgaccacaagagatgccccgagttcttctaccccgagctggtgaagaacatcagaggcaaggtgaagggcctgcagcccggcgacaagaagaaggacctgagcgaccccttcaacgacgaggagaaggagagacacaaggtggaggccctggccagaaagttcgaggagaagtacggcggcaagaagagaagaaaggacagaatccaggacctgatcgacatgggctacggctacgacgagagcgacagcttcatcgacaacagcgaggcctacgacgagctggtgcccgccagcctgaccaccaagtacggcggcttctacatcaacagcggcaccctgcagttcagacaggccagcgagagcgaggacgacttcatcaaggagaagaagaagaagagccccaagaagagaaagctgaaggagggcggcgagaagatcaagaagaagaagaaggacgacacctacgacaaggagaagaagagcaagaagagcaagttcagcaaggccggcttcaccgccctgaacgccagcaaggagaagaagaagaagaagtacagcggcgccctgagcgtgaaggagatgctgaagaagttccagaaggagaaggaggcccagaagaagagagaggaggagcacaagcccgtggccgtgcccagcgccgaggcccagggcctgagagagctggagggcgccagcgaccccctgctgagcctgttcggcagcaccagcgacaacgacctgctgcaggccgccaccgccatggacagcctgaccgacctggacctggagcacctgctgagcgagagccccgagggcagccccttcagagacatggacgacggcagcgacagcctgggcgtgggcctggaccaggagttcagacagcccagcagcctgcccgagggcctgcccgcccccctggagaagagagtgaaggagctggcccaggccgccagagccgccgagggcgagagcagacagaagttcttcacccaggacatcaacggcatcctgctggacatcgaggcccagaccagagagctgagcagccaggtgagaagcggcgtgtacgcctacctggccagcttcctgccctgcagcaaggacgccctgctgaagagagccagaaagctgcacctgtacgagcagggcggcagactgaaggagcccctgcagaagctgaaggaggccatcggcagagccatgcccgagcagatggccaagtaccaggacgagtgccaggcccacacccaggccaaggtggccaagatgctggaggaggagaaggacaaggagcagagagacagaatctgcagcgacgaggaggaggacgaggagaagggcggcagaagaatcatgggccccagaaagaagttccagtggaacgacgagatcagagagctgctgtgccaggtggtgaagatcaagctggagagccaggacctggagagaaacaacaaggcccaggcctgggaggactgcgtgaagggcttcctggacgccgaggtgaagcccctgtggcccaagggctggatgcaggccagaaccctgttcaaggagagcagaagaggccacggccacctgaccagcatcctggccaagaagaaggtgatggcccccagcaagatcaaggtgaaggagagcagcaccaagcccgacaagaaggtgagcgtgcccagcggccagatcggcggccccatcgccctgcccagcgaccaccagaccggcggcctgagcatcggcgccagcagcagagagctgcccagccaggccagcggcggcctggccaaccccccccccgtgaacctggaggacagcctggacgaggacctgatcagaaaccccgccagcagcgtggaggccgtgagcaaggagctggccgccctgaacagcagagccgccggcaacagcgagttcaccctgcccgcccccagcaaggcccccgccgagaaggtgggcggcgtgctgtgcaccgaggagaagagaaacttcgccaagcccagccccagcgcccccccccccgccagcagcctgcagagccccctgaacttcctggccgagcaggccctggccctgggccagagcagccaggagaagaagcccgagagcagcggctacaaggagctgagctgccaggcccccctgaacaagggcctgcccgaggtgcaccagagcaaggccaagcaccacagcctgcccagaaccagccacggcccccaggtggccgtgcccgtgcccggcccccaggtgaaggtgttccacgccggcacccagcagcagaagaacttcaccccccccagccccttcgccaacaagctgcagggccccaaggccagccccacccagtgccacagaagcctgctgcagctggtgaagaccgccgccaagggccagggcttccaccccagcgcccccgccaccagcggcggcctgagcgccagcagcagcagcagccacaagacccccgccagcagcagcagcgccctgagccaccccgccaagccccacagcgtgagcagcgccggcagcagctacaagaacaaccccttcgccagcagcatcagcaagcacggcgtgagcagcggcagcagcagcagcggcggcacccccgtgcagagcagcgtgagcggcagcctggtgcccggcatccagccccccagcgtgggccaggccaccagcagacccgtgcccagcagcgccggcaagaagatgcccgtgagccagaagctgaccctggtggccccccccggcggccccaacggcgacagcagcggcggcacccagggcgtggccaagctgctgaccagccccagcctgaagcccagcgccgtgagcagcgtgaccagcagcaccagcctgagcaagggcgccagcggcaccgtgctgctggccggcagcagcctgatggccagcccctacaagagcagcagccccaagctgagcggcgccatgagcagcaacagcctgggcatcatcacccccgtgcccatccccgtgcacgtgctgagcttcagcgccgacagcagcgccaaggccggcgtgagcaaggacgccatcgtgaccggccccgcccccggcagcttccaccacggcctgggccacagcgccagccagctgcacggcaagggccccgccgtgcccagaaagctgtag

SEQ ID NO: 104247 - DNA, 3795 bp, Artificial Sequence
  Description of Artificial Sequence: Synthetic coding sequence
atgagcctgcagagagagccccccagacccgagccccccccccccttcccccccctgcccctgcagccccccccccccagagagagcgccagcagagccgagcagccccccagaccccccagagagaccgtgagactggagctggtgctgaaggaccccaccgacgagagctgcgtggagttcagctaccccgagctgctgctgtgcggcgagcagagaaagaagctgatccacaccgaggaccccttcaacgacgagcaccaggagagacaggaggtggagatgctggccaagaagttcgagatgaagtacggcggcaagcccagaaagcacagaaaggacagactgcaggacctgatcgacatcggcttcggctacgacgagaccgaccccttcatcgacaacagcgaggcctacgacgagctggtgcccgccagcctgaccaccaagtacggcggcttctacatcaacaccggcaccctgcagttcagacaggccagcgacaccgaggaggacgacatcaccgacaaccagaagcacaagccccccaaggtgcccaagatcaaggaggacgacatcgagatgaagaagagaaagagaaaggaggagggcgagaaggagaagaagcccagaaagaaggtgcccaagcagctgggcgtggtggccctgaacagccacaagagcgagaagaagaagaagagatacaaggacagcctgagcctggccgccatgatcagaaagttccagaaggagaaggacgccctgaagaaggagagcaaccccaaggtgcccgtgaccctgagcacccccagcctgaacaagcccccctgcgccgccgccgccctgggcaacgacgtgcccgacctgaacctgagcagcggcgaccccgacctgcccatcttcgtgagcaccaacgagcacgagctgttccaggaggccgagaacgccctggagatgctggacgacttcgacttcgacagactgctggacgccgccagcgacggcagccccctgagcgagagcggcggcgagaacggcaccaccacccagcccacctacaccagccaggtgatgcccaaggtggtgcccaccctgcccgagggcctgcccgtgctgctggagaagagaatcgaggacctgagagtggccgccaagctgttcgacgaggagggcagaaagaagttcttcacccaggacatgaacaacatcctgctggacatcgagctgcagctgcaggagctgggccccgtgatcagaagcggcgtgtacagccacctggaggccttcgtgccctgcaacaaggagaccctggtgaagagactgaagaagctgcacctgaacgtgcaggacgacagactgagagagcccctgcagaagctgaagctggccgtgagcaacgtgatgcccgagcagctgttcaagtaccaggaggactgccaggccagaagccaggccaagtgcgccaagctgcagaccgacgaggagagagagaagaacggcagcgaggaggacgacgacgagaagcccggcaagagagtgatcggccccagaaagaagttccactgggacgacaccatcagaaccctgctgtgcaacctggtggagatcaagctgggctgctacgagctggagcccaacaagagccagagcgccgaggactacctgaagagcttcatggagaccgaggtgaagcccctgtggcccaagggctggatgcaggccagaatgctgttcaaggagagcagaagcgtgcacaaccacctgaccagcgcccccgccaagaagaaggtgatccccgcccccaagcccaaggtgaaggaggtgatggtgaagaccctgcccctgcacagcttccccaccatgctgaaggagtgcagccccaagaaggaccagaagacccccaccagcctggtggccagcgtgagcggcccccccaccagcagcagcaccgccgccatcgccgccgccagcagcagcagcgcccccgcccaggagaccatctgcctggacgacagcctggacgaggacctgagcttccacagccccagcctggacctggtgagcgaggccctggccgtgatcaacaacggcaacaagggcccccccgtgggcagcagaatcagcatgcccaccaccaagcccagacccggcctgagagaggagaagctggccagcatcatgagcaagctgcccctggccacccccaagaagctggacagcacccagaccacccacagcagcagcctgatcgccggccacaccggccccgtgcccaagaagccccaggacctggcccacaccggcatcagcagcggcctgatcgccggcagcagcatccagaaccccaaggtgagcctggagcccctgcccgccagactgctgcagcagggcctgcagagaagcagccagatccacaccagcagcagcagccagacccacgtgagcagcagcagccaggcccagatcgccgccagcagccacgccctgggcaccagcgaggcccaggacgccagcagcctgacccaggtgaccaaggtgcaccagcacagcgccgtgcagcagaactacgtgagccccctgcaggccaccatcagcaagagccagaccaaccccgtggtgaagctgagcaacaacccccagctgagctgcagcagcagcctgatcaagaccagcgacaagcccctgatgtacagactgcccctgagcacccccagccccggcaacggcagccagggcagccaccccctggtgagcagaaccgtgcccagcaccaccaccagcagcaactacctggccaaggccatggtgagccagatcagcacccagggcttcaagagccccttcagcatggccgccagccccaagctggccgccagccccaagcccgccaccagccccaagcccctgcccagccccaagcccagcgccagccccaagcccagcctgagcgccaagcccagcgtgagcaccaagctgatcagcaagagcaaccccacccccaagcccaccgtgagccccagcagcagcagccccaacgccctggtggcccagggcagccacagcagcaccaacagccccgtgcacaagcagcccagcggcatgaacatcagcagacagagccccaccctgaacctgctgcccagcagcagaaccagcggcctgccccccaccaagaacctgcaggcccccagcaagctgaccaacagcagcagcaccggcaccgtgggcaagaacagcctgagcggcatcgccatgaacgtgcccgccagcagaggcagcaacctgaacagcagcggcgccaacagaaccagcctgagcggcggcaccggcagcggcacccagggcgccaccaagcccctgagcaccccccacagacccagcaccgccagcggcagcagcgtggtgaccgccagcgtgcagagcaccgccggcgccagcctgctggccaacgccagccccctgaccctgatgaccagccccctgagcgtgaccaaccagaacgtgacccccttcggcatgctgggcggcctggtgcccgtgaccatgcccttccagttccccctggagatcttcggcttcggcaccgacaccgccggcgtgaccaccaccagcggcagcaccagcgccgccttccaccacagcctgacccagaacctgctgaagggcctgcagcccggcggcgcccagcacgccgccaccctgagccacagccccctgcccgcccacctgcagcaggccttccacgacggcggccagagcaagggcgacaccaagctgcccagaaagagccagtag

SEQ ID NO: 104248 - DNA, 4044 bp, Artificial Sequence
  Description of Artificial Sequence: Synthetic coding sequence
atggccgagcccagaagagtggccttcatcagcctgagccccgtgagaagaagagaggccgagtaccccggccccgagagagagcccgagtaccccagagagccccccagactggagccccagccctacagagagcccgccagagccgagccccccgcccccagagagcccgcccccagaagcgacgcccagccccccagcagagagaagcccctgccccagagagaggtgagcagagccgagccccccatgagcctgcagagagagccccccagacccgagccccccccccccttcccccccctgcccctgcagccccccccccccagagagagcgccagcagagccgagcagccccccagaccccccagagagaccgtgagactggagctggtgctgaaggaccccaccgacgagagctgcgtggagttcagctaccccgagctgctgctgtgcggcgagcagagaaagaagctgatccacaccgaggaccccttcaacgacgagcaccaggagagacaggaggtggagatgctggccaagaagttcgagatgaagtacggcggcaagcccagaaagcacagaaaggacagactgcaggacctgatcgacatcggcttcggctacgacgagaccgaccccttcatcgacaacagcgaggcctacgacgagctggtgcccgccagcctgaccaccaagtacggcggcttctacatcaacaccggcaccctgcagttcagacaggccagcgacaccgaggaggacgacatcaccgacaaccagaagcacaagccccccaaggtgcccaagatcaaggaggacgacatcgagatgaagaagagaaagagaaaggaggagggcgagaaggagaagaagcccagaaagaaggtgcccaagcagctgggcgtggtggccctgaacagccacaagagcgagaagaagaagaagagatacaaggacagcctgagcctggccgccatgatcagaaagttccagaaggagaaggacgccctgaagaaggagagcaaccccaaggtgcccgtgaccctgagcacccccagcctgaacaagcccccctgcgccgccgccgccctgggcaacgacgtgcccgacctgaacctgagcagcggcgaccccgacctgcccatcttcgtgagcaccaacgagcacgagctgttccaggaggccgagaacgccctggagatgctggacgacttcgacttcgacagactgctggacgccgccagcgacggcagccccctgagcgagagcggcggcgagaacggcaccaccacccagcccacctacaccagccaggtgatgcccaaggtggtgcccaccctgcccgagggcctgcccgtgctgctggagaagagaatcgaggacctgagagtggccgccaagctgttcgacgaggagggcagaaagaagttcttcacccaggacatgaacaacatcctgctggacatcgagctgcagctgcaggagctgggccccgtgatcagaagcggcgtgtacagccacctggaggccttcgtgccctgcaacaaggagaccctggtgaagagactgaagaagctgcacctgaacgtgcaggacgacagactgagagagcccctgcagaagctgaagctggccgtgagcaacgtgatgcccgagcagctgttcaagtaccaggaggactgccaggccagaagccaggccaagtgcgccaagctgcagaccgacgaggagagagagaagaacggcagcgaggaggacgacgacgagaagcccggcaagagagtgatcggccccagaaagaagttccactgggacgacaccatcagaaccctgctgtgcaacctggtggagatcaagctgggctgctacgagctggagcccaacaagagccagagcgccgaggactacctgaagagcttcatggagaccgaggtgaagcccctgtggcccaagggctggatgcaggccagaatgctgttcaaggagagcagaagcgtgcacaaccacctgaccagcgcccccgccaagaagaaggtgatccccgcccccaagcccaaggtgaaggaggtgatggtgaagaccctgcccctgcacagcttccccaccatgctgaaggagtgcagccccaagaaggaccagaagacccccaccagcctggtggccagcgtgagcggcccccccaccagcagcagcaccgccgccatcgccgccgccagcagcagcagcgcccccgcccaggagaccatctgcctggacgacagcctggacgaggacctgagcttccacagccccagcctggacctggtgagcgaggccctggccgtgatcaacaacggcaacaagggcccccccgtgggcagcagaatcagcatgcccaccaccaagcccagacccggcctgagagaggagaagctggccagcatcatgagcaagctgcccctggccacccccaagaagctggacagcacccagaccacccacagcagcagcctgatcgccggccacaccggccccgtgcccaagaagccccaggacctggcccacaccggcatcagcagcggcctgatcgccggcagcagcatccagaaccccaaggtgagcctggagcccctgcccgccagactgctgcagcagggcctgcagagaagcagccagatccacaccagcagcagcagccagacccacgtgagcagcagcagccaggcccagatcgccgccagcagccacgccctgggcaccagcgaggcccaggacgccagcagcctgacccaggtgaccaaggtgcaccagcacagcgccgtgcagcagaactacgtgagccccctgcaggccaccatcagcaagagccagaccaaccccgtggtgaagctgagcaacaacccccagctgagctgcagcagcagcctgatcaagaccagcgacaagcccctgatgtacagactgcccctgagcacccccagccccggcaacggcagccagggcagccaccccctggtgagcagaaccgtgcccagcaccaccaccagcagcaactacctggccaaggccatggtgagccagatcagcacccagggcttcaagagccccttcagcatggccgccagccccaagctggccgccagccccaagcccgccaccagccccaagcccctgcccagccccaagcccagcgccagccccaagcccagcctgagcgccaagcccagcgtgagcaccaagctgatcagcaagagcaaccccacccccaagcccaccgtgagccccagcagcagcagccccaacgccctggtggcccagggcagccacagcagcaccaacagccccgtgcacaagcagcccagcggcatgaacatcagcagacagagccccaccctgaacctgctgcccagcagcagaaccagcggcctgccccccaccaagaacctgcaggcccccagcaagctgaccaacagcagcagcaccggcaccgtgggcaagaacagcctgagcggcatcgccatgaacgtgcccgccagcagaggcagcaacctgaacagcagcggcgccaacagaaccagcctgagcggcggcaccggcagcggcacccagggcgccaccaagcccctgagcaccccccacagacccagcaccgccagcggcagcagcgtggtgaccgccagcgtgcagagcaccgccggcgccagcctgctggccaacgccagccccctgaccctgatgaccagccccctgagcgtgaccaaccagaacgtgacccccttcggcatgctgggcggcctggtgcccgtgaccatgcccttccagttccccctggagatcttcggcttcggcaccgacaccgccggcgtgaccaccaccagcggcagcaccagcgccgccttccaccacagcctgacccagaacctgctgaagggcctgcagcccggcggcgcccagcacgccgccaccctgagccacagccccctgcccgcccacctgcagcaggccttccacgacggcggccagagcaagggcgacaccaagctgcccagaaagagccagtag

SEQ ID NO: 104249 - DNA, 1686 bp, Artificial Sequence
  Description of Artificial Sequence: Synthetic coding sequence
atggccgagagcggcgagagcggcggcccccccggcagccaggacagcgccgccggcgccgagggcgccggcgcccccgccgccgccgccagcgccgagcccaagatcatgaaggtgaccgtgaagacccccaaggagaaggaggagttcgccgtgcccgagaacagcagcgtgcagcagttcaaggaggagatcagcaagagattcaagagccacaccgaccagctggtgctgatcttcgccggcaagatcctgaaggaccaggacaccctgagccagcacggcatccacgacggcctgaccgtgcacctggtgatcaagacccagaacagaccccaggaccacagcgcccagcagaccaacaccgccggcagcaacgtgaccaccagcagcacccccaacagcaacagcaccagcggcagcgccaccagcaaccccttcggcctgggcggcctgggcggcctggccggcctgagcagcctgggcctgaacaccaccaacttcagcgagctgcagagccagatgcagagacagctgctgagcaaccccgagatgatggtgcagatcatggagaaccccttcgtgcagagcatgctgagcaaccccgacctgatgagacagctgatcatggccaacccccagatgcagcagctgatccagagaaaccccgagatcagccacatgctgaacaaccccgacatcatgagacagaccctggagctggccagaaaccccgccatgatgcaggagatgatgagaaaccaggacagagccctgagcaacctggagagcatccccggcggctacaacgccctgagaagaatgtacaccgacatccaggagcccatgctgagcgccgcccaggagcagttcggcggcaaccccttcgccagcctggtgagcaacaccagcagcggcgagggcagccagcccagcagaaccgagaacagagaccccctgcccaacccctgggccccccagaccagccagagcagcagcgccagcagcggcaccgccagcaccgtgggcggcaccaccggcagcaccgccagcggcaccagcggccagagcaccaccgcccccaacctggtgcccggcgtgggcgccagcatgttcaacacccccggcatgcagagcctgctgcagcagatcaccgagaacccccagctgatgcagaacatgctgagcgccccctacatgagaagcatgatgcagagcctgagccagaaccccgacctggccgcccagatgcagaaccccgacaccctgagcgccatgagcaaccccagagccatgcaggccctgctgcagatccagcagggcctgcagaccctggccaccgaggcccccggcctgatccccggcttcacccccggcctgggcgccctgggcagcaccggcggcagcagcggcaccaacggcagcaacgccacccccagcgagaacaccagccccaccgccggcaccaccgagcccggccaccagcagttcatccagcagatgctgcaggccctggccggcgtgaacccccagctgcagaaccccgaggtgagattccagcagcagctggagcagctgagcgccatgggcttcctgaacagagaggccaacctgcaggccctgatcgccaccggcggcgacatcaacgccgccatcgagagactgctgggcagccagcccagctag

SEQ ID NO: 104250 - DNA, 1770 bp, Artificial Sequence
  Description of Artificial Sequence: Synthetic coding sequence
atggccgagagcggcgagagcggcggcccccccggcagccaggacagcgccgccggcgccgagggcgccggcgcccccgccgccgccgccagcgccgagcccaagatcatgaaggtgaccgtgaagacccccaaggagaaggaggagttcgccgtgcccgagaacagcagcgtgcagcagttcaaggaggagatcagcaagagattcaagagccacaccgaccagctggtgctgatcttcgccggcaagatcctgaaggaccaggacaccctgagccagcacggcatccacgacggcctgaccgtgcacctggtgatcaagacccagaacagaccccaggaccacagcgcccagcagaccaacaccgccggcagcaacgtgaccaccagcagcacccccaacagcaacagcaccagcggcagcgccaccagcaaccccttcggcctgggcggcctgggcggcctggccggcctgagcagcctgggcctgaacaccaccaacttcagcgagctgcagagccagatgcagagacagctgctgagcaaccccgagatgatggtgcagatcatggagaaccccttcgtgcagagcatgctgagcaaccccgacctgatgagacagctgatcatggccaacccccagatgcagcagctgatccagagaaaccccgagatcagccacatgctgaacaaccccgacatcatgagacagaccctggagctggccagaaaccccgccatgatgcaggagatgatgagaaaccaggacagagccctgagcaacctggagagcatccccggcggctacaacgccctgagaagaatgtacaccgacatccaggagcccatgctgagcgccgcccaggagcagttcggcggcaaccccttcgccagcctggtgagcaacaccagcagcggcgagggcagccagcccagcagaaccgagaacagagaccccctgcccaacccctgggccccccagaccagccagagcagcagcgccagcagcggcaccgccagcaccgtgggcggcaccaccggcagcaccgccagcggcaccagcggccagagcaccaccgcccccaacctggtgcccggcgtgggcgccagcatgttcaacacccccggcatgcagagcctgctgcagcagatcaccgagaacccccagctgatgcagaacatgctgagcgccccctacatgagaagcatgatgcagagcctgagccagaaccccgacctggccgcccagatgatgctgaacaaccccctgttcgccggcaacccccagctgcaggagcagatgagacagcagctgcccaccttcctgcagcagatgcagaaccccgacaccctgagcgccatgagcaaccccagagccatgcaggccctgctgcagatccagcagggcctgcagaccctggccaccgaggcccccggcctgatccccggcttcacccccggcctgggcgccctgggcagcaccggcggcagcagcggcaccaacggcagcaacgccacccccagcgagaacaccagccccaccgccggcaccaccgagcccggccaccagcagttcatccagcagatgctgcaggccctggccggcgtgaacccccagctgcagaaccccgaggtgagattccagcagcagctggagcagctgagcgccatgggcttcctgaacagagaggccaacctgcaggccctgatcgccaccggcggcgacatcaacgccgccatcgagagactgctgggcagccagcccagctag

SEQ ID NO: 104251 - DNA, 1875 bp, Artificial Sequence
  Description of Artificial Sequence: Synthetic coding sequence
atggccgagaacggcgagagcagcggcccccccagacccagcagaggccccgccgccgcccagggcagcgccgccgcccccgccgagcccaagatcatcaaggtgaccgtgaagacccccaaggagaaggaggagttcgccgtgcccgagaacagcagcgtgcagcagttcaaggaggccatcagcaagagattcaagagccagaccgaccagctggtgctgatcttcgccggcaagatcctgaaggaccaggacaccctgatccagcacggcatccacgacggcctgaccgtgcacctggtgatcaagagccagaacagaccccagggccagagcacccagcccagcaacgccgccggcaccaacaccaccagcgccagcacccccagaagcaacagcacccccatcagcaccaacagcaaccccttcggcctgggcagcctgggcggcctggccggcctgagcagcctgggcctgagcagcaccaacttcagcgagctgcagagccagatgcagcagcagctgatggccagccccgagatgatgatccagatcatggagaaccccttcgtgcagagcatgctgagcaaccccgacctgatgagacagctgatcatggccaacccccagatgcagcagctgatccagagaaaccccgagatcagccacctgctgaacaaccccgacatcatgagacagaccctggagatcgccagaaaccccgccatgatgcaggagatgatgagaaaccaggacctggccctgagcaacctggagagcatccccggcggctacaacgccctgagaagaatgtacaccgacatccaggagcccatgctgaacgccgcccaggagcagttcggcggcaaccccttcgccagcgtgggcagcagcagcagcagcggcgagggcacccagcccagcagaaccgagaacagagaccccctgcccaacccctgggcccccccccccgccacccagagcagcgccaccaccagcaccaccaccagcaccggcagcggcagcggcaacagcagcagcaacgccaccggcaacaccgtggccgccgccaactacgtggccagcatcttcagcacccccggcatgcagagcctgctgcagcagatcaccgagaacccccagctgatccagaacatgctgagcgccccctacatgagaagcatgatgcagagcctgagccagaaccccgacctggccgcccagatgatgctgaacagccccctgttcaccgccaacccccagctgcaggagcagatgagaccccagctgcccgccttcctgcagcagatgcagaaccccgacaccctgagcgccatgagcaaccccagagccatgcaggccctgatgcagatccagcagggcctgcagaccctggccaccgaggcccccggcctgatccccagcttcacccccggcgtgggcgtgggcgtgctgggcaccgccatcggccccgtgggccccgtgacccccatcggccccatcggccccatcgtgcccttcacccccatcggccccatcggccccatcggccccaccggccccgccgccccccccggcagcaccggcagcggcggccccaccggccccaccgtgagcagcgccgcccccagcgagaccaccagccccaccagcgagagcggccccaaccagcagttcatccagcagatggtgcaggccctggccggcgccaacgccccccagctgcccaaccccgaggtgagattccagcagcagctggagcagctgaacgccatgggcttcctgaacagagaggccaacctgcaggccctgatcgccaccggcggcgacatcaacgccgccatcgagagactgctgggcagccagcccagctag

SEQ ID NO: 104252 - DNA, 1467 bp, Artificial Sequence
  Description of Artificial Sequence: Synthetic coding sequence
atggccgagaacggcgagagcagcggcccccccagacccagcagaggccccgccgccgcccagggcagcgccgccgcccccgccgagcccaagatcatcaaggtgaccgtgaagacccccaaggagaaggaggagttcgccgtgcccgagaacagcagcgtgcagcagttcaaggaggccatcagcaagagattcaagagccagaccgaccagctggtgctgatcttcgccggcaagatcctgaaggaccaggacaccctgatccagcacggcatccacgacggcctgaccgtgcacctggtgatcaagagccagaacagaccccagggccagagcacccagcccagcaacgccgccggcaccaacaccaccagcgccagcacccccagaagcaacagcacccccatcagcaccaacagcaaccccttcggcctgggcagcctgggcggcctggccggcctgagcagcctgggcctgagcagcaccaacttcagcgagctgcagagccagatgcagcagcagctgatggccagccccgagatgatgatccagatcatggagaaccccttcgtgcagagcatgctgagcaaccccgacctgatgagacagctgatcatggccaacccccagatgcagcagctgatccagagaaaccccgagatcagccacctgctgaacaaccccgacatcatgagacagaccctggagatcgccagaaaccccgccatgatgcaggagatgatgagaaaccaggacctggccctgagcaacctggagagcatccccggcggctacaacgccctgagaagaatgtacaccgacatccaggagcccatgctgaacgccgcccaggagcagttcggcggcaaccccttcgccagcgtgggcagcagcagcagcagcggcgagggcacccagcccagcagaaccgagaacagagaccccctgcccaacccctgggcccccccccccgccacccagagcagcgccaccaccagcaccaccaccagcaccggcagcggcagcggcaacagcagcagcaacgccaccggcaacaccgtggccgccgccaactacgtggccagcatcttcagcacccccggcatgcagagcctgctgcagcagatcaccgagaacccccagctgatccagaacatgctgagcgccccctacatgagaagcatgatgcagagcctgagccagaaccccgacctggccgcccagatgatgctgaacagccccctgttcaccgccaacccccagctgcaggagcagatgagaccccagctgcccgccttcctgcagcagatgcagaaccccgacaccctgagcgccatgagcaaccccaccagcagcagcttcagcaagtggtgcagaccctggctggagcagatgctgcacagctgcagaatccagaagagcgacttcagcaacaactggaacagcagcacccagtggggcagctag

SEQ ID NO: 104253 - DNA, 1968 bp, Artificial Sequence
  Description of Artificial Sequence: Synthetic coding sequence
atggccaagggcggcgaggccctgccccagggcagccccgcccccgtgcaggacccccacctgatcaaggtgaccgtgaagacccccaaggacaaggaggacttcagcgtgaccgacacctgcaccatccagcagctgaaggaggagatcagccagagattcaaggcccaccccgaccagctggtgctgatcttcgccggcaagatcctgaaggaccccgacagcctggcccagtgcggcgtgagagacggcctgaccgtgcacctggtgatcaagagacagcacagagccatgggcaacgagtgccccgccgccagcgtgcccacccagggccccagccccggcagcctgccccagcccagcagcatctaccccgccgacggcccccccgccttcagcctgggcctgctgaccggcctgagcagactgggcctggcctacagaggcttccccgaccagcccagcagcctgatgagacagcacgtgagcgtgcccgagttcgtgacccagctgatcgacgaccccttcatccccggcctgctgagcaacaccggcctggtgagacagctggtgctggacaacccccacatgcagcagctgatccagcacaaccccgagatcggccacatcctgaacaaccccgagatcatgagacagaccctggagttcctgagaaaccccgccatgatgcaggagatgatcagaagccaggacagagtgctgagcaacctggagagcatccccggcggctacaacgtgctgtgcaccatgtacaccgacatcatggaccccatgctgaacgccgtgcaggagcagttcggcggcaaccccttcgccaccgccaccaccgacaacgccaccaccaccaccagccagcccagcagaatggagaactgcgaccccctgcccaacccctggaccagcacccacggcggcagcggcagcagacagggcagacaggacggcgaccaggacgcccccgacatcagaaacagattccccaacttcctgggcatcatcagactgtacgactacctgcagcagctgcacgagaacccccagagcctgggcacctacctgcagggcaccgccagcgccctgagccagagccaggagcccccccccagcgtgaacagagtgccccccagcagccccagcagccaggagcccggcagcggccagcccctgcccgaggagagcgtggccatcaagggcagaagcagctgccccgccttcctgagataccccaccgagaacagcaccggccagggcggcgaccaggacggcgccggcaagagcagcaccggccacagcaccaacctgcccgacctggtgagcggcctgggcgacagcgccaacagagtgcccttcgcccccctgagcttcagccccaccgccgccatccccggcatccccgagcccccctggctgcccagccccgcctaccccagaagcctgagacccgacggcatgaaccccgccccccagctgcaggacgagatccagccccagctgcccctgctgatgcacctgcaggccgccatggccaaccccagagccctgcaggccctgagacagatcgagcagggcctgcaggtgctggccaccgaggcccccagactgctgctgtggttcatgccctgcctggccggcaccggcagcgtggccggcggcatcgagagcagagaggaccccctgatgagcgaggaccccctgcccaaccccccccccgaggtgttccccgccctggacagcgccgagctgggcttcctgagcccccccttcctgcacatgctgcaggacctggtgagcaccaacccccagcagctgcagcccgaggcccacttccaggtgcagctggagcagctgagaagcatgggcttcctgaacagagaggccaacctgcaggccctgatcgccaccggcggcgacgtggacgccgccgtggagaagctgagacagagctag

SEQ ID NO: 104254 - DNA, 666 bp, Artificial Sequence
  Description of Artificial Sequence: Synthetic coding sequence
atggccaagggcggcgaggccctgccccagggcagccccgcccccgtgcaggacccccacctgatcaaggtgaccgtgaagacccccaaggacaaggaggacttcagcgtgaccgacacctgcaccatccagcagctgaaggaggagatcagccagagattcaaggcccaccccgaccagctggtgctgatcttcgccggcaagatcctgaaggaccccgacagcctggcccagtgcggcgtgagagacggcctgaccgtgcacctggtgatcaagagacagcacagagccatgggcaacgagtgccccgccgccagcgtgcccacccagggccccagccccggcagcctgccccagcccagcagcatctaccccgccgacggcccccccgccttcagcctgggcctgctgaccggcctgagcagactgggcctggcctacagaggcttccccgaccagcccagcagcctgatgagacagcacgtgagcgtgcccgagttcgtgacccagctgatcgacgaccccttcatccccggcctgctgagcaacaccggcctggtgagacagctggtgctggacaacccccacatgcagcagctgatccagcacaaccccgagatcggccacatcctgaacaaccccgagatcatgagacagaccctgtag

SEQ ID NO: 104255 - DNA, 681 bp, Artificial Sequence
  Description of Artificial Sequence: Synthetic coding sequence
atggccgagcccagcggcgccgagaccagaccccccatcagagtgaccgtgaagacccccaaggacaaggaggagatcgtgatctgcgacagagccagcgtgaaggagttcaaggaggagatcagcagaagattcaaggcccagcaggaccagctggtgctgatcttcgccggcaagatcctgaaggacggcgacaccctgaaccagcacggcatcaaggacggcctgaccgtgcacctggtgatcaagaccccccagaaggcccaggaccccgccccccccgccgcccccagcctgcccgccgccgacgccgagcccagagtgaccctgcacccctaccagagccccagccacgccggcatcgccgccgaccccgccggcaccaccgacctggccgacagaggcccctgggccggcacccagccctggctgctgtgggacatccccgaccccagcaccctgagcagacagcagagaagagtgtacgccagaggcccccacttcctgaccagccacgccagccacatcttcagcaacagaggcttccagagacccgccgccacccacgccgccgacgaccccgccttcggctggaagtggaagctgaccggcgccgacgccagaagcgagatcagcgccgccgccggcgccgcccagctgcacggcctgcaccagagctag

SEQ ID NO: 104256 - DNA, 1806 bp, Artificial Sequence
  Description of Artificial Sequence: Synthetic coding sequence
atggccgagcccagcggcgccgagaccagaccccccatcagagtgaccgtgaagacccccaaggacaaggaggagatcgtgatctgcgacagagccagcgtgaaggagttcaaggaggagatcagcagaagattcaaggcccagcaggaccagctggtgctgatcttcgccggcaagatcctgaaggacggcgacaccctgaaccagcacggcatcaaggacggcctgaccgtgcacctggtgatcaagaccccccagaaggcccaggaccccgccgccgccaccgccagcagccccagcacccccgaccccgccagcgcccccagcaccacccccgccagccccgccacccccgcccagcccagcaccagcggcagcgccagcagcgacgccggcagcggcagcagaagaagcagcggcggcggccccagccccggcgccggcgagggcagccccagcgccaccgccagcatcctgagcggcttcggcggcatcctgggcctgggcagcctgggcctgggcagcgccaacttcatggagctgcagcagcagatgcagagacagctgatgagcaaccccgagatgctgagccagatcatggagaaccccctggtgcaggacatgatgagcaaccccgacctgatgagacacatgatcatggccaacccccagatgcagcagctgatggagagaaaccccgagatcagccacatgctgaacaaccccgagctgatgagacagaccatggagctggccagaaaccccgccatgatgcaggagatgatgagaaaccaggacagagccctgagcaacctggagagcatccccggcggctacaacgccctgagaagaatgtacaccgacatccaggagcccatgttcagcgccgccagagagcagttcggcaacaaccccttcagcagcctggccggcaacagcgacagcagcagcagccagcccctgagaaccgagaacagagagcccctgcccaacccctggagccccagcccccccaccagccaggcccccggcagcggcggcgagggcaccggcggcagcggcaccagccaggtgcaccccaccgtgagcaaccccttcggcatcaacgccgccagcctgggcagcggcatgttcaacagccccgagatgcaggccctgctgcagcagatcagcgagaacccccagctgatgcagaacgtgatcagcgccccctacatgagaagcatgatgcagaccctggcccagaaccccgacttcgccgcccagatgatggtgaacgtgcccctgttcgccggcaacccccagctgcaggagcagctgagactgcagctgcccgtgttcctgcagcagatgcagaaccccgagagcctgagcatcctgaccaaccccagagccatgcaggccctgctgcagatccagcagggcctgcagaccctgcagaccgaggcccccggcctggtgcccagcctgggcagcttcggcatcagcagaacccccgcccccagcgccggcagcaacgccggcagcacccccgaggcccccaccagcagccccgccacccccgccaccagcagccccaccggcgccagcagcgcccagcagcagctgatgcagcagatgatccagctgctggccggcagcggcaacagccaggtgcagacccccgaggtgagattccagcagcagctggagcagctgaacagcatgggcttcatcaacagagaggccaacctgcaggccctgatcgccaccggcggcgacatcaacgccgccatcgagagactgctgggcagccagctgagctag

SEQ ID NO: 104257 - DNA, 336 bp, Artificial Sequence
  Description of Artificial Sequence: Synthetic coding sequence
atggccggcaagcaggccgtgagcgccagcggcaagtggctggacggcatcagaaagtggtactacaacgccgccggcttcaacaagctgggcctgatgagagacgacaccatctacgaggacgaggacgtgaaggaggccatcagaagactgcccgagaacctgtacaacgacagaatgttcagaatcaagagagccctggacctgaacctgaagcaccagatcctgcccaaggagcagtggaccaagtacgaggaggagaacttctacctggagccctacctgaaggaggtgatcagagagagaaaggagagagaggagtgggccaagaagtag

SEQ ID NO: 104258 - DNA, 1443 bp, Artificial Sequence
  Description of Artificial Sequence: Synthetic coding sequence
atggccgccagcgtggtgtgcagagccgccaccgccggcgcccaggtgctgctgagagccagaagaagccccgccctgctgagaacccccgccctgagaagcaccgccaccttcgcccaggccctgcagttcgtgcccgagacccaggtgagcctgctggacaacggcctgagagtggccagcgagcagagcagccagcccacctgcaccgtgggcgtgtggatcgacgtgggcagcagattcgagaccgagaagaacaacggcgccggctacttcctggagcacctggccttcaagggcaccaagaacagacccggcagcgccctggagaaggaggtggagagcatgggcgcccacctgaacgcctacagcaccagagagcacaccgcctactacatcaaggccctgagcaaggacctgcccaaggccgtggagctgctgggcgacatcgtgcagaactgcagcctggaggacagccagatcgagaaggagagagacgtgatcctgagagagatgcaggagaacgacgccagcatgagagacgtggtgttcaactacctgcacgccaccgccttccagggcacccccctggcccaggccgtggagggccccagcgagaacgtgagaaagctgagcagagccgacctgaccgagtacctgagcacccactacaaggcccccagaatggtgctggccgccgccggcggcgtggagcaccagcagctgctggacctggcccagaagcacctgggcggcatcccctggacctacgccgaggacgccgtgcccaccctgaccccctgcagattcaccggcagcgagatcagacacagagacgacgccctgcccttcgcccacgtggccatcgccgtggagggccccggctgggccagccccgacaacgtggccctgcaggtggccaacgccatcatcggccactacgactgcacctacggcggcggcgtgcacctgagcagccccctggccagcggcgccgtggccaacaagctgtgccagagcttccagaccttcagcatctgctacgccgagaccggcctgctgggcgcccacttcgtgtgcgacagaatgaagatcgacgacatgatgttcgtgctgcagggccagtggatgagactgtgcaccagcgccaccgagagcgaggtggccagaggcaagaacatcctgagaaacgccctggtgagccacctggacggcaccacccccgtgtgcgaggacatcggcagaagcctgctgacctacggcagaagaatccccctggccgagtgggagagcagaatcgccgaggtggacgccagcgtggtgagagagatctgcagcaagtacatctacgaccagtgccccgccgtggccggctacggccccatcgagcagctgcccgactacaacagaatcagaagcggcatgttctggctgagattctag

SEQ ID NO: 104259 - DNA, 1362 bp, Artificial Sequence
  Description of Artificial Sequence: Synthetic coding sequence
atgaagctgctgaccagagccggcagcttcagcagattctacagcctgaaggtggcccccaaggtgaaggccaccgccgcccccgccggcgcccccccccagccccaggacctggagttcaccaagctgcccaacggcctggtgatcgccagcctggagaactacagccccgtgagcagaatcggcctgttcatcaaggccggcagcagatacgaggacttcagcaacctgggcaccacccacctgctgagactgaccagcagcctgaccaccaagggcgccagcagcttcaagatcaccagaggcatcgaggccgtgggcggcaagctgagcgtgaccgccaccagagagaacatggcctacaccgtggagtgcctgagaggcgacgtggacatcctgatggagttcctgctgaacgtgaccaccgcccccgagttcagaagatgggaggtggccgacctgcagccccagctgaagatcgacaaggccgtggccttccagaacccccagacccacgtgatcgagaacctgcacgccgccgcctacagaaacgccctggccaaccccctgtactgccccgactacagaatcggcaaggtgaccagcgaggagctgcactacttcgtgcagaaccacttcaccagcgccagaatggccctgatcggcctgggcgtgagccaccccgtgctgaagcaggtggccgagcagttcctgaacatgagaggcggcctgggcctgagcggcgccaaggccaactacagaggcggcgagatcagagagcagaacggcgacagcctggtgcacgccgccttcgtggccgagagcgccgtggccggcagcgccgaggccaacgccttcagcgtgctgcagcacgtgctgggcgccggcccccacgtgaagagaggcagcaacaccaccagccacctgcaccaggccgtggccaaggccacccagcagcccttcgacgtgagcgccttcaacgccagctacagcgacagcggcctgttcggcatctacaccatcagccaggccaccgccgccggcgacgtgatcaaggccgcctacaaccaggtgaagaccatcgcccagggcaacctgagcaacaccgacgtgcaggccgccaagaacaagctgaaggccggctacctgatgagcgtggagagcagcgagtgcttcctggaggaggtgggcagccaggccctggtggccggcagctacatgccccccagcaccgtgctgcagcagatcgacagcgtggccaacgccgacatcatcaacgccgccaagaagttcgtgagcggccagaagagcatggccgccagcggcaacctgggccacacccccttcgtggacgagctgtag

SEQ ID NO: 104260 - DNA, 276 bp, Artificial Sequence
  Description of Artificial Sequence: Synthetic coding sequence
atgggcctggaggacgagcagaagatgctgaccgagagcggcgaccccgaggaggaggaggaggaggaggaggagctggtggaccccctgaccaccgtgagagagcagtgcgagcagctggagaagtgcgtgaaggccagagagagactggagctgtgcgacgagagagtgagcagcagaagccacaccgaggaggactgcaccgaggagctgttcgacttcctgcacgccagagaccactgcgtggcccacaagctgttcaacaacctgaagtag

SEQ ID NO: 104261 - DNA, 249 bp, Artificial Sequence
  Description of Artificial Sequence: Synthetic coding sequence
atgggcagagagttcggcaacctgaccagaatgagacacgtgatcagctacagcctgagccccttcgagcagagagcctacccccacgtgttcaccaagggcatccccaacgtgctgagaagaatcagagagagcttcttcagagtggtgccccagttcgtggtgttctacctgatctacacctggggcaccgaggagttcgagagaagcaagagaaagaaccccgccgcctacgagaacgacaagtag

SEQ ID NO: 104262 - DNA, 249 bp, Artificial Sequence; identical to SEQ ID NO: 104261
  Description of Artificial Sequence: Synthetic coding sequence

SEQ ID NO: 104263 - DNA, 249 bp, Artificial Sequence; identical to SEQ ID NO: 104261
  Description of Artificial Sequence: Synthetic coding sequence

SEQ ID NO: 104264 - DNA, 387 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatcatcgagcccagcctgagacagctggcccagaagtacaactgcgacaagatgatctgcagaaagtgctacgccagactgcaccccagagccgtgaactgcagaaagaagaagtgcggccacaccaacaacctgagacccaagaagaaggtgaagtag

SEQ ID NO: 104265 - DNA, 387 bp, Artificial Sequence; identical to SEQ ID NO: 104264
  Description of Artificial Sequence: Synthetic coding sequence

SEQ ID NO: 104266 - DNA, 1872 bp, Artificial Sequence
  Description of Artificial Sequence: Synthetic coding sequence
atggccgccggcgagacccagctgtacgccaaggtgagcaacaagctgaagagcagaagcagccccagcctgctggagcccctgctggccatgggcttccccgtgcacaccgccctgaaggccctggccgccaccggcagaaagaccgccgaggaggccctggcctggctgcacgaccactgcaacgaccccagcctggacgaccccatcccccaggagtacgccctgttcctgtgccccaccggccccctgctggagaagctgcaggagttctggagagagagcaagagacagtgcgccaagaacagagcccacgaggtgttcccccacgtgaccctgtgcgacttcttcacctgcgaggaccagaaggtggagtgcctgtacgaggccctgaagagagccggcgacagactgctgggcagcttccccaccgccgtgcccctggccctgcacagcagcatcagctacctgggcttcttcgtgagcggcagccccgccgacgtgatcagagagttcgccatgaccttcgccaccgaggccagcctgctggccgactgcagcgtgaagccctgcaccaagcagctgcacctgaccctggcccacaagttctacccccaccaccagagaaccctggagcagctggccagagccatccccctgggccacagctgccagtggaccgccgccctgtacagcagagacatgagattcgtgcactaccagaccctgagagccctgttccagtacaagccccagaacgtggacgagctgaccctgagccccggcgactacatcttcgtggaccccacccagcaggacgaggccagcgagggctgggtgatcggcatcagccagagaaccggctgcagaggcttcctgcccgagaactacaccgacagagccagcgagagcgacacctgggtgaagcacagaatgtacaccttcagcctggccaccgacctgaacagcagaaaggacggcgaggccagcagcagatgcagcggcgagttcctgccccagaccgccagaagcctgagcagcctgcaggccctgcaggccaccgtggccagaaagagcgtgctggtggtgagacacggcgagagagtggaccagatcttcggcaaggcctggctgcagcagtgcagcacccccgacggcaagtactacagacccgacctgaacttcccctgcagcctgcccagaagaagcagaggcatcaaggacttcgagaacgacccccccctgagcagctgcggcatcttccagagcagaatcgccggcgacgccctgctggacagcggcatcagaatcagcagcgtgttcgccagccccgccctgagatgcgtgcagaccgccaagctgatcctggaggagctgaagctggagaagaagatcaagatcagagtggagcccggcatcttcgagtggaccaagtgggaggccggcaagaccacccccaccctgatgagcctggaggagctgaaggaggccaacttcaacatcgacaccgactacagacccgccttccccctgagcgccctgatgcccgccgagagctaccaggagtacatggacagatgcaccgccagcatggtgcagatcgtgaacacctgcccccaggacaccggcgtgatcctgatcgtgagccacggcagcaccctggacagctgcaccagacccctgctgggcctgccccccagagagtgcggcgacttcgcccagctggtgagaaagatccccagcctgggcatgtgcttctgcgaggagaacaaggaggagggcaagtgggagctggtgaacccccccgtgaagaccctgacccacggcgccaacgccgccttcaactggagaaactggatcagcggcaactag

SEQ ID NO: 104267 - DNA, 1986 bp, Artificial Sequence
  Description of Artificial Sequence: Synthetic coding sequence
atggccgccggcgagacccagctgtacgccaaggtgagcaacaagctgaagagcagaagcagccccagcctgctggagcccctgctggccatgggcttccccgtgcacaccgccctgaaggccctggccgccaccggcagaaagaccgccgaggaggccctggcctggctgcacgaccactgcaacgaccccagcctggacgaccccatcccccaggagtacgccctgttcctgtgccccaccggccccctgctggagaagctgcaggagttctggagagagagcaagagacagtgcgccaagaacagagcccacgaggtgttcccccacgtgaccctgtgcgacttcttcacctgcgaggaccagaaggtggagtgcctgtacgaggccctgaagagagccggcgacagactgctgggcagcttccccaccgccgtgcccctggccctgcacagcagcatcagctacctgggcttcttcgtgagcggcagccccgccgacgtgatcagagagttcgccatgaccttcgccaccgaggccagcctgctggccggcaccagcgtgagcagattctggatcttcagccaggtgcccggccacggccccaacctgagactgagcaacctgaccagagccagcttcgtgagccactacatcctgcagaagtactgcagcgtgaagccctgcaccaagcagctgcacctgaccctggcccacaagttctacccccaccaccagagaaccctggagcagctggccagagccatccccctgggccacagctgccagtggaccgccgccctgtacagcagagacatgagattcgtgcactaccagaccctgagagccctgttccagtacaagccccagaacgtggacgagctgaccctgagccccggcgactacatcttcgtggaccccacccagcaggacgaggccagcgagggctgggtgatcggcatcagccagagaaccggctgcagaggcttcctgcccgagaactacaccgacagagccagcgagagcgacacctgggtgaagcacagaatgtacaccttcagcctggccaccgacctgaacagcagaaaggacggcgaggccagcagcagatgcagcggcgagttcctgccccagaccgccagaagcctgagcagcctgcaggccctgcaggccaccgtggccagaaagagcgtgctggtggtgagacacggcgagagagtggaccagatcttcggcaaggcctggctgcagcagtgcagcacccccgacggcaagtactacagacccgacctgaacttcccctgcagcctgcccagaagaagcagaggcatcaaggacttcgagaacgacccccccctgagcagctgcggcatcttccagagcagaatcgccggcgacgccctgctggacagcggcatcagaatcagcagcgtgttcgccagccccgccctgagatgcgtgcagaccgccaagctgatcctggaggagctgaagctggagaagaagatcaagatcagagtggagcccggcatcttcgagtggaccaagtgggaggccggcaagaccacccccaccctgatgagcctggaggagctgaaggaggccaacttcaacatcgacaccgactacagacccgccttccccctgagcgccctgatgcccgccgagagctaccaggagtacatggacagatgcaccgccagcatggtgcagatcgtgaacacctgcccccaggacaccggcgtgatcctgatcgtgagccacggcagcaccctggacagctgcaccagacccctgctgggcctgccccccagagagtgcggcgacttcgcccagctggtgagaaagatccccagcctgggcatgtgcttctgcgaggagaacaaggaggagggcaagtgggagctggtgaacccccccgtgaagaccctgacccacggcgccaacgccgccttcaactggagaaactggatcagcggcaactag

SEQ ID NO: 104268 - DNA, 369 bp, Artificial Sequence
  Description of Artificial Sequence: Synthetic coding sequence
atggccgccggcgagacccagctgtacgccaaggtgagcaacaagctgaagagcagaagcagccccagcctgctggagcccctgctggccatgggcttccccgtgcacaccgccctgaaggccctggccgccaccggcagaaagaccgccgaggaggccctggcctggctgcacgaccactgcaacgaccccagcctggacgaccccatcccccaggagtacgccctgttcctgtgccccaccggccccctgctggagaagctgcaggagttctggagagagagcaagagacagtgcgccaagaacagagcccacgaggtgttcccccacgtgaccctgtgcgacttcttcaccggccccgccgtgtag

SEQ ID NO: 104269 - DNA, 1581 bp, Artificial Sequence
  Description of Artificial Sequence: Synthetic coding sequence
atggccgccggcgagacccagctgtacgccaaggtgagcaacaagctgaagagcagaagcagccccagcctgctggagcccctgctggccatgggcttccccgtgcacaccgccctgaaggccctggccgccaccggcagaaagaccgccgaggaggccctggcctggctgcacgaccactgcaacgaccccagcctggacgaccccatcccccaggagtacgccctgttcctgtgccccaccggccccctgctggagaagctgcaggagttctggagagagagcaagagacagtgcgccaagaacagagcccacgaggtgttcccccacgtgaccctgtgcgacttcttcacctgcgaggaccagaaggtggagtgcctgtacgaggccctgaagagagccggcgacagactgctgggcagcttccccaccgccgtgcccctggccctgcacagcagcatcagctacctgggcttcttcgtgagcggcagccccgccgacgtgatcagagagttcgccatgaccttcgccaccgaggccagcctgctggccgactgcagcgtgaagccctgcaccaagcagctgcacctgaccctggcccacaagttctacccccaccaccagagaaccctggagcagctggccagagccatccccctgggccacagctgccagtggaccgccgccctgtacagcagagacatgagattcgtgcactaccagaccctgagagccctgttccagtacaagccccagaacgtggacgagctgaccctgagccccggcgactacatcttcgtggaccccacccagcaggacgaggccagcgagggctgggtgatcggcatcagccagagaaccggctgcagaggcttcctgcccgagaactacaccgacagagccagcgagagcgacacctgggtgaagcacagaatgtacaccttcagcctggccaccgacctgaacagcagaaaggacggcgaggccagcagcagatgcagcggcgagttcctgccccagaccgccagaagcctgagcagcctgcaggccctgcaggccaccgtggccagaaagagcgtgctggtggtgagacacggcgagagagtggaccagatcttcggcaaggcctggctgcagcagtgcagcacccccgacggcaagtactacagacccgacctgaacttcccctgcagcctgcccagaagaagcagaggcatcaaggacttcgagaacgacccccccctgagcagctgcggcatcttccagagcagaatcgccggcgacgccctgctggacagcggcatcagaatcagcagcgtgttcgccagccccgccctgagatgcgtgcagaccgccaagctgatcctggaggagctgaagctggagaagaagatcaagatcagagtggagcccggcatcttcgagtggaccaagtgggaggccggcaagaccacccccaccctgatgagcctggaggagctgaaggaggccaacttcaacatcgacaccgactacagaagcctgccctgggcctgcgccagcgtgaagaagatcaagagaaaggagaacggcagctggtag

SEQ ID NO: 104270 - DNA, 1950 bp, Artificial Sequence
  Description of Artificial Sequence: Synthetic coding sequence
atggcccagtacggccaccccagccccctgggcatggccgccagagaggagctgtacagcaaggtgacccccagaagaaacagacagcagagacccggcaccatcaagcacggcagcgccctggacgtgctgctgagcatgggcttccccagagccagagcccagaaggccctggccagcaccggcggcagaagcgtgcaggccgcctgcgactggctgttcagccacgtgggcgaccccttcctggacgaccccctgcccagagagtacgtgctgtacctgagacccaccggccccctggcccagaagctgagcgacttctggcagcagagcaagcagatctgcggcaagaacaaggcccacaacatcttcccccacatcaccctgtgccagttcttcatgtgcgaggacagcaaggtggacgccctgggcgaggccctgcagaccaccgtgagcagatggaagtgcaagttcagcgcccccctgcccctggagctgtacaccagcagcaacttcatcggcctgttcgtgaaggaggacagcgccgaggtgctgaagaagttcgccgccgacttcgccgccgaggccgccagcaagaccgaggtgcacgtggagccccacaagaagcagctgcacgtgaccctggcctaccacttccaggccagccacctgcccaccctggagaagctggcccagaacatcgacgtgaagctgggctgcgactgggtggccaccatcttcagcagagacatcagattcgccaaccacgagaccctgcaggtgatctacccctacaccccccagaacgacgacgagctggagctggtgcccggcgacttcatcttcatgagccccatggagcagaccagcaccagcgagggctggatctacggcaccagcctgaccaccggctgcagcggcctgctgcccgagaactacatcaccaaggccgacgagtgcagcacctggatcttccacggcagctacagcatcctgaacaccagcagcagcaacagcctgaccttcggcgacggcgtgctggagagaagaccctacgaggaccagggcctgggcgagaccacccccctgaccatcatctgccagcccatgcagcccctgagagtgaacagccagcccggcccccagaagagatgcctgttcgtgtgcagacacggcgagagaatggacgtggtgttcggcaagtactggctgagccagtgcttcgacgccaagggcagatacatcagaaccaacctgaacatgccccacagcctgccccagagaagcggcggcttcagagactacgagaaggacgcccccatcaccgtgttcggctgcatgcaggccagactggtgggcgaggccctgctggagagcaacaccatcatcgaccacgtgtactgcagccccagcctgagatgcgtgcagaccgcccacaacatcctgaagggcctgcagcaggagaaccacctgaagatcagagtggagcccggcctgttcgagtggaccaagtgggtggccggcagcaccctgcccgcctggatcccccccagcgagctggccgccgccaacctgagcgtggacaccacctacagaccccacatccccatcagcaagctggtggtgagcgagagctacgacacctacatcagcagaagcttccaggtgaccaaggagatcatcagcgagtgcaagagcaagggcaacaacatcctgatcgtggcccacgccagcagcctggaggcctgcacctgccagctgcagggcctgagcccccagaacagcaaggacttcgtgcagatggtgagaaagatcccctacctgggcttctgcagctgcgaggagctgggcgagaccggcatctggcagctgaccgacccccccatcctgcccctgacccacggccccaccggcggcttcaactggagagagaccctgctgcaggagtag

SEQ ID NO: 104271 - DNA, 1509 bp, Artificial Sequence
  Description of Artificial Sequence: Synthetic coding sequence
atggccagcaagaagctgggcgccgacttccacggcaccttcagctacctggacgacgtgcccttcaagaccggcgacaagttcaagacccccgccaaggtgggcctgcccatcggcttcagcctgcccgactgcctgcaggtggtgagagaggtgcagtacgacttcagcctggagaagaagaccatcgagtgggccgaggagatcaagaagatcgaggaggccgagagagaggccgagtgcaagatcgccgaggccgaggccaaggtgaacagcaagagcggccccgagggcgacagcaagatgagcttcagcaagacccacagcaccgccaccatgcccccccccatcaaccccatcctggccagcctgcagcacaacagcatcctgacccccaccagagtgagcagcagcgccaccaagcagaaggtgctgagccccccccacatcaaggccgacttcaacctggccgacttcgagtgcgaggaggaccccttcgacaacctggagctgaagaccatcgacgagaaggaggagctgagaaacatcctggtgggcaccaccggccccatcatggcccagctgctggacaacaacctgcccagaggcggcagcggcagcgtgctgcaggacgaggaggtgctggccagcctggagagagccaccctggacttcaagcccctgcacaagcccaacggcttcatcaccctgccccagctgggcaactgcgagaagatgagcctgagcagcaaggtgagcctgccccccatccccgccgtgagcaacatcaagagcctgagcttccccaagctggacagcgacgacagcaaccagaagaccgccaagctggccagcaccttccacagcaccagctgcctgagaaacggcaccttccagaacagcctgaagcccagcacccagagcagcgccagcgagctgaacggccaccacaccctgggcctgagcgccctgaacctggacagcggcaccgagatgcccgccctgaccagcagccagatgcccagcctgagcgtgctgagcgtgtgcaccgaggagagcagcccccccaacaccggccccaccgtgaccccccccaacttcagcgtgagccaggtgcccaacatgcccagctgcccccaggcctacagcgagctgcagatgctgagccccagcgagagacagtgcgtggagaccgtggtgaacatgggctacagctacgagtgcgtgctgagagccatgaagaagaagggcgagaacatcgagcagatcctggactacctgttcgcccacggccagctgtgcgagaagggcttcgaccccctgctggtggaggaggccctggagatgcaccagtgcagcgaggagaagatgatggagttcctgcagctgatgagcaagttcaaggagatgggcttcgagctgaaggacatcaaggaggtgctgctgctgcacaacaacgaccaggacaacgccctggaggacctgatggccagagccggcgccagctag

SEQ ID NO: 104272 - DNA, 1509 bp, Artificial Sequence; identical to SEQ ID NO: 104271
  Description of Artificial Sequence: Synthetic coding sequence

SEQ ID NO: 104273 - DNA, 1326 bp, Artificial Sequence
  Description of Artificial Sequence: Synthetic coding sequence
atggccagcaagaagctgggcgccgacttccacggcaccttcagctacctggacgacgtgcccttcaagaccggcgacaagttcaagacccccgccaaggtgggcctgcccatcggcttcagcctgcccgactgcctgcaggtggtgagagaggtgcagtacgacttcagcctggagaagaagaccatcgagtgggccgaggagatcaagaagatcgaggaggccgagagagaggccgagtgcaagatcgccgaggccgaggccaaggtgaacagcaagagcggccccgagggcgacagcaagatgagcttcagcaagacccacagcaccgccaccatgcccccccccatcaaccccatcctggccagcctgcagcacaacagcatcctgacccccaccagagtgagcagcagcgccaccaagcagaaggtgctgagccccccccacatcaaggccgacttcaacctggccgacttcgagtgcgaggaggaccccttcgacaacctggagctgaagaccatcgacgagaaggaggagctgagaaacatcctggtgggcaccaccggccccatcatggcccagctgctggacaacaacctgcccagaggcggcagcggcagcgtgctgcaggacgaggaggtgctggccagcctggagagagccaccctggacttcaagcccctgcacaagcccaacggcttcatcaccctgccccagctgggcaactgcgagaagatgagcctgagcagcaaggtgagcctgccccccatccccgccgtgagcaacatcaagagcctgagcttccccaagctggacagcgacgacagcaaccagaagaccgccaagctggccagcaccttccacagcaccagctgcctgagaaacggcaccttccagaacagcctgaagcccagcacccagagcagcgccagcgagctgaacggccaccacaccctgggcctgagcgccctgaacctggacagcggcaccgagatgcccgccctgaccagcagccagatgcccagcctgagcgtgctgagcgtgtgcaccgaggagagcagcccccccaacaccggccccaccatcctggactacctgttcgcccacggccagctgtgcgagaagggcttcgaccccctgctggtggaggaggccctggagatgcaccagtgcagcgaggagaagatgatggagttcctgcagctgatgagcaagttcaaggagatgggcttcgagctgaaggacatcaaggaggtgctgctgctgcacaacaacgaccaggacaacgccctggaggacctgatggccagagccggcgccagctag

SEQ ID NO: 104274 - DNA, 1509 bp, Artificial Sequence; identical to SEQ ID NO: 104271
  Description of Artificial Sequence: Synthetic coding sequence

SEQ ID NO: 104275 - DNA, 1509 bp, Artificial Sequence; identical to SEQ ID NO: 104271
  Description of Artificial Sequence: Synthetic coding sequence

SEQ ID NO: 104276 - DNA, 1617 bp, Artificial Sequence
  Description of Artificial Sequence: Synthetic coding sequence
atgagcggcgccgtgagaggcagaagaagagaggtgggcctgcagcacggcggctgcggcaccggcggcggctacggcgacggcctggccagaagcggccagagctggagatggtggagaagcctgagcctgggcgccgtgggcagcagcgccggcaccgagcccggcagacccgccggcgccagcaccttcagactgctgagaagaagacagcagagacacagcggcagcaagtggctgctgagaagctgggtgcagatcttcatgtacgacttcagcctggagaagaagaccatcgagtgggccgaggagatcaagaagatcgaggaggccgagagagaggccgagtgcaagatcgccgaggccgaggccaaggtgaacagcaagagcggccccgagggcgacagcaagatgagcttcagcaagacccacagcaccgccaccatgcccccccccatcaaccccatcctggccagcctgcagcacaacagcatcctgacccccaccagagtgagcagcagcgccaccaagcagaaggtgctgagccccccccacatcaaggccgacttcaacctggccgacttcgagtgcgaggaggaccccttcgacaacctggagctgaagaccatcgacgagaaggaggagctgagaaacatcctggtgggcaccaccggccccatcatggcccagctgctggacaacaacctgcccagaggcggcagcggcagcgtgctgcaggacgaggaggtgctggccagcctggagagagccaccctggacttcaagcccctgcacaagcccaacggcttcatcaccctgccccagctgggcaactgcgagaagatgagcctgagcagcaaggtgagcctgccccccatccccgccgtgagcaacatcaagagcctgagcttccccaagctggacagcgacgacagcaaccagaagaccgccaagctggccagcaccttccacagcaccagctgcctgagaaacggcaccttccagaacagcctgaagcccagcacccagagcagcgccagcgagctgaacggccaccacaccctgggcctgagcgccctgaacctggacagcggcaccgagatgcccgccctgaccagcagccagatgcccagcctgagcgtgctgagcgtgtgcaccgaggagagcagcccccccaacaccggccccaccgtgaccccccccaacttcagcgtgagccaggtgcccaacatgcccagctgcccccaggcctacagcgagctgcagatgctgagccccagcgagagacagtgcgtggagaccgtggtgaacatgggctacagctacgagtgcgtgctgagagccatgaagaagaagggcgagaacatcgagcagatcctggactacctgttcgcccacggccagctgtgcgagaagggcttcgaccccctgctggtggaggaggccctggagatgcaccagtgcagcgaggagaagatgatggagttcctgcagctgatgagcaagttcaaggagatgggcttcgagctgaaggacatcaaggaggtgctgctgctgcacaacaacgaccaggacaacgccctggaggacctgatggccagagccggcgccagctag

SEQ ID NO: 104277 - DNA, 1701 bp, Artificial Sequence
  Description of Artificial Sequence: Synthetic coding sequence
atgagcggcgccgtgagaggcagaagaagagaggtgggcctgcagcacggcggctgcggcaccggcggcggctacggcgacggcctggccagaagcggccagagctggagatggtggagaagcctgagcctgggcgccgtgggcagcagcgccggcaccgagcccggcagacccgccggcgccagcaccttcagactgctgagaagaagacagcagagacacagcggcaccttcagctacctggacgacgtgcccttcaagaccggcgacaagttcaagacccccgccaaggtgggcctgcccatcggcttcagcctgcccgactgcctgcaggtggtgagagaggtgcagtacgacttcagcctggagaagaagaccatcgagtgggccgaggagatcaagaagatcgaggaggccgagagagaggccgagtgcaagatcgccgaggccgaggccaaggtgaacagcaagagcggccccgagggcgacagcaagatgagcttcagcaagacccacagcaccgccaccatgcccccccccatcaaccccatcctggccagcctgcagcacaacagcatcctgacccccaccagagtgagcagcagcgccaccaagcagaaggtgctgagccccccccacatcaaggccgacttcaacctggccgacttcgagtgcgaggaggaccccttcgacaacctggagctgaagaccatcgacgagaaggaggagctgagaaacatcctggtgggcaccaccggccccatcatggcccagctgctggacaacaacctgcccagaggcggcagcggcagcgtgctgcaggacgaggaggtgctggccagcctggagagagccaccctggacttcaagcccctgcacaagcccaacggcttcatcaccctgccccagctgggcaactgcgagaagatgagcctgagcagcaaggtgagcctgccccccatccccgccgtgagcaacatcaagagcctgagcttccccaagctggacagcgacgacagcaaccagaagaccgccaagctggccagcaccttccacagcaccagctgcctgagaaacggcaccttccagaacagcctgaagcccagcacccagagcagcgccagcgagctgaacggccaccacaccctgggcctgagcgccctgaacctggacagcggcaccgagatgcccgccctgaccagcagccagatgcccagcctgagcgtgctgagcgtgtgcaccgaggagagcagcccccccaacaccggccccaccgtgaccccccccaacttcagcgtgagccaggtgcccaacatgcccagctgcccccaggcctacagcgagctgcagatgctgagccccagcgagagacagtgcgtggagaccgtggtgaacatgggctacagctacgagtgcgtgctgagagccatgaagaagaagggcgagaacatcgagcagatcctggactacctgttcgcccacggccagctgtgcgagaagggcttcgaccccctgctggtggaggaggccctggagatgcaccagtgcagcgaggagaagatgatggagttcctgcagctgatgagcaagttcaaggagatgggcttcgagctgaaggacatcaaggaggtgctgctgctgcacaacaacgaccaggacaacgccctggaggacctgatggccagagccggcgccagctag

SEQ ID NO: 104278 - DNA, 690 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggctgctag

SEQ ID NO: 104279 - DNA, 690 bp, Artificial Sequence; identical to SEQ ID NO: 104278
  Description of Artificial Sequence: Synthetic coding sequence

SEQ ID NO: 104280 - DNA, 690 bp, Artificial Sequence; identical to SEQ ID NO: 104278
  Description of Artificial Sequence: Synthetic coding sequence

SEQ ID NO: 104281 - DNA, 462 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggctgctag

SEQ ID NO: 104282 - DNA, 2058 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatccccagcgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcgtgtag

SEQ ID NO: 104283 - DNA, 450 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgtag

SEQ ID NO: 104284 - DNA, 372 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggctag

SEQ ID NO: 104285 - DNA, 2058 bp, Artificial Sequence; identical to SEQ ID NO: 104282
  Description of Artificial Sequence: Synthetic coding sequence

SEQ ID NO: 104286 - DNA, 486 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgacctag

SEQ ID NO: 104287 - DNA, 405 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactag

SEQ ID NO: 104288 - DNA, 510 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatccccagcgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtgtag

SEQ ID NO: 104289 - DNA, 468 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatctag

SEQ ID NO: 104290 - DNA, 186 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatctag

SEQ ID NO: 104291 - DNA, 1830 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatccccagcgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcgtgtag

SEQ ID NO: 104292 - DNA, 411 bp, Artificial Sequence
  Description of Artificial Sequence: Synthetic coding sequence
atgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaacatccagaaggagagcaccctgcacctggtgctgagactgagaggcggcatgcagatcttcgtgaagaccctgaccggcaagaccatcaccctggaggtggagcccagcgacaccatcgagaacgtgaaggccaagatccaggacaaggagggcatcccccccgaccagcagagactgatcttcgccggcaagcagctggaggacggcagaaccctgagcgactacaactag

SEQ ID NO: 104293 - DNA, 672 bp, Artificial Sequence
  Description of Artificial Sequence: Synthetic coding sequence
atgcagctgaagcccatggagatcaaccccgagatgctgaacaaggtgctgagcagactgggcgtggccggccagtggagattcgtggacgtgctgggcctggaggaggagagcctgggcagcgtgcccgcccccgcctgcgccctgctgctgctgttccccctgaccgcccagcacgagaacttcagaaagaagcagatcgaggagctgaagggccaggaggtgagccccaaggtgtacttcatgaagcagaccatcggcaacagctgcggcaccatcggcctgatccacgccgtggccaacaaccaggacaagctgggcttcgaggacggcagcgtgctgaagcagttcctgagcgagaccgagaagatgagccccgaggacagagccaagtgcttcgagaagaacgaggccatccaggccgcccacgacgccgtggcccaggagggccagtgcagagtggacgacaaggtgaacttccacttcatcctgttcaacaacgtggacggccacctgtacgagctggacggcagaatgcccttccccgtgaaccacggcgccagcagcgaggacaccctgctgaaggacgccgccaaggtgtgcagagagttcaccgagagagagcagggcgaggtgagattcagcgccgtggccctgtgcaaggccgcctag

SEQ ID NO: 104294 - DNA, 642 bp, Artificial Sequence
  Description of Artificial Sequence: Synthetic coding sequence
atgcagctgaagcccatggagatcaaccccgagatgctgaacaaggtgctgagcagactgggcgtggccggccagtggagattcgtggacgtgctgggcctggaggaggagagcctgggcagcgtgcccgcccccgcctgcgccctgctgctgctgttccccctgaccgcccagcacgagaacttcagaaagaagcagatcgaggagctgaagggccaggaggtgagccccaaggtgtacttcatgaagcagaccatcggcaacagctgcggcaccatcggcctgatccacgccgtggccaacaaccaggacaagctgggcttcgaggacggcagcgtgctgaagcagttcctgagcgagaccgagaagatgagccccgaggacagagccaagtgcttcgagaagaacgaggccatccaggccgcccacgacgccgtggcccaggagggccagtgcagagtggacgacaaggtgaacttccacttcatcctgttcaacaacgtggacggccacctgtacgagctggacggcagaatgcccttccccgtgaaccacggcgccagcagcgaggacaccctgctgaaggacgccgccaaggtgtgcagagagttcaccgagagagagcagggcgaggtgagatag

SEQ ID NO: 104295 - DNA, 177 bp, Artificial Sequence
  Description of Artificial Sequence: Synthetic coding sequence
atgcagctgaagcccatggagatcaaccccgagatgctgaacaaggtgctgagcagactgggcgtggccggccagtggagattcgtggacgtgctgggcctggaggaggagagcctgggcagcgtgcccgcccccgcctgcgccctgctgctgctgttccccctgaccgcccagtag

SEQ ID NO: 104296 - DNA, 756 bp, Artificial Sequence
  Description of Artificial Sequence: Synthetic coding sequence
atggtgcccagacccgtgtgcgccgtgctgctgctgttccccatcaccgagaagtacgaggtgttcagaaccgaggaggaggagaagatcaagagccagggccaggacgtgaccagcagcgtgtacttcatgaagcagaccatcagcaacgcctgcggcaccatcggcctgatccacgccatcgccaacaacaaggacaagatgcacttcgagagcggcagcaccctgaagaagttcctggaggagagcgtgagcatgagccccgaggagagagccagatacctggagaactacgacgccatcagagtgacccacgagaccagcgcccacgagggccagaccgagagcagcagccccagcagcagccagccccacagcagccactgcagaaccaaggccagcagcctgtgccaccacgccagcctgccctgggtgaagagaaaccacgtgggccccgccaaggccaccagccccagcctgagactgagaagatggagacccttcctgagactgcccagcctgggcctgcacagcgtggcccccagcatcgacgagaaggtggacctgcacttcatcgccctggtgcacgtggacggccacctgtacgagctggacggcagaaagcccttccccatcaaccacggcgagaccagcgacgagaccctgctggaggacgccatcgaggtgtgcaagaagttcatggagagagaccccgacgagctgagattcaacgccatcgccctgagcgccgcctag

SEQ ID NO: 104297 - DNA, 693 bp, Artificial Sequence
  Description of Artificial Sequence: Synthetic coding sequence
atggagggccagagatggctgcccctggaggccaaccccgaggtgaccaaccagttcctgaagcagctgggcctgcaccccaactggcagttcgtggacgtgtacggcatggaccccgagctgctgagcatggtgcccagacccgtgtgcgccgtgctgctgctgttccccatcaccgagaagtacgaggtgttcagaaccgaggaggaggagaagatcaagagccagggccaggacgtgaccagcagcgtgtacttcatgaagcagaccatcagcaacgcctgcggcaccatcggcctgatccacgccatcgccaacaacaaggacaagatgcacttcgagagcggcagcaccctgaagaagttcctggaggagagcgtgagcatgagccccgaggagagagccagatacctggagaactacgacgccatcagagtgacccacgagaccagcgcccacgagggccagaccgaggcccccagcatcgacgagaaggtggacctgcacttcatcgccctggtgcacgtggacggccacctgtacgagctggacggcagaaagcccttccccatcaaccacggcgagaccagcgacgagaccctgctggaggacgccatcgaggtgtgcaagaagttcatggagagagaccccgacgagctgagattcaacgccatcgccctgagcgccgcctag

SEQ ID NO: 104298 - DNA, 687 bp, Artificial Sequence
  Description of Artificial Sequence: Synthetic coding sequence
accgaggaggaggagaagatcaagagccagggccaggacgtgaccagcagcgtgtacttcatgaagcagaccatcagcaacgcctgcggcaccatcggcctgatccacgccatcgccaacaacaaggacaagatgcacttcgagagcggcagcaccctgaagaagttcctggaggagagcgtgagcatgagccccgaggagagagccagatacctggagaactacgacgccatcagagtgacccacgagaccagcgcccacgagggccagaccgagagcagcagccccagcagcagccagccccacagcagccactgcagaaccaaggccagcagcctgtgccaccacgccagcctgccctgggtgaagagaaaccacgtgggccccgccaaggccaccagccccagcctgagactgagaagatggagacccttcctgagactgcccagcctgggcctgcacagcgtggcccccagcatcgacgagaaggtggacctgcacttcatcgccctggtgcacgtggacggccacctgtacgagctggacggcagaaagcccttccccatcaaccacggcgagaccagcgacgagaccctgctggaggacgccatcgaggtgtgcaagaagttcatggagagagaccccgacgagctgagattcaacgccatcgccctgagcgccgcctag

SEQ ID NO: 104299 - DNA, 981 bp, Artificial Sequence
  Description of Artificial Sequence: Synthetic coding sequence
atgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagttcgagaagcacttcgagaagaccctgctgggcaagtag

SEQ ID NO: 104300 - DNA, 951 bp, Artificial Sequence
  Description of Artificial Sequence: Synthetic coding sequence
atgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagggcaagtag

SEQ ID NO: 104301 - DNA, 1107 bp, Artificial Sequence
  Description of Artificial Sequence: Synthetic coding sequence
gccagaggcggcagcggcagatgcgtggccagagccatgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaaggacggcttcagcccctgctgccccggctggagccagacccccgagctgaagcccagcgcctgcctggacctgcccaagtggtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaaggccaaggagaagcagaacgccaagaaggcccaggagaccaagtag

SEQ ID NO: 104302 - DNA, 1068 bp, Artificial Sequence
  Description of Artificial Sequence: Synthetic coding sequence
atgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaaggacggcttcagcccctgctgccccggctggagccagacccccgagctgaagcccagcgcctgcctggacctgcccaagtggtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaaggccaaggagaagcagaacgccaagaaggcccaggagaccaagtag

SEQ ID NO: 104303 - DNA, 579 bp, Artificial Sequence
  Description of Artificial Sequence: Synthetic coding sequence
atgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagatcttctag

SEQ ID NO: 104304 - DNA, 987 bp, Artificial Sequence
  Description of Artificial Sequence: Synthetic coding sequence
atgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaaggccaaggagaagcagaacgccaagaaggcccaggagaccaagtag

SEQ ID NO: 104305 - DNA, 990 bp, Artificial Sequence
  Description of Artificial Sequence: Synthetic coding sequence
atgaccggcaacgccggcgagtggtgcctgatggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaaggccaaggagaagcagaacgccaagaaggcccaggagaccaagtag

SEQ ID NO: 104306 - DNA, 954 bp, Artificial Sequence
  Description of Artificial Sequence: Synthetic coding sequence
atggagagcgaccccggcgtgttcaccgagctgatcaagggcttcggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagttcgagaagcacttcgagaagaccctgctgggcaagtag

SEQ ID NO: 104307 - DNA, 300 bp, Artificial Sequence
  Description of Artificial Sequence: Synthetic coding sequence
tgaaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagatcttctag

SEQ ID NO: 104308 - DNA, 498 bp, Artificial Sequence
  Description of Artificial Sequence: Synthetic coding sequence
atggtgagacccggcctggccagaatgagcctgcccagatgctggttcagataccccggctggaccggcgccgaggccggcagaggcagagccatcgtgagcagaagactgcccagcctgaacccctgggacgccggcgagagacacggcggcctggtgagaatctgcgccagcctgggcccccacaagagactgcccgccggcctgccccagtgcccccacctgtacctggccgccgaccccctggacccccagagaagacaggagaagagctgcgccgccctgggcaacgacaagagaagacagcccgacggccagagacagccccagcagcagcagcagccccactgcagaagaggcttccaggcccccgccctgcccaaccccctgagagtgctgcagggcctgggcagagtgagcatgagcctgggctggctggagagaccccccgccctgagcagagccgccggctgcagaggcgcccaggtggaggagtag

SEQ ID NO: 104309 - DNA, 657 bp, Artificial Sequence
  Description of Artificial Sequence: Synthetic coding sequence
tgactgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagttcgagaagcacttcgagaagaccctgctgggcaagtag

SEQ ID NO: 104310 - DNA, 777 bp, Artificial Sequence
  Description of Artificial Sequence: Synthetic coding sequence
atgagcctgggctggctggagagaccccccgccctgagcagagccgccggctgcagaggcgcccaggtggaggagatctggagcctggagcccgagaacttcgagaagctgaagcccgtgcacggcctgatcttcctgttcaagtggcagcccggcgaggagcccgccggcagcgtggtgcaggacagcagactggacaccatcttcttcgccaagcaggtgatcaacaacgcctgcgccacccaggccatcgtgagcgtgctgctgaactgcacccaccaggacgtgcacctgggcgagaccctgagcgagttcaaggagttcagccagagcttcgacgccgccatgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagtag

SEQ ID NO: 104311 - DNA, 552 bp, Artificial Sequence
  Description of Artificial Sequence: Synthetic coding sequence
tgacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagttcgagaagcacttcgagaagaccctgctgggcaagtag

SEQ ID NO: 104312 - DNA, 348 bp, Artificial Sequence
  Description of Artificial Sequence: Synthetic coding sequence
tgagagggcgagatcagattcaacctgatggccatcgtgagcgacagaaagatgatctacgagcagaagatcgccgagctgcagagacagctggccgaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagttcgagaagcacttcgagaagaccctgctgggcaagtag

SEQ ID NO: 104313 - DNA, 582 bp, Artificial Sequence
  Description of Artificial Sequence: Synthetic coding sequence
atgaagggcctggccctgagcaacagcgacgtgatcagacaggtgcacaacagcttcgccagacagcagatgttcgagttcgacaccaagaccagcgccaaggaggaggacgccttccacttcgtgagctacgtgcccgtgaacggcagactgtacgagctggacggcctgagagagggccccatcgacctgggcgcctgcaaccaggacgactggatcagcgccgtgagacccgtgatcgagaagagaatccagaagtacagcgagggcgagatcagattcaacctgatggccatcgtgagcgacagaaagatgatctacgagcagaagatcgccgagctgcagagacagctggccgaggaggagcccatggacaccgaccagggcaacagcatgctgagcgccatccagagcgaggtggccaagaaccagatgctgatcgaggaggaggtgcagaagctgaagagatacaagatcgagaacatcagaagaaagcacaactacctgcccttcatcatggagctgctgaagaccctggccgagcaccagcagctgatccccctggtggagaagatcttctag

SEQ ID NO: 104314 - DNA, 498 bp, Artificial Sequence
  Description of Artificial Sequence: Synthetic coding sequence
atggcccccaacgccagctgcctgtgcgtgcacgtgagaagcgaggagtgggacctgatgaccttcgacgccaacccctacgacagcgtgaagaagatcaaggagcacgtgagaagcaagaccaaggtgcccgtgcaggaccaggtgctgctgctgggcagcaagatcctgaagcccagaagaagcctgagcagctacggcatcgacaaggagaagaccatccacctgaccctgaaggtggtgaagcccagcgacgaggagctgcccctgttcctggtggagagcggcgacgaggccaagagacacctgctgcaggtgagaagaagcagcagcgtggcccaggtgaaggccatgatcgagaccaagaccggcatcatccccgagacccagatcgtgacctgcaacggcaagagactggaggacggcaagatgatggccgactacggcatcagaaagggcaacctgctgttcctggcctgctactgcatcggcggctag

SEQ ID NO: 104315 - DNA, 498 bp, Artificial Sequence
  Description of Artificial Sequence: Synthetic coding sequence
atggcccccaacgccagctgcctgtgcgtgcacgtgagaagcgaggagtgggacctgatgaccttcgacgccaacccctacgacagcgtgaagaagatcaaggagcacgtgagaagcaagaccaaggtgcccgtgcaggaccaggtgctgctgctgggcagcaagatcctgaagcccagaagaagcctgagcagctacggcatcgacaaggagaagaccatccacctgaccctgaaggtggtgaagcccagcgacgaggagctgcccctgttcctggtggagagcggcgacgaggccaagagacacctgctgcaggtgagaagaagcagcagcgtggcccaggtgaaggccatgatcgagaccaagaccggcatcatccccgagacccagatcgtgacctgcaacggcaagagactggaggacggcaagatgatggccgactacggcatcagaaagggcaacctgctgttcctggccagctactgcatcggcggctag

SEQ ID NO: 104316 - DNA, 498 bp, Artificial Sequence
  Description of Artificial Sequence: Synthetic coding sequence
atggcccccaacgccagctgcctgtgcgtgcacgtgagaagcgaggagtgggacctgatgaccttcgacgccaacccctacgacagcgtgaagaagatcaaggagcacgtgagaagcaagaccaaggtgcccgtgcaggaccaggtgctgctgctgggcagcaagatcctgaagcccagaagaagcctgagcagctacggcaccgacaaggagaagaccatccacctgaccctgaaggtggtgaagcccagcgacgaggagctgcccctgttcctggtggagagcggcgacgaggccaagagacacctgctgcaggtgagaagaagcagcagcgtggcccaggtgaaggccatgatcgagaccaagaccggcatcatccccgagacccagatcgtgacctgcaacggcaagagactggaggacggcaagatgatggccgactacggcatcagaaagggcaacctgctgttcctggccagctactgcatcggcggctag

SEQ ID NO: 104317 - DNA, 498 bp, Artificial Sequence; identical to SEQ ID NO: 104316
  Description of Artificial Sequence: Synthetic coding sequence

SEQ ID NO: 104318 - DNA, 498 bp, Artificial Sequence; identical to SEQ ID NO: 104314
  Description of Artificial Sequence: Synthetic coding sequence

SEQ ID NO: 104319 - DNA, 498 bp, Artificial Sequence; identical to SEQ ID NO: 104316
  Description of Artificial Sequence: Synthetic coding sequence

SEQ ID NO: 104320 - DNA, 498 bp, Artificial Sequence; identical to SEQ ID NO: 104315
  Description of Artificial Sequence: Synthetic coding sequence

SEQ ID NO: 104321 - DNA, 705 bp, Artificial Sequence
  Description of Artificial Sequence: Synthetic coding sequence
atgggcggctgcgtgggcgcccagcacgacagcagcggcagcctgaacgagaacagcgagggcaccggcgtggccctgggcagaaaccagcccctgaagaaggagaagcccaagtggaagagcgactaccccatgaccgacggccagctgagaagcaagagagacgagttctgggacaccgcccccgccttcgagggcagaaaggagatctgggacgccctgaaggccgccgcccacgccttcgagagcaacgaccacgagctggcccaggccatcatcgacggcgccaacatcaccctgccccacggcgccctgaccgagtgctacgacgagctgggcaacagataccagctgcccgtgtactgcctggccccccccatcaacatgatcgaggagaagagcgacatcgagaccctggacatccccgagcccccccccaacagcggctacgagtgccagctgagactgagactgagcaccggcaaggacctgaagctggtggtgagaagcaccgacaccgtgttccacatgaagagaagactgcacgccgccgagggcgtggagcccggcagccagagatggttcttcagcggcagacccctgaccgacaagatgaagttcgaggagctgaagatccccaaggactacgtggtgcaggtgatcgtgagccagcccgtgcagaaccccacccccgtggagaactag

SEQ ID NO: 104322 - DNA, 924 bp, Artificial Sequence
  Description of Artificial Sequence: Synthetic coding sequence
atgttcagcttcaacatgttcgaccaccccatccccagagtgttccagaacagattcagcacccagtacagatgcttcagcgtgagcatgctggccggccccaacgacagaagcgacgtggagaagggcggcaagatcatcatgccccccagcgccctggaccagctgagcagactgaacatcacctaccccatgctgttcaagctgaccaacaagaacagcgacagaatgacccactgcggcgtgctggagttcgtggccgacgagggcatctgctacctgccccactggatgatgcagaacctgctgctggaggagggcggcctggtgcaggtggagagcgtgaacctgcaggtggccacctacagcaagttccagccccagagccccgacttcctggacatcaccaaccccaaggccgtgctggagaacgccctgagaaacttcgcctgcctgaccaccggcgacgtgatcgccatcaactacaacgagaagatctacgagctgagagtgatggagaccaagcccgacaaggccgtgagcatcatcgagtgcgacatgaacgtggacttcgacgcccccctgggctacaaggagcccgagagacaggtgcagcacgaggagagcaccgagggcgaggccgaccacagcggctacgccggcgagctgggcttcagagccttcagcggcagcggcaacagactggacggcaagaagaagggcgtggagcccagccccagccccatcaagcccggcgacatcaagagaggcatccccaactacgagttcaagctgggcaagatcaccttcatcagaaacagcagacccctggtgaagaaggtggaggaggacgaggccggcggcagattcgtggccttcagcggcgagggccagagcctgagaaagaagggcagaaagccctag

SEQ ID NO: 104323 - DNA, 891 bp, Artificial Sequence
  Description of Artificial Sequence: Synthetic coding sequence
atgttcagcttcaacatgttcgaccaccccatccccagagtgttccagaacagattcagcacccagtacagatgcttcagcgtgagcatgctggccggccccaacgacagaagcgacgtggagaagggcggcaagagcagactgaacatcacctaccccatgctgttcaagctgaccaacaagaacagcgacagaatgacccactgcggcgtgctggagttcgtggccgacgagggcatctgctacctgccccactggatgatgcagaacctgctgctggaggagggcggcctggtgcaggtggagagcgtgaacctgcaggtggccacctacagcaagttccagccccagagccccgacttcctggacatcaccaaccccaaggccgtgctggagaacgccctgagaaacttcgcctgcctgaccaccggcgacgtgatcgccatcaactacaacgagaagatctacgagctgagagtgatggagaccaagcccgacaaggccgtgagcatcatcgagtgcgacatgaacgtggacttcgacgcccccctgggctacaaggagcccgagagacaggtgcagcacgaggagagcaccgagggcgaggccgaccacagcggctacgccggcgagctgggcttcagagccttcagcggcagcggcaacagactggacggcaagaagaagggcgtggagcccagccccagccccatcaagcccggcgacatcaagagaggcatccccaactacgagttcaagctgggcaagatcaccttcatcagaaacagcagacccctggtgaagaaggtggaggaggacgaggccggcggcagattcgtggccttcagcggcgagggccagagcctgagaaagaagggcagaaagccctag

SEQ ID NO: 104324 - DNA, 1032 bp, Artificial Sequence
  Description of Artificial Sequence: Synthetic coding sequence
atgttcagcttcaacatgttcgaccaccccatccccagagtgttccagaacagattcagcacccagtacagatgcttcagcgtgagcatgctggccggccccaacgacagaagcgacgtggagaagggcggcaagatcatcatgccccccagcgccctggaccagctgagcagactgaacatcacctaccccatgctgttcaagctgaccaacaagaacagcgacagaatgacccactgcggcgtgctggagttcgtggccgacgagggcatctgctacctgccccactgggtggtgtacagactgagcctggagagagacggcctgaagagcctggaggtggccgaggtgagcggcagcgactacttccccagccccttctgcggcctggaggtgtggatgatgcagaacctgctgctggaggagggcggcctggtgcaggtggagagcgtgaacctgcaggtggccacctacagcaagttccagccccagagccccgacttcctggacatcaccaaccccaaggccgtgctggagaacgccctgagaaacttcgcctgcctgaccaccggcgacgtgatcgccatcaactacaacgagaagatctacgagctgagagtgatggagaccaagcccgacaaggccgtgagcatcatcgagtgcgacatgaacgtggacttcgacgcccccctgggctacaaggagcccgagagacaggtgcagcacgaggagagcaccgagggcgaggccgaccacagcggctacgccggcgagctgggcttcagagccttcagcggcagcggcaacagactggacggcaagaagaagggcgtggagcccagccccagccccatcaagcccggcgacatcaagagaggcatccccaactacgagttcaagctgggcaagatcaccttcatcagaaacagcagacccctggtgaagaaggtggaggaggacgaggccggcggcagattcgtggccttcagcggcgagggccagagcctgagaaagaagggcagaaagccctag

SEQ ID NO: 104325 - DNA, 801 bp, Artificial Sequence
  Description of Artificial Sequence: Synthetic coding sequence
atgttcagcttcaacatgttcgaccaccccatccccagagtgttccagaacagattcagcacccagtacagatgcttcagcgtgagcatgctggccggccccaacgacagaagcgacgtggagaagggcggcaagatcatcatgccccccagcgccctggaccagctgagcagactgaacatcacctaccccatgctgttcaagctgaccaacaagaacagcgacagaatgacccactgcggcgtgctggagttcgtggccgacgagggcatctgctacctgccccactggatgatgcagaacctgctgctggaggagggcggcctggtgcaggtggagagcgtgaacctgcaggtggccacctacagcaagttccagccccagagccccgacttcctggacatcaccaaccccaaggccgtgctggagaacgccctgagaaacttcgcctgcctgaccaccggcgacgtgatcgccatcaactacaacgagaagatctacgagctgagagtgatggagaccaagcccgacaaggccgtgagcatcatcgagtgcgacatgaacgtggacttcgacgcccccctgggctacaaggagcccgagagacaggtgcagcacgaggagagcaccgagggcgaggccgaccacagcggctacgccggcgagctgggcttcagagccttcagcggcagcggcaacagactggacggcaagaagaagggcgtggagcccagccccagccccatcaagcccggcgacatcaagagaggcatccccaactacgagttcaagctgggctag

SEQ ID NO: 104326 - DNA, 1053 bp, Artificial Sequence
  Description of Artificial Sequence: Synthetic coding sequence
atgctgcccctgcccgacctggacctgtggcccctggacagactgcccagccccatcaagagaaagccccagaccctgggcagcctgaagagcagccagggcatcgtggaggagaccagcgaggagggcaacagcgtgcccgccagccagagcgtggccgccctgaccagcaagagaagcctggtgctgatgcccgagagcagcgccgaggagatcaccgtgtgccccgagacccagctgagcagcagcgagaccttcgacctggagagagaggtgagccccggcagcagagacatcctggacggcgtgagaatcatcatggccgacaaggaggtgggcaacaaggaggacgccgagaaggaggtggccatcagcaccttcagcagcagcaaccaggtgagctgccccctgtgcgaccagtgcttcccccccaccaagatcgagagacacgccatgtactgcaacggcctgatggaggaggacaccgaggtgctgaccagaagacagaaggaggccaagaccaagagcgacagcggcaccgccgcccagaccagcctggacatcgacaagaacgagaagtgctacctgtgcaagagcctggtgcccttcagagagtaccagtgccacgtggacagctgcctgcagctggccaaggccgaccagggcgacggccccgagggcagcggcagagcctgcagcaccgtggagggcaagtggcagcagagactgaagaaccccaaggagaagggccacagcgagggcagactgctgagcttcctggagcagagcgagcacaagaccagcgacgccgacatcaagagcagcgagaccggcgccttcagagtgcccagccccggcatggaggaggccggctgcagcagagagatgcagagcagcttcaccagaagagacctgaacgagagccccgtgaagagcttcgtgagcatcagcgaggccaccgactgcctggtggacttcaagaagcaggtgaccgtgcagcccggcagcagaaccagaaccaaggccggcagaggcagaagaagaaagttctag

SEQ ID NO: 104327 - DNA, 2163 bp, Artificial Sequence
  Description of Artificial Sequence: Synthetic coding sequence
atgcccagaagaaagaagaaggtgaaggaggtgagcgagagcagaaacctggagaagaaggacgtggagaccaccagcagcgtgagcgtgaagagaaagagaagactggaggacgccttcatcgtgatcagcgacagcgacggcgaggagcccaaggaggagaacggcctgcagaagaccaagaccaagcagagcaacagagccaagtgcctggccaagagaaagatcgcccagatgaccgaggaggagcagttcgccctggccctgaagatgagcgagcaggaggccagagaggtgaacagccaggaggaggaggaggaggagctgctgagaaaggccatcgccgagagcctgaacagctgcagacccagcgacgccagcgccaccagaagcagacccctggccaccggccccagcagccagagccaccaggagaagaccaccgacagcggcctgaccgagggcatctggcagctggtgccccccagcctgttcaagggcagccacatcagccagggcaacgaggccgaggagagagaggagccctgggaccacaccgagaagaccgaggaggagcccgtgagcggcagcagcggcagctgggaccagagcagccagcccgtgttcgagaacgtgaacgtgaagagcttcgacagatgcaccggccacagcgccgagcacacccagtgcggcaagccccaggagagcaccggcagaggcagcgccttcctgaaggccgtgcagggcagcggcgacaccagcagacactgcctgcccaccctggccgacgccaagggcctgcaggacaccggcggcaccgtgaactacttctggggcatccccttctgccccgacggcgtggaccccaaccagtacaccaaggtgatcctgtgccagctggaggtgtaccagaagagcctgaagatggcccagagacagctgctgaacaagaagggcttcggcgagcccgtgctgcccagaccccccagcctgatccagaacgagtgcggccagggcgagcaggccagcgagaagaacgagtgcatcagcgaggacatgggcgacgaggacaaggaggagagacaggagagcagagccagcgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcccgccagccagagcgtggccgccctgaccagcaagagaagcctggtgctgatgcccgagagcagcgccgaggagatcaccgtgtgccccgagacccagctgagcagcagcgagaccttcgacctggagagagaggtgagccccggcagcagagacatcctggacggcgtgagaatcatcatggccgacaaggaggtgggcaacaaggaggacgccgagaaggaggtggccatcagcaccttcagcagcagcaaccaggtgagctgccccctgtgcgaccagtgcttcccccccaccaagatcgagagacacgccatgtactgcaacggcctgatggaggaggacaccgaggtgctgaccagaagacagaaggaggccaagaccaagagcgacagcggcaccgccgcccagaccagcctggacatcgacaagaacgagaagtgctacctgtgcaagagcctggtgcccttcagagagtaccagtgccacgtggacagctgcctgcagctggccaaggccgaccagggcgacggccccgagggcagcggcagagcctgcagcaccgtggagggcaagtggcagcagagactgaagaaccccaaggagaagggccacagcgagggcagactgctgagcttcctggagcagagcgagcacaagaccagcgacgccgacatcaagagcagcgagaccggcgccttcagagtgcccagccccggcatggaggaggccggctgcagcagagagatgcagagcagcttcaccagaagagacctgaacgagagccccgtgaagagcttcgtgagcatcagcgaggccaccgactgcctggtggacttcaagaagcaggtgaccgtgcagcccggcagcagaaccagaaccaaggccggcagaggcagaagaagaaagttctag

SEQ ID NO: 104328 - DNA, 1929 bp, Artificial Sequence
  Description of Artificial Sequence: Synthetic coding sequence
atgaccgaggaggagcagttcgccctggccctgaagatgagcgagcaggaggccagagaggtgaacagccaggaggaggaggaggaggagctgctgagaaaggccatcgccgagagcctgaacagctgcagacccagcgacgccagcgccaccagaagcagacccctggccaccggccccagcagccagagccaccaggagaagaccaccgacagcggcctgaccgagggcatctggcagctggtgccccccagcctgttcaagggcagccacatcagccagggcaacgaggccgaggagagagaggagccctgggaccacaccgagaagaccgaggaggagcccgtgagcggcagcagcggcagctgggaccagagcagccagcccgtgttcgagaacgtgaacgtgaagagcttcgacagatgcaccggccacagcgccgagcacacccagtgcggcaagccccaggagagcaccggcagaggcagcgccttcctgaaggccgtgcagggcagcggcgacaccagcagacactgcctgcccaccctggccgacgccaagggcctgcaggacaccggcggcaccgtgaactacttctggggcatccccttctgccccgacggcgtggaccccaaccagtacaccaaggtgatcctgtgccagctggaggtgtaccagaagagcctgaagatggcccagagacagctgctgaacaagaagggcttcggcgagcccgtgctgcccagaccccccagcctgatccagaacgagtgcggccagggcgagcaggccagcgagaagaacgagtgcatcagcgaggacatgggcgacgaggacaaggaggagagacaggagagcagagccagcgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcccgccagccagagcgtggccgccctgaccagcaagagaagcctggtgctgatgcccgagagcagcgccgaggagatcaccgtgtgccccgagacccagctgagcagcagcgagaccttcgacctggagagagaggtgagccccggcagcagagacatcctggacggcgtgagaatcatcatggccgacaaggaggtgggcaacaaggaggacgccgagaaggaggtggccatcagcaccttcagcagcagcaaccaggtgagctgccccctgtgcgaccagtgcttcccccccaccaagatcgagagacacgccatgtactgcaacggcctgatggaggaggacaccgaggtgctgaccagaagacagaaggaggccaagaccaagagcgacagcggcaccgccgcccagaccagcctggacatcgacaagaacgagaagtgctacctgtgcaagagcctggtgcccttcagagagtaccagtgccacgtggacagctgcctgcagctggccaaggccgaccagggcgacggccccgagggcagcggcagagcctgcagcaccgtggagggcaagtggcagcagagactgaagaaccccaaggagaagggccacagcgagggcagactgctgagcttcctggagcagagcgagcacaagaccagcgacgccgacatcaagagcagcgagaccggcgccttcagagtgcccagccccggcatggaggaggccggctgcagcagagagatgcagagcagcttcaccagaagagacctgaacgagagccccgtgaagagcttcgtgagcatcagcgaggccaccgactgcctggtggacttcaagaagcaggtgaccgtgcagcccggcagcagaaccagaaccaaggccggcagaggcagaagaagaaagttctag

SEQ ID NO: 104329 - DNA, 2160 bp, Artificial Sequence
  Description of Artificial Sequence: Synthetic coding sequence
atgcccagaagaaagaagaaggtgaaggaggtgagcgagagcagaaacctggagaagaaggacgtggagaccaccagcagcgtgagcgtgaagagaaagagaagactggaggacgccttcatcgtgatcagcgacagcgacggcgaggagcccaaggaggagaacggcctgcagaagaccaagaccaagcagagcaacagagccaagtgcctggccaagagaaagatcgcccagatgaccgaggaggagcagttcgccctggccctgaagatgagcgagcaggaggccagagaggtgaacagccaggaggaggaggaggaggagctgctgagaaaggccatcgccgagagcctgaacagctgcagacccagcgacgccagcgccaccagaagcagacccctggccaccggccccagcagccagagccaccaggagaagaccaccgacagcggcctgaccgagggcatctggcagctggtgccccccagcctgttcaagggcagccacatcagccagggcaacgaggccgaggagagagaggagccctgggaccacaccgagaagaccgaggaggagcccgtgagcggcagcagcggcagctgggaccagagcagccagcccgtgttcgagaacgtgaacgtgaagagcttcgacagatgcaccggccacagcgccgagcacacccagtgcggcaagccccaggagagcaccggcagaggcagcgccttcctgaaggccgtgcagggcagcggcgacaccagcagacactgcctgcccaccctggccgacgccaagggcctgcaggacaccggcggcaccgtgaactacttctggggcatccccttctgccccgacggcgtggaccccaaccagtacaccaaggtgatcctgtgccagctggaggtgtaccagaagagcctgaagatggcccagagacagctgctgaacaagaagggcttcggcgagcccgtgctgcccagaccccccagcctgatccagaacgagtgcggccagggcgagcaggccagcgagaagaacgagtgcatcagcgaggacatgggcgacgaggacaaggaggagagacaggagagcagagccagcgactggcacagcaagaccaaggacttccaggagagcagcatcaagagcctgaaggagaagctgctgctggaggaggagcccaccaccagccacggccagagcagccagggcatcgtggaggagaccagcgaggagggcaacagcgtgcccgccagccagagcgtggccgccctgaccagcaagagaagcctggtgctgatgcccgagagcagcgccgaggagatcaccgtgtgccccgagacccagctgagcagcagcgagaccttcgacctggagagagaggtgagccccggcagcagagacatcctggacggcgtgagaatcatcatggccgacaaggaggtgggcaacaaggaggacgccgagaaggaggtggccatcagcaccttcagcagcagcaaccaggtgagctgccccctgtgcgaccagtgcttcccccccaccaagatcgagagacacgccatgtactgcaacggcctgatggaggaggacaccgtgctgaccagaagacagaaggaggccaagaccaagagcgacagcggcaccgccgcccagaccagcctggacatcgacaagaacgagaagtgctacctgtgcaagagcctggtgcccttcagagagtaccagtgccacgtggacagctgcctgcagctggccaaggccgaccagggcgacggccccgagggcagcggcagagcctgcagcaccgtggagggcaagtggcagcagagactgaagaaccccaaggagaagggccacagcgagggcagactgctgagcttcctggagcagagcgagcacaagaccagcgacgccgacatcaagagcagcgagaccggcgccttcagagtgcccagccccggcatggaggaggccggctgcagcagagagatgcagagcagcttcaccagaagagacctgaacgagagccccgtgaagagcttcgtgagcatcagcgaggccaccgactgcctggtggacttcaagaagcaggtgaccgtgcagcccggcagcagaaccagaaccaaggccggcagaggcagaagaagaaagttctag

SEQ ID NO: 104330 - DNA, 96 bp, Artificial Sequence
  Description of Artificial Sequence: Synthetic coding sequence
atgcccagaagaaagaagaaggtgaaggaggtgagcgagagcagaaacctggagaagaaggacgtggagaccaccagcagcgtgagcgtgaagtag

SEQ ID NO: 104331 - DNA, 270 bp, Artificial Sequence
  Description of Artificial Sequence: Synthetic coding sequence
atgcccagaagaaagaagaaggtgaaggaggtgagcgagagcagaaacctggagaagaaggacgtggagaccaccagcagcgtgagcgtgaagagaaagagaagactggaggacgccttcatcgtgatcagcgacagcgacggcgaggagcccaaggaggagaacggcctgcagaagaccaagaccaagcagagcaacagagccaagtgcctggccaagagaaagatcgcccagatgaccgaggaggagcagttcgccctggccctgtag

SEQ ID NO: 104332 - DNA, 474 bp, Artificial Sequence
  Description of Artificial Sequence: Synthetic coding sequence
atgcccagaagaaagaagaaggtgaaggaggtgagcgagagcagaaacctggagaagaaggacgtggagaccaccagcagcgtgagcgtgaagagaaagagaagactggaggacgccttcatcgtgatcagcgacagcgacggcgaggagcccaaggaggagaacggcctgcagaagaccaagaccaagcagagcaacagagccaagtgcctggccaagagaaagatcgcccagatgaccgaggaggagcagttcgccctggccctgaagatgagcgagcaggaggccagagaggtgaacagccaggaggaggaggaggaggagctgctgagaaaggccatcgccgagagcctgaacagctgcagacccagcgacgccagcgccaccagaagcagacccctggccaccggccccagcagccagagccaccaggagaagaccaccgacagcggcctgaccgagggcatctggtag

SEQ ID NO: 104333 - DNA, 2160 bp, Artificial Sequence; identical to SEQ ID NO: 104329
  Description of Artificial Sequence: Synthetic coding sequence

SEQ ID NO: 104334 - DNA, 5250 bp, Artificial Sequence
  Description of Artificial Sequence: Synthetic coding sequence
atggccgacgaggaggccggcggcaccgagagaatggagatcagcgccgagctgccccagaccccccagagactggccagctggtgggaccagcaggtggacttctacaccgccttcctgcaccacctggcccagctggtgcccgagatctacttcgccgagatggaccccgacctggagaagcaggaggagagcgtgcagatgagcatcttcacccccctggagtggtacctgttcggcgaggaccccgacatctgcctggagaagctgaagcacagcggcgccttccagctgtgcggcagagtgttcaagagcggcgagaccacctacagctgcagagactgcgccatcgaccccacctgcgtgctgtgcatggactgcttccaggacagcgtgcacaagaaccacagatacaagatgcacaccagcaccggcggcggcttctgcgactgcggcgacaccgaggcctggaagaccggccccttctgcgtgaaccacgagcccggcagagccggcaccatcaaggagaacagcagatgccccctgaacgaggaggtgatcgtgcaggccagaaagatcttccccagcgtgatcaagtacgtggtggagatgaccatctgggaggaggagaaggagctgccccccgagctgcagatcagagagaagaacgagagatactactgcgtgctgttcaacgacgagcaccacagctacgaccacgtgatctacagcctgcagagagccctggactgcgagctggccgaggcccagctgcacaccaccgccatcgacaaggagggcagaagagccgtgaaggccggcgcctacgccgcctgccaggaggccaaggaggacatcaagagccacagcgagaacgtgagccagcaccccctgcacgtggaggtgctgcacagcgagatcatggcccaccagaagttcgccctgagactgggcagctggatgaacaagatcatgagctacagcagcgacttcagacagatcttctgccaggcctgcctgagagaggagcccgacagcgagaacccctgcctgatcagcagactgatgctgtgggacgccaagctgtacaagggcgccagaaagatcctgcacgagctgatcttcagcagcttcttcatggagatggagtacaagaagctgttcgccatggagttcgtgaagtactacaagcagctgcagaaggagtacatcagcgacgaccacgacagaagcatcagcatcaccgccctgagcgtgcagatgttcaccgtgcccaccctggccagacacctgatcgaggagcagaacgtgatcagcgtgatcaccgagaccctgctggaggtgctgcccgagtacctggacagaaacaacaagttcaacttccagggctacagccaggacaagctgggcagagtgtacgccgtgatctgcgacctgaagtacatcctgatcagcaagcccaccatctggaccgagagactgagaatgcagttcctggagggcttcagaagcttcctgaagatcctgacctgcatgcagggcatggaggagatcagaagacaggtgggccagcacatcgaggtggaccccgactgggaggccgccatcgccatccagatgcagctgaagaacatcctgctgatgttccaggagtggtgcgcctgcgacgaggagctgctgctggtggcctacaaggagtgccacaaggccgtgatgagatgcagcaccagcttcatcagcagcagcaagaccgtggtgcagagctgcggccacagcctggagaccaagagctacagagtgagcgaggacctggtgagcatccacctgcccctgagcagaaccctggccggcctgcacgtgagactgagcagactgggcgccgtgagcagactgcacgagttcgtgagcttcgaggacttccaggtggaggtgctggtggagtaccccctgagatgcctggtgctggtggcccaggtggtggccgagatgtggagaagaaacggcctgagcctgatcagccaggtgttctactaccaggacgtgaagtgcagagaggagatgtacgacaaggacatcatcatgctgcagatcggcgccagcctgatggaccccaacaagttcctgctgctggtgctgcagagatacgagctggccgaggccttcaacaagaccatcagcaccaaggaccaggacctgatcaagcagtacaacaccctgatcgaggagatgctgcaggtgctgatctacatcgtgggcgagagatacgtgcccggcgtgggcaacgtgaccaaggaggaggtgaccatgagagagatcatccacctgctgtgcatcgagcccatgccccacagcgccatcgccaagaacctgcccgagaacgagaacaacgagaccggcctggagaacgtgatcaacaaggtggccaccttcaagaagcccggcgtgagcggccacggcgtgtacgagctgaaggacgagagcctgaaggacttcaacatgtacttctaccactacagcaagacccagcacagcaaggccgagcacatgcagaagaagagaagaaagcaggagaacaaggacgaggccctgccccccccccccccccccgagttctgccccgccttcagcaaggtgatcaacctgctgaactgcgacatcatgatgtacatcctgagaaccgtgttcgagagagccatcgacaccgacagcaacctgtggaccgagggcatgctgcagatggccttccacatcctggccctgggcctgctggaggagaagcagcagctgcagaaggcccccgaggaggaggtgaccttcgacttctaccacaaggccagcagactgggcagcagcgccatgaacatccagatgctgctggagaagctgaagggcatcccccagctggagggccagaaggacatgatcacctggatcctgcagatgttcgacaccgtgaagagactgagagagaagagctgcctgatcgtggccaccaccagcggcagcgagagcatcaagaacgacgagatcacccacgacaaggagaaggccgagagaaagagaaaggccgaggccgccagactgcacagacagaagatcatggcccagatgagcgccctgcagaagaacttcatcgagacccacaagctgatgtacgacaacaccagcgagatgcccggcaaggaggacagcatcatggaggaggagagcacccccgccgtgagcgactacagcagaatcgccctgggccccaagagaggccccagcgtgaccgagaaggaggtgctgacctgcatcctgtgccaggaggagcaggaggtgaagatcgagaacaacgccatggtgctgagcgcctgcgtgcagaagagcaccgccctgacccagcacagaggcaagcccatcgagctgagcggcgaggccctggaccccctgttcatggaccccgacctggcctacggcacctacaccggcagctgcggccacgtgatgcacgccgtgtgctggcagaagtacttcgaggccgtgcagctgagcagccagcagagaatccacgtggacctgttcgacctggagagcggcgagtacctgtgccccctgtgcaagagcctgtgcaacaccgtgatccccatcatccccctgcagccccagaagatcaacagcgagaacgccgacgccctggcccagctgctgaccctggccagatggatccagaccgtgctggccagaatcagcggctacaacatcagacacgccaagggcgagaaccccatccccatcttcttcaaccagggcatgggcgacagcaccctggagttccacagcatcctgagcttcggcgtggagagcagcatcaagtacagcaacagcatcaaggagatggtgatcctgttcgccaccaccatctacagaatcggcctgaaggtgccccccgacgagagagaccccagagtgcccatgctgacctggagcacctgcgccttcaccatccaggccatcgagaacctgctgggcgacgagggcaagcccctgttcggcgccctgcagaacagacagcacaacggcctgaaggccctgatgcagttcgccgtggcccagagaatcacctgcccccaggtgctgatccagaagcacctggtgagactgctgagcgtggtgctgcccaacatcaagagcgaggacaccccctgcctgctgagcatcgacctgttccacgtgctggtgggcgccgtgctggccttccccagcctgtactgggacgaccccgtggacctgcagcccagcagcgtgagcagcagctacaaccacctgtacctgttccacctgatcaccatggcccacatgctgcagatcctgctgaccgtggacaccggcctgcccctggcccaggtgcaggaggacagcgaggaggcccacagcgccagcagcttcttcgccgagatcagccagtacaccagcggcagcatcggctgcgacatccccggctggtacctgtgggtgagcctgaagaacggcatcaccccctacctgagatgcgccgccctgttcttccactacctgctgggcgtgaccccccccgaggagctgcacaccaacagcgccgagggcgagtacagcgccctgtgcagctacctgagcctgcccaccaacctgttcctgctgttccaggagtactgggacaccgtgagacccctgctgcagagatggtgcgccgaccccgccctgctgaactgcctgaagcagaagaacaccgtggtgagataccccagaaagagaaacagcctgatcgagctgcccgacgactacagctgcctgctgaaccaggccagccacttcagatgccccagaagcgccgacgacgagagaaagcaccccgtgctgtgcctgttctgcggcgccatcctgtgcagccagaacatctgctgccaggagatcgtgaacggcgaggaggtgggcgcctgcatcttccacgccctgcactgcggcgccggcgtgtgcatcttcctgaagatcagagagtgcagagtggtgctggtggagggcaaggccagaggctgcgcctaccccgccccctacctggacgagtacggcgagaccgaccccggcctgaagagaggcaaccccctgcacctgagcagagagagatacagaaagctgcacctggtgtggcagcagcactgcatcatcgaggagatcgccagaagccaggagaccaaccagatgctgttcggcttcaactggcagctgctgtag

SEQ ID NO: 104335 - DNA, 2412 bp, Artificial Sequence
  Description of Artificial Sequence: Synthetic coding sequence
atggccgacgaggaggccggcggcaccgagagaatggagatcagcgccgagctgccccagaccccccagagactggccagctggtgggaccagcaggtggacttctacaccgccttcctgcaccacctggcccagctggtgcccgagatctacttcgccgagatggaccccgacctggagaagcaggaggagagcgtgcagatgagcatcttcacccccctggagtggtacctgttcggcgaggaccccgacatctgcctggagaagctgaagcacagcggcgccttccagctgtgcggcagagtgttcaagagcggcgagaccacctacagctgcagagactgcgccatcgaccccacctgcgtgctgtgcatggactgcttccaggacagcgtgcacaagaaccacagatacaagatgcacaccagcaccggcggcggcttctgcgactgcggcgacaccgaggcctggaagaccggccccttctgcgtgaaccacgagcccggcagagccggcaccatcaaggagaacagcagatgccccctgaacgaggaggtgatcgtgcaggccagaaagatcttccccagcgtgatcaagtacgtggtggagatgaccatctgggaggaggagaaggagctgccccccgagctgcagatcagagagaagaacgagagatactactgcgtgctgttcaacgacgagcaccacagctacgaccacgtgatctacagcctgcagagagccctggactgcgagctggccgaggcccagctgcacaccaccgccatcgacaaggagggcagaagagccgtgaaggccggcgcctacgccgcctgccaggaggccaaggaggacatcaagagccacagcgagaacgtgagccagcaccccctgcacgtggaggtgctgcacagcgagatcatggcccaccagaagttcgccctgagactgggcagctggatgaacaagatcatgagctacagcagcgacttcagacagatcttctgccaggcctgcctgagagaggagcccgacagcgagaacccctgcctgatcagcagactgatgctgtgggacgccaagctgtacaagggcgccagaaagatcctgcacgagctgatcttcagcagcttcttcatggagatggagtacaagaagctgttcgccatggagttcgtgaagtactacaagcagctgcagaaggagtacatcagcgacgaccacgacagaagcatcagcatcaccgccctgagcgtgcagatgttcaccgtgcccaccctggccagacacctgatcgaggagcagaacgtgatcagcgtgatcaccgagaccctgctggaggtgctgcccgagtacctggacagaaacaacaagttcaacttccagggctacagccaggacaagctgggcagagtgtacgccgtgatctgcgacctgaagtacatcctgatcagcaagcccaccatctggaccgagagactgagaatgcagttcctggagggcttcagaagcttcctgaagatcctgacctgcatgcagggcatggaggagatcagaagacaggtgggccagcacatcgaggtggaccccgactgggaggccgccatcgccatccagatgcagctgaagaacatcctgctgatgttccaggagtggtgcgcctgcgacgaggagctgctgctggtggcctacaaggagtgccacaaggccgtgatgagatgcagcaccagcttcatcagcagcagcaagaccgtggtgcagagctgcggccacagcctggagaccaagagctacagagtgagcgaggacctggtgagcatccacctgcccctgagcagaaccctggccggcctgcacgtgagactgagcagactgggcgccgtgagcagactgcacgagttcgtgagcttcgaggacttccaggtggaggtgctggtggagtaccccctgagatgcctggtgctggtggcccaggtggtggccgagatgtggagaagaaacggcctgagcctgatcagccaggtgttctactaccaggacgtgaagtgcagagaggagatgtacgacaaggacatcatcatgctgcagatcggcgccagcctgatggaccccaacaagttcctgctgctggtgctgcagagatacgagctggccgaggccttcaacaagaccatcagcaccaaggaccaggacctgatcaagcagtacaacaccctgatcgaggagatgctgcaggtgctgatctacatcgtgggcgagagatacgtgcccggcgtgggcaacgtgaccaaggaggaggtgaccatgagagagatcatccacctgctgtgcatcgagcccatgccccacagcgccatcgccaagaacctgcccgagaacgagaccagatgcatcagaccctggagcctgtag

SEQ ID NO: 104336 - DNA, 3042 bp, Artificial Sequence
  Description of Artificial Sequence: Synthetic coding sequence
atggccgacgaggaggccggcggcaccgagagaatggagatcagcgccgagctgccccagaccccccagagactggccagctggtgggaccagcaggtggacttctacaccgccttcctgcaccacctggcccagctggtgcccgagatctacttcgccgagatggaccccgacctggagaagcaggaggagagcgtgcagatgagcatcttcacccccctggagtggtacctgttcggcgaggaccccgacatctgcctggagaagctgaagcacagcggcgccttccagctgtgcggcagagtgttcaagagcggcgagaccacctacagctgcagagactgcgccatcgaccccacctgcgtgctgtgcatggactgcttccaggacagcgtgcacaagaaccacagatacaagatgcacaccagcaccggcggcggcttctgcgactgcggcgacaccgaggcctggaagaccggccccttctgcgtgaaccacgagcccggcagagccggcaccatcaaggagaacagcagatgccccctgaacgaggaggtgatcgtgcaggccagaaagatcttccccagcgtgatcaagtacgtggtggagatgaccatctgggaggaggagaaggagctgccccccgagctgcagatcagagagaagaacgagagatactactgcgtgctgttcaacgacgagcaccacagctacgaccacgtgatctacagcctgcagagagccctggactgcgagctggccgaggcccagctgcacaccaccgccatcgacaaggagggcagaagagccgtgaaggccggcgcctacgccgcctgccaggaggccaaggaggacatcaagagccacagcgagaacgtgagccagcaccccctgcacgtggaggtgctgcacagcgagatcatggcccaccagaagttcgccctgagactgggcagctggatgaacaagatcatgagctacagcagcgacttcagacagatcttctgccaggcctgcctgagagaggagcccgacagcgagaacccctgcctgatcagcagactgatgctgtgggacgccaagctgtacaagggcgccagaaagatcctgcacgagctgatcttcagcagcttcttcatggagatggagtacaagaagctgttcgccatggagttcgtgaagtactacaagcagctgcagaaggagtacatcagcgacgaccacgacagaagcatcagcatcaccgccctgagcgtgcagatgttcaccgtgcccaccctggccagacacctgatcgaggagcagaacgtgatcagcgtgatcaccgagaccctgctggaggtgctgcccgagtacctggacagaaacaacaagttcaacttccagggctacagccaggacaagctgggcagagtgtacgccgtgatctgcgacctgaagtacatcctgatcagcaagcccaccatctggaccgagagactgagaatgcagttcctggagggcttcagaagcttcctgaagatcctgacctgcatgcagggcatggaggagatcagaagacaggtgggccagcacatcgaggtggaccccgactgggaggccgccatcgccatccagatgcagctgaagaacatcctgctgatgttccaggagtggtgcgcctgcgacgaggagctgctgctggtggcctacaaggagtgccacaaggccgtgatgagatgcagcaccagcttcatcagcagcagcaagaccgtggtgcagagctgcggccacagcctggagaccaagagctacagagtgagcgaggacctggtgagcatccacctgcccctgagcagaaccctggccggcctgcacgtgagactgagcagactgggcgccgtgagcagactgcacgagttcgtgagcttcgaggacttccaggtggaggtgctggtggagtaccccctgagatgcctggtgctggtggcccaggtggtggccgagatgtggagaagaaacggcctgagcctgatcagccaggtgttctactaccaggacgtgaagtgcagagaggagatgtacgacaaggacatcatcatgctgcagatcggcgccagcctgatggaccccaacaagttcctgctgctggtgctgcagagatacgagctggccgaggccttcaacaagaccatcagcaccaaggaccaggacctgatcaagcagtacaacaccctgatcgaggagatgctgcaggtgctgatctacatcgtgggcgagagatacgtgcccggcgtgggcaacgtgaccaaggaggaggtgaccatgagagagatcatccacctgctgtgcatcgagcccatgccccacagcgccatcgccaagaacctgcccgagaacgagaacaacgagaccggcctggagaacgtgatcaacaaggtggccaccttcaagaagcccggcgtgagcggccacggcgtgtacgagctgaaggacgagagcctgaaggacttcaacatgtacttctaccactacagcaagacccagcacagcaaggccgagcacatgcagaagaagagaagaaagcaggagaacaaggacgaggccctgccccccccccccccccccgagttctgccccgccttcagcaaggtgatcaacctgctgaactgcgacatcatgatgtacatcctgagaaccgtgttcgagagagccatcgacaccgacagcaacctgtggaccgagggcatgctgcagatggccttccacatcctggccctgggcctgctggaggagaagcagcagctgcagaaggcccccgaggaggaggtgaccttcgacttctaccacaaggccagcagactgggcagcagcgccatgaacatccagatgctgctggagaagctgaagggcatcccccagctggagggccagaaggacatgatcacctggatcctgcagatgttcgacaccgtgaagagactgagagagaagagctgcctgatcgtggccaccaccagcggcagcgagagcatcaagaacgacgagatcctgcaccactag

SEQ ID NO: 104337 - DNA, 1728 bp, Artificial Sequence
  Description of Artificial Sequence: Synthetic coding sequence
atgtacgccggcaacatccccatctacaagaccgagagcagaagcagaaacgagcagggcatggaccccatcaccagacaggtgggccagcacatcgagatggagcccgagtgggaggccgccttcaccctgcagatgaagctgacccacgtgatcagcatgatgcaggactggtgcgccagcgacgagaaggtgctgatcgaggcctacaagaagtgcctggccgtgctgatgcagtgccacggcggctacaccgacggcgagcagcccatcaccctgagcatctgcggccacagcgtggagaccatcagatactgcgtgagccaggagaaggtgagcatccacctgcccgtgagcagactgctggccggcctgcacgtgctgctgagcaagagcgaggtggcctacaagttccccgagctgctgcccctgagcgagctgagcccccccatgctgatcgagcaccccctgagatgcctggtgctgtgcgcccaggtgcacgccggcatgtggagaagaaacggcttcagcctggtgaaccagatctactactaccacaacgtgaagtgcagaagagagatgttcgacaaggacgtggtgatgctgcagaccggcgtgagcatgatggaccccaaccacttcctgatgatcatgctgagcagattcgagctgtaccagatcttcagcacccccgactacggcaagagattcagcagcgagatcacccacaaggacgtggtgcagcagaacaacaccctgatcgaggagatgctgtacctgatcatcatgctggtgggcgagagattcagccccggcgtgggccaggtgaacgccaccgacgagatcaagagagagatcatccaccagctgagcatcaagcccatggcccacagcgagctggtgaagagcctgcccgaggacgagaacaaggagaccggcatggagagcgtgatcgaggccgtggcccacttcaagaagcccggcctgaccggcagaggcatgtacgagctgaagcccgagtgcgccaaggagttcaacctgtacttctaccacttcagcagagccgagcagagcaaggccgaggaggcccagagaaagctgaagagacagaacagagaggacaccgccctgcccccccccgtgctgccccccttctgccccctgttcgccagcctggtgaacatcctgcagagcgacgtgatgctgtgcatcatgggcaccatcctgcagtgggccgtggagcacaacggctacgcctggagcgagagcatgctgcagagagtgctgcacctgatcggcatggccctgcaggaggagaagcagcacctggagaacgtgaccgaggagcacgtggtgaccttcaccttcacccagaagatcagcaagcccggcgaggcccccaagaacagccccagcatcctggccatgctggagaccctgcagaacgccccctacctggaggtgcacaaggacatgatcagatggatcctgaagaccttcaacgccgtgaagaagatgagagagagcagccccaccagccccgtggccgagaccgagggcaccatcatggaggagcacaacttcagagtgcagggcaccaagaccaagctgagaggcagagagaagcagagactgcccgactgcgccgagaagagaagctggctgagatgcctgaagtgcagcggcatcctgctgatgaagaccaagaacagcttcagcagacactag

SEQ ID NO: 104338 - DNA, 5268 bp, Artificial Sequence
  Description of Artificial Sequence: Synthetic coding sequence
atggccagcgagctggagcccgaggtgcaggccatcgacagaagcctgctggagtgcagcgccgaggagatcgccggcaagtggctgcaggccaccgacctgaccagagaggtgtaccagcacctggcccactacgtgcccaagatctactgcagaggccccaaccccttcccccagaaggaggacatgctggcccagcacgtgctgctgggccccatggagtggtacctgtgcggcgaggaccccgccttcggcttccccaagctggagcaggccaacaagcccagccacctgtgcggcagagtgttcaaggtgggcgagcccacctacagctgcagagactgcgccgtggaccccacctgcgtgctgtgcatggagtgcttcctgggcagcatccacagagaccacagatacagaatgaccaccagcggcggcggcggcttctgcgactgcggcgacaccgaggcctggaaggagggcccctactgccagaagcacgagctgaacaccagcgagatcgaggaggaggaggaccccctggtgcacctgagcgaggacgtgatcgccagaacctacaacatcttcgccatcaccttcagatacgccgtggagatcctgacctgggagaaggagagcgagctgcccgccgacctggagatggtggagaagagcgacacctactactgcatgctgttcaacgacgaggtgcacacctacgagcaggtgatctacaccctgcagaaggccgtgaactgcacccagaaggaggccatcggcttcgccaccaccgtggacagagacggcagaagaagcgtgagatacggcgacttccagtactgcgagcaggccaagagcgtgatcgtgagaaacaccagcagacagaccaagcccctgaaggtgcaggtgatgcacagcagcatcgtggcccaccagaacttcggcctgaagctgctgagctggctgggcagcatcatcggctacagcgacggcctgagaagaatcctgtgccaggtgggcctgcaggagggccccgacggcgagaacagcagcctggtggacagactgatgctgagcgacagcaagctgtggaagggcgccagaagcgtgtaccaccagctgttcatgagcagcctgctgatggacctgaagtacaagaagctgttcgccgtgagattcgccaagaactaccagcagctgcagagagacttcatggaggacgaccacgagagagccgtgagcgtgaccgccctgagcgtgcagttcttcaccgcccccaccctggccagaatgctgatcaccgaggagaacctgatgagcatcatcatcaagaccttcatggaccacctgagacacagagacgcccagggcagattccagttcgagagatacaccgccctgcaggccttcaagttcagaagagtgcagagcctgatcctggacctgaagtacgtgctgatcagcaagcccaccgagtggagcgacgagctgagacagaagttcctggagggcttcgacgccttcctggagctgctgaagtgcatgcagggcatggaccccatcaccagacaggtgggccagcacatcgagatggagcccgagtgggaggccgccttcaccctgcagatgaagctgacccacgtgatcagcatgatgcaggactggtgcgccagcgacgagaaggtgctgatcgaggcctacaagaagtgcctggccgtgctgatgcagtgccacggcggctacaccgacggcgagcagcccatcaccctgagcatctgcggccacagcgtggagaccatcagatactgcgtgagccaggagaaggtgagcatccacctgcccgtgagcagactgctggccggcctgcacgtgctgctgagcaagagcgaggtggcctacaagttccccgagctgctgcccctgagcgagctgagcccccccatgctgatcgagcaccccctgagatgcctggtgctgtgcgcccaggtgcacgccggcatgtggagaagaaacggcttcagcctggtgaaccagatctactactaccacaacgtgaagtgcagaagagagatgttcgacaaggacgtggtgatgctgcagaccggcgtgagcatgatggaccccaaccacttcctgatgatcatgctgagcagattcgagctgtaccagatcttcagcacccccgactacggcaagagattcagcagcgagatcacccacaaggacgtggtgcagcagaacaacaccctgatcgaggagatgctgtacctgatcatcatgctggtgggcgagagattcagccccggcgtgggccaggtgaacgccaccgacgagatcaagagagagatcatccaccagctgagcatcaagcccatggcccacagcgagctggtgaagagcctgcccgaggacgagaacaaggagaccggcatggagagcgtgatcgaggccgtggcccacttcaagaagcccggcctgaccggcagaggcatgtacgagctgaagcccgagtgcgccaaggagttcaacctgtacttctaccacttcagcagagccgagcagagcaaggccgaggaggcccagagaaagctgaagagacagaacagagaggacaccgccctgcccccccccgtgctgccccccttctgccccctgttcgccagcctggtgaacatcctgcagagcgacgtgatgctgtgcatcatgggcaccatcctgcagtgggccgtggagcacaacggctacgcctggagcgagagcatgctgcagagagtgctgcacctgatcggcatggccctgcaggaggagaagcagcacctggagaacgtgaccgaggagcacgtggtgaccttcaccttcacccagaagatcagcaagcccggcgaggcccccaagaacagccccagcatcctggccatgctggagaccctgcagaacgccccctacctggaggtgcacaaggacatgatcagatggatcctgaagaccttcaacgccgtgaagaagatgagagagagcagccccaccagccccgtggccgagaccgagggcaccatcatggaggagagcagcagagacaaggacaaggccgagagaaagagaaaggccgagatcgccagactgagaagagagaagatcatggcccagatgagcgagatgcagagacacttcatcgacgagaacaaggagctgttccagcagaccctggagctggacgccagcaccagcgccgtgctggaccacagccccgtggccagcgacatgaccctgaccgccctgggccccgcccagacccaggtgcccgagcagagacagttcgtgacctgcatcctgtgccaggaggagcaggaggtgaaggtggagagcagagccatggtgctggccgccttcgtgcagagaagcaccgtgctgagcaagaacagaagcaagttcatccaggaccccgagaagtacgaccccctgttcatgcaccccgacctgagctgcggcacccacaccagcagctgcggccacatcatgcacgcccactgctggcagagatacttcgacagcgtgcaggccaaggagcagagaagacagcagagactgagactgcacaccagctacgacgtggagaacggcgagttcctgtgccccctgtgcgagtgcctgagcaacaccgtgatccccctgctgctgccccccagaaacatcttcaacaacagactgaacttcagcgaccagcccaacctgacccagtggatcagaaccatcagccagcagatcaaggccctgcagttcctgagaaaggaggagagcacccccaacaacgccagcaccaagaacagcgagaacgtggacgagctgcagctgcccgagggcttcagacccgacttcagacccaagatcccctacagcgagagcatcaaggagatgctgaccaccttcggcaccgccacctacaaggtgggcctgaaggtgcaccccaacgaggaggaccccagagtgcccatcatgtgctggggcagctgcgcctacaccatccagagcatcgagagaatcctgagcgacgaggacaagcccctgttcggccccctgccctgcagactggacgactgcctgagaagcctgaccagattcgccgccgcccactggaccgtggccagcgtgagcgtggtgcagggccacttctgcaagctgttcgccagcctggtgcccaacgacagccacgaggagctgccctgcatcctggacatcgacatgttccacctgctggtgggcctggtgctggccttccccgccctgcagtgccaggacttcagcggcatcagcctgggcaccggcgacctgcacatcttccacctggtgaccatggcccacatcatccagatcctgctgaccagctgcaccgaggagaacggcatggaccaggagaaccccccctgcgaggaggagagcgccgtgctggccctgtacaagaccctgcaccagtacaccggcagcgccctgaaggagatccccagcggctggcacctgtggagaagcgtgagagccggcatcatgcccttcctgaagtgcagcgccctgttcttccactacctgaacggcgtgcccagcccccccgacatccaggtgcccggcaccagccacttcgagcacctgtgcagctacctgagcctgcccaacaacctgatctgcctgttccaggagaacagcgagatcatgaacagcctgatcgagagctggtgcagaaacagcgaggtgaagagatacctggagggcgagagagacgccatcagataccccagagagagcaacaagctgatcaacctgcccgaggactacagcagcctgatcaaccaggccagcaacttcagctgccccaagagcggcggcgacaagagcagagcccccaccctgtgcctggtgtgcggcagcctgctgtgcagccagagctactgctgccagaccgagctggagggcgaggacgtgggcgcctgcaccgcccacacctacagctgcggcagcggcgtgggcatcttcctgagagtgagagagtgccaggtgctgttcctggccggcaagaccaagggctgcttctacagccccccctacctggacgactacggcgagaccgaccagggcctgagaagaggcaaccccctgcacctgtgcaaggagagattcaagaagatccagaagctgtggcaccagcacagcgtgaccgaggagatcggccacgcccaggaggccaaccagaccctggtgggcatcgactggcagcacctgtag

SEQ ID NO: 104339 - DNA, 5268 bp, Artificial Sequence
  Description of Artificial Sequence: Synthetic coding sequence
atggccagcgagctggagcccgaggtgcaggccatcgacagaagcctgctggagtgcagcgccgaggagatcgccggcaagtggctgcaggccaccgacctgaccagagaggtgtaccagcacctggcccactacgtgcccaagatctactgcagaggccccaaccccttcccccagaaggaggacatgctggcccagcacgtgctgctgggccccatggagtggtacctgtgcggcgaggaccccgccttcggcttccccaagctggagcaggccaacaagcccagccacctgtgcggcagagtgttcaaggtgggcgagcccacctacagctgcagagactgcgccgtggaccccacctgcgtgctgtgcatggagtgcttcctgggcagcatccacagagaccacagatacagaatgaccaccagcggcggcggcggcttctgcgactgcggcgacaccgaggcctggaaggagggcccctactgccagaagcacgagctgaacaccagcgagatcgaggaggaggaggaccccctggtgcacctgagcgaggacgtgatcgccagaacctacaacatcttcgccatcaccttcagatacgccgtggagatcctgacctgggagaaggagagcgagctgcccgccgacctggagatggtggagaagagcgacacctactactgcatgctgttcaacgacgaggtgcacacctacgagcaggtgatctacaccctgcagaaggccgtgaactgcacccagaaggaggccatcggcttcgccaccaccgtggacagagacggcagaagaagcgtgagatacggcgacttccagtactgcgagcaggccaagagcgtgatcgtgagaaacaccagcagacagaccaagcccctgaaggtgcaggtgatgcacagcagcatcgtggcccaccagaacttcggcctgaagctgctgagctggctgggcagcatcatcggctacagcgacggcctgagaagaatcctgtgccaggtgggcctgcaggagggccccgacggcgagaacagcagcctggtggacagactgatgctgagcgacagcaagctgtggaagggcgccagaagcgtgtaccaccagctgttcatgagcagcctgctgatggacctgaagtacaagaagctgttcgccgtgagattcgccaagaactacgagagactgcagagcgactacgtgaccgacgaccacgacagagagttcagcgtggccgacctgagcgtgcagatcttcaccgtgcccagcctggccagaatgctgatcaccgaggagaacctgatgagcatcatcatcaagaccttcatggaccacctgagacacagagacgcccagggcagattccagttcgagagatacaccgccctgcaggccttcaagttcagaagagtgcagagcctgatcctggacctgaagtacgtgctgatcagcaagcccaccgagtggagcgacgagctgagacagaagttcctggagggcttcgacgccttcctggagctgctgaagtgcatgcagggcatggaccccatcaccagacaggtgggccagcacatcgagatggagcccgagtgggaggccgccttcaccctgcagatgaagctgacccacgtgatcagcatgatgcaggactggtgcgccagcgacgagaaggtgctgatcgaggcctacaagaagtgcctggccgtgctgatgcagtgccacggcggctacaccgacggcgagcagcccatcaccctgagcatctgcggccacagcgtggagaccatcagatactgcgtgagccaggagaaggtgagcatccacctgcccgtgagcagactgctggccggcctgcacgtgctgctgagcaagagcgaggtggcctacaagttccccgagctgctgcccctgagcgagctgagcccccccatgctgatcgagcaccccctgagatgcctggtgctgtgcgcccaggtgcacgccggcatgtggagaagaaacggcttcagcctggtgaaccagatctactactaccacaacgtgaagtgcagaagagagatgttcgacaaggacgtggtgatgctgcagaccggcgtgagcatgatggaccccaaccacttcctgatgatcatgctgagcagattcgagctgtaccagatcttcagcacccccgactacggcaagagattcagcagcgagatcacccacaaggacgtggtgcagcagaacaacaccctgatcgaggagatgctgtacctgatcatcatgctggtgggcgagagattcagccccggcgtgggccaggtgaacgccaccgacgagatcaagagagagatcatccaccagctgagcatcaagcccatggcccacagcgagctggtgaagagcctgcccgaggacgagaacaaggagaccggcatggagagcgtgatcgaggccgtggcccacttcaagaagcccggcctgaccggcagaggcatgtacgagctgaagcccgagtgcgccaaggagttcaacctgtacttctaccacttcagcagagccgagcagagcaaggccgaggaggcccagagaaagctgaagagacagaacagagaggacaccgccctgcccccccccgtgctgccccccttctgccccctgttcgccagcctggtgaacatcctgcagagcgacgtgatgctgtgcatcatgggcaccatcctgcagtgggccgtggagcacaacggctacgcctggagcgagagcatgctgcagagagtgctgcacctgatcggcatggccctgcaggaggagaagcagcacctggagaacgtgaccgaggagcacgtggtgaccttcaccttcacccagaagatcagcaagcccggcgaggcccccaagaacagccccagcatcctggccatgctggagaccctgcagaacgccccctacctggaggtgcacaaggacatgatcagatggatcctgaagaccttcaacgccgtgaagaagatgagagagagcagccccaccagccccgtggccgagaccgagggcaccatcatggaggagagcagcagagacaaggacaaggccgagagaaagagaaaggccgagatcgccagactgagaagagagaagatcatggcccagatgagcgagatgcagagacacttcatcgacgagaacaaggagctgttccagcagaccctggagctggacgccagcaccagcgccgtgctggaccacagccccgtggccagcgacatgaccctgaccgccctgggccccgcccagacccaggtgcccgagcagagacagttcgtgacctgcatcctgtgccaggaggagcaggaggtgaaggtggagagcagagccatggtgctggccgccttcgtgcagagaagcaccgtgctgagcaagaacagaagcaagttcatccaggaccccgagaagtacgaccccctgttcatgcaccccgacctgagctgcggcacccacaccagcagctgcggccacatcatgcacgcccactgctggcagagatacttcgacagcgtgcaggccaaggagcagagaagacagcagagactgagactgcacaccagctacgacgtggagaacggcgagttcctgtgccccctgtgcgagtgcctgagcaacaccgtgatccccctgctgctgccccccagaaacatcttcaacaacagactgaacttcagcgaccagcccaacctgacccagtggatcagaaccatcagccagcagatcaaggccctgcagttcctgagaaaggaggagagcacccccaacaacgccagcaccaagaacagcgagaacgtggacgagctgcagctgcccgagggcttcagacccgacttcagacccaagatcccctacagcgagagcatcaaggagatgctgaccaccttcggcaccgccacctacaaggtgggcctgaaggtgcaccccaacgaggaggaccccagagtgcccatcatgtgctggggcagctgcgcctacaccatccagagcatcgagagaatcctgagcgacgaggacaagcccctgttcggccccctgccctgcagactggacgactgcctgagaagcctgaccagattcgccgccgcccactggaccgtggccagcgtgagcgtggtgcagggccacttctgcaagctgttcgccagcctggtgcccaacgacagccacgaggagctgccctgcatcctggacatcgacatgttccacctgctggtgggcctggtgctggccttccccgccctgcagtgccaggacttcagcggcatcagcctgggcaccggcgacctgcacatcttccacctggtgaccatggcccacatcatccagatcctgctgaccagctgcaccgaggagaacggcatggaccaggagaaccccccctgcgaggaggagagcgccgtgctggccctgtacaagaccctgcaccagtacaccggcagcgccctgaaggagatccccagcggctggcacctgtggagaagcgtgagagccggcatcatgcccttcctgaagtgcagcgccctgttcttccactacctgaacggcgtgcccagcccccccgacatccaggtgcccggcaccagccacttcgagcacctgtgcagctacctgagcctgcccaacaacctgatctgcctgttccaggagaacagcgagatcatgaacagcctgatcgagagctggtgcagaaacagcgaggtgaagagatacctggagggcgagagagacgccatcagataccccagagagagcaacaagctgatcaacctgcccgaggactacagcagcctgatcaaccaggccagcaacttcagctgccccaagagcggcggcgacaagagcagagcccccaccctgtgcctggtgtgcggcagcctgctgtgcagccagagctactgctgccagaccgagctggagggcgaggacgtgggcgcctgcaccgcccacacctacagctgcggcagcggcgtgggcatcttcctgagagtgagagagtgccaggtgctgttcctggccggcaagaccaagggctgcttctacagccccccctacctggacgactacggcgagaccgaccagggcctgagaagaggcaaccccctgcacctgtgcaaggagagattcaagaagatccagaagctgtggcaccagcacagcgtgaccgaggagatcggccacgcccaggaggccaaccagaccctggtgggcatcgactggcagcacctgtag

SEQ ID NO: 104340 - DNA, 1320 bp, Artificial Sequence
  Description of Artificial Sequence: Synthetic coding sequence
atggccagcgagctggagcccgaggtgcaggccatcgacagaagcctgctggagtgcagcgccgaggagatcgccggcaagtggctgcaggccaccgacctgaccagagaggtgtaccagcacctggcccactacgtgcccaagatctactgcagaggccccaaccccttcccccagaaggaggacatgctggcccagcacgtgctgctgggccccatggagtggtacctgtgcggcgaggaccccgccttcggcttccccaagctggagcaggccaacaagcccagccacctgtgcggcagagtgttcaaggtgggcgagcccacctacagctgcagagactgcgccgtggaccccacctgcgtgctgtgcatggagtgcttcctgggcagcatccacagagaccacagatacagaatgaccaccagcggcggcggcggcttctgcgactgcggcgacaccgaggcctggaaggagggcccctactgccagaagcacgagctgaacaccagcgagatcgaggaggaggaggaccccctggtgcacctgagcgaggacgtgatcgccagaacctacaacatcttcgccatcaccttcagatacgccgtggagatcctgacctgggagaaggagagcgagctgcccgccgacctggagatggtggagaagagcgacacctactactgcatgctgttcaacgacgaggtgcacacctacgagcaggtgatctacaccctgcagaaggccgtgaactgcacccagaaggaggccatcggcttcgccaccaccgtggacagagacggcagaagaagcgtgagatacggcgacttccagtactgcgagcaggccaagagcgtgatcgtgagaaacaccagcagacagaccaagcccctgaaggtgcaggtgatgcacagcagcatcgtggcccaccagaacttcggcctgaagctgctgagctggctgggcagcatcatcggctacagcgacggcctgagaagaatcctgtgccaggtgggcctgcaggagggccccgacggcgagaacagcagcctggtggacagactgatgctgagcgacagcaagctgtggaagggcgccagaagcgtgtaccaccagctgttcatgagcagcctgctgatggacctgaagtacaagaagctgttcgccgtgagattcgccaagaactacgagagactgcagagcgactacgtgaccgacgaccacgacagagagttcagcgtggccgacctgagcgtgcagatcttcaccgtgcccagcctgttcagcatcagcgccggcagaagcggcagccccctgtag

SEQ ID NO: 104341 - DNA, 5667 bp, Artificial Sequence
  Description of Artificial Sequence: Synthetic coding sequence
atggccgccgccgccgccgccgccgtgggcggccagcagcccagccagcccgagctgcccgcccccggcctggccctggacaaggccgccaccgccgcccacctgaaggccgccctgagcagacccgacaacagagccggcgccgaggagctgcaggccctgctggagagagtgctgagcgccgagagacccctggccgccgccgccggcggcgaggacgccgccgccgccggcggcggcggcggccccggcgccgccgaggaggaggccctggagtggtgcaagtgcctgctggccggcggcggcggctacgacgagttctgcgccgccgtgagagcctacgaccccgccgccctgtgcggcctggtgtggaccgccaacttcgtggcctacagatgcagaacctgcggcatcagcccctgcatgagcctgtgcgccgagtgcttccaccagggcgaccacaccggccacgacttcaacatgttcagaagccaggccggcggcgcctgcgactgcggcgacagcaacgtgatgagagagagcggcttctgcaagagacaccagatcaagagcagcagcaacatcccctgcgtgcccaaggacctgctgatgatgagcgagttcgtgctgcccagattcatcttctgcctgatccagtacctgagagagggctacaacgagcccgccgccgacggccccagcgagaaggacctgaacaaggtgctgcagctgctggagccccagatcagcttcctggaggacctgaccaagatgggcggcgccatgagaagcgtgctgacccaggtgctgaccaaccagcagaactacaaggacctgaccagcggcctgggcgagaacgcctgcgtgaagaagagccacgagaagtacctgatcgccctgaagagcagcggcctgacctaccccgaggacaagctggtgtacggcgtgcaggagcccagcgccggcaccagcagcctggccgtgcagggcttcatcggcgccaccggcaccctgggccaggtggacagcagcgacgaggacgaccaggacggcagccagggcctgggcaagagaaagagagtgaagctgagcagcggcaccaaggaccagagcatcatggacgtgctgaagcacaagagcttcctggaggagctgctgttctggaccatcaagtacgagttcccccagaagatggtgaccttcctgctgaacatgctgcccgaccaggagtacaaggtggccttcaccaagaccttcgtgcagcactacgccttcatcatgaagaccctgaagaagagccacgagagcgacaccatgagcaacagaatcgtgcacatcagcgtgcagctgttcagcaacgaggagctggccagacaggtgaccgaggagtgccagctgctggacatcatggtgaccgtgctgctgtacatgatggagagctgcctgatcaagagcgagctgcaggacgaggagaacagcctgcacgtggtggtgaactgcggcgaggccctgctgaagaacaacacctactggcccctggtgagcgacttcatcaacatcctgagccaccagagcgtggccaagagattcctggaggaccacggcctgctggtgacctggatgaacttcgtgagcttcttccagggcatgaacctgaacaagagagagctgaacgagcacgtggagttcgagagccagacctactacgccgccttcgccgccgagctggaggcctgcgcccagcccatgtggggcctgctgagccactgcaaggtgagagagacccaggagtacaccagaaacgtggtgagatactgcctggaggccctgcaggactggttcgacgccatcaacttcgtggacgagcccgcccccaaccaggtgaccttccacctgcccctgcacagatactacgccatgttcctgagcaaggccgtgaagtgccaggagctggacctggacagcgtgctgcccgaccaggagatgctgatgaagctgatgatccaccccctgcagatccaggccagcctggccgagatccacagcaacatgtgggtgagaaacggcctgcagatcaagggccaggccatgacctacgtgcagagccacttctgcaacagcatgatcgaccccgacatctacctgctgcaggtgtgcgccagcagactggaccccgactacttcatcagcagcgtgttcgagagattcaaggtggtggacctgctgaccatggccagccagcaccagaacaccgtgctggacgccgagcacgagagaagcatgctggagggcgccctgaccttcctggtgatcctgctgagcctgagactgcacctgggcatgagcgacgacgagatcctgagagccgagatggtggcccagctgtgcatgaacgacagaacccacagcagcctgctggacctgatccccgagaaccccaaccccaagagcggcatcatccccggcagctacagcttcgagagcgtgctgagcgccgtggccgacttcaaggcccccgtgttcgagcccggcggcagcatgcagcagggcatgtacacccccaaggccgaggtgtgggaccaggagttcgaccccgtgatggtgatcctgagaaccgtgtacagaagagacgtgcagagcgccatggacagatacaccgccttcctgaagcagagcggcaagttccccggcaacccctggcccccctacaagaagagaaccagcctgcaccccagctacaagggcctgatgagactgctgcactgcaagaccctgcacatcgtgctgttcaccctgctgtacaagatcctgatggaccaccagaacctgagcgagcacgtgctgtgcatggtgctgtacctgatcgagctgggcctggagaacagcgccgaggaggagagcgacgaggaggccagcgtgggcggccccgagagatgccacgacagctggttccccggcagcaacctggtgagcaacatgagacacttcatcaactacgtgagagtgagagtgcccgagaccgcccccgaggtgaagagagacagccccgccagcaccagcagcgacaacctgggcagcctgcagaacagcggcaccgcccaggtgttcagcctggtggccgagagaagaaagaagttccaggagatcatcaacagaagcagcagcgaggccaaccaggtggtgagacccaagaccagcagcaagtggagcgcccccggcagcgccccccagctgaccaccgccatcctggagatcaaggagagcatcctgagcctgctgatcaagctgcaccacaagctgagcggcaagcagaacagctactaccccccctggctggacgacatcgagatcctgatccagcccgagatccccaagtacagccacggcgacggcatcaccgccgtggagagaatcctgctgaaggccgccagccagagcagaatgaacaagagaatcatcgaggagatctgcagaaaggtgaccccccccgtgccccccaagaaggtgaccgccgccgagaagaagaccctggacaaggaggagagaagacagaaggccagagagagacagcagaagctgctggccgagttcgccagcagacagaagagcttcatggagaccgccatggacgtggacagccccgagaacgacatccccatggagatcaccaccgccgagccccaggtgagcgaggccgtgtacgactgcgtgatctgcggccagagcggccccagcagcgaggacagacccaccggcctggtggtgctgctgcaggccagcagcgtgctgggccagtgcagagacaacgtggagcccaagaagctgcccatcagcgaggaggagcagatctacccctgggacacctgcgccgccgtgcacgacgtgagactgagcctgctgcagagatacttcaaggacagcagctgcctgctggccgtgagcatcggctgggagggcggcgtgtacgtgcagacctgcggccacaccctgcacatcgactgccacaagagctacatggagagcctgagaaacgaccaggtgctgcagggcttcagcgtggacaagggcgagttcacctgccccctgtgcagacagttcgccaacagcgtgctgccctgctaccccggcagcaacgtggagaacaacccctggcagagacccagcaacaagagcatccaggacctgatcaaggaggtggaggagctgcagggcagacccggcgccttccccagcgagaccaacctgagcaaggagatggagagcgtgatgaaggacatcaagaacaccacccagaagaagtacagagactacagcaagacccccggcagccccgacaacgacttcctgttcatgtacagcgtggccagaaccaacctggagctggagctgatccacagaggcggcaacctgtgcagcggcggcgccagcaccgccggcaagagaagctgcctgaaccagctgttccacgtgctggccctgcacatgagactgtacagcatcgacagcgagtacaacccctggagaaagctgacccagctggaggagatgaacccccagctgggctacgaggagcagcagcccgaggtgcccatcctgtaccacgacgtgaccagcctgctgctgatccagatcctgatgatgccccagcccctgagaaaggaccacttcacctgcatcgtgaaggtgctgttcaccctgctgtacacccaggccctggccgccctgagcgtgaagtgcagcgaggaggacagaagcgcctggaagcacgccggcgccctgaagaagagcacctgcgacgccgagaagagctacgaggtgctgctgagcttcgtgatcagcgagctgttcaagggcaagctgtaccacgaggagggcacccaggagtgcgccatggtgaaccccatcgcctggagccccgagagcatggagaagtgcctgcaggacttctgcctgcccttcctgagaatcaccagcctgctgcagcaccacctgttcggcgaggacctgcccagctgccaggaggaggaggagttcagcgtgctggccagctgcctgggcctgctgcccaccttctaccagaccgagcaccccttcatcagcgccagctgcctggactggcccgtgcccgccttcgacatcatcacccagtggtgcttcgagatcaagagcttcaccgagagacacgccgagcagggcaaggccctgctgatccaggagagcaagtggaagctgccccacctgctgcagctgcccgagaactacaacaccatcttccagtactaccacagaaagacctgcagcgtgtgcaccaaggtgcccaaggaccccgccgtgtgcctggtgtgcggcaccttcgtgtgcctgaagggcctgtgctgcaagcagcagagctactgcgagtgcgtgctgcacagccagaactgcggcgccggcaccggcatcttcctgctgatcaacgccagcgtgatcatcatcatcagaggccacagattctgcctgtggggcagcgtgtacctggacgcccacggcgaggaggacagagacctgagaagaggcaagcccctgtacatctgcaaggagagatacaaggtgctggagcagcagtggatcagccacaccttcgaccacatcaacaagagatggggcccccactacaacggcctgtag

SEQ ID NO: 104342 - DNA, 2130 bp, Artificial Sequence
  Description of Artificial Sequence: Synthetic coding sequence
atgatcgccagcaagcagagacagttcaccgaggtgttcagaatcatgagcagcaccttcagccagagcagattcctgtacgccgccgtggtgaccgacagccccgagaacgacatccccatggagatcaccaccgccgagccccaggtgagcgaggccgtgtacgactgcgtgatctgcggccagagcggccccagcagcgaggacagacccaccggcctggtggtgctgctgcaggccagcagcgtgctgggccagtgcagagacaacgtggagcccaagaagctgcccatcagcgaggaggagcagatctacccctgggacacctgcgccgccgtgcacgacgtgagactgagcctgctgcagagatacttcaaggacagcagctgcctgctggccgtgagcatcggctgggagggcggcgtgtacgtgcagacctgcggccacaccctgcacatcgactgccacaagagctacatggagagcctgagaaacgaccaggtgctgcagggcttcagcgtggacaagggcgagttcacctgccccctgtgcagacagttcgccaacagcgtgctgccctgctaccccggcagcaacgtggagaacaacccctggcagagacccagcaacaagagcatccaggacctgatcaaggaggtggaggagctgcagggcagacccggcgccttccccagcgagaccaacctgagcaaggagatggagagcgtgatgaaggacatcaagaacaccacccagaagaagtacagagactacagcaagacccccggcagccccgacaacgacttcctgttcatgtacagcgtggccagaaccaacctggagctggagctgatccacagaggcggcaacctgtgcagcggcggcgccagcaccgccggcaagagaagctgcctgaaccagctgttccacgtgctggccctgcacatgagactgtacagcatcgacagcgagtacaacccctggagaaagctgacccagctggaggagatgaacccccagctgggctacgaggagcagcagcccgaggtgcccatcctgtaccacgacgtgaccagcctgctgctgatccagatcctgatgatgccccagcccctgagaaaggaccacttcacctgcatcgtgaaggtgctgttcaccctgctgtacacccaggccctggccgccctgagcgtgaagtgcagcgaggaggacagaagcgcctggaagcacgccggcgccctgaagaagagcacctgcgacgccgagaagagctacgaggtgctgctgagcttcgtgatcagcgagctgttcaagggcaagctgtaccacgaggagggcacccaggagtgcgccatggtgaaccccatcgcctggagccccgagagcatggagaagtgcctgcaggacttctgcctgcccttcctgagaatcaccagcctgctgcagcaccacctgttcggcgaggacctgcccagctgccaggaggaggaggagttcagcgtgctggccagctgcctgggcctgctgcccaccttctaccagaccgagcaccccttcatcagcgccagctgcctggactggcccgtgcccgccttcgacatcatcacccagtggtgcttcgagatcaagagcttcaccgagagacacgccgagcagggcaaggccctgctgatccaggagagcaagtggaagctgccccacctgctgcagctgcccgagaactacaacaccatcttccagtactaccacagaaagacctgcagcgtgtgcaccaaggtgcccaaggaccccgccgtgtgcctggtgtgcggcaccttcgtgtgcctgaagggcctgtgctgcaagcagcagagctactgcgagtgcgtgctgcacagccagaactgcggcgccggcaccggcatcttcctgctgatcaacgccagcgtgatcatcatcatcagaggccacagattctgcctgtggggcagcgtgtacctggacgcccacggcgaggaggacagagacctgagaagaggcaagcccctgtacatctgcaaggagagatacaaggtgctggagcagcagtggatcagccacaccttcgaccacatcaacaagagatggggcccccactacaacggcctgtag

SEQ ID NO: 104343 - DNA, 5667 bp, Artificial Sequence; identical to SEQ ID NO: 104341
  Description of Artificial Sequence: Synthetic coding sequence

SEQ ID NO: 104344 - DNA, 5754 bp, Artificial Sequence
  Description of Artificial Sequence: Synthetic coding sequence
atggccgccgccgccgccgccgccgtgggcggccagcagcccagccagcccgagctgcccgcccccggcctggccctggacaaggccgccaccgccgcccacctgaaggccgccctgagcagacccgacaacagagccggcgccgaggagctgcaggccctgctggagagagtgctgagcgccgagagacccctggccgccgccgccggcggcgaggacgccgccgccgccggcggcggcggcggccccggcgccgccgaggaggaggccctggagtggtgcaagtgcctgctggccggcggcggcggctacgacgagttctgcgccgccgtgagagcctacgaccccgccgccctgtgcggcctggtgtggaccgccaacttcgtggcctacagatgcagaacctgcggcatcagcccctgcatgagcctgtgcgccgagtgcttccaccagggcgaccacaccggccacgacttcaacatgttcagaagccaggccggcggcgcctgcgactgcggcgacagcaacgtgatgagagagagcggcttctgcaagagacaccagatcaagagcagcagcaacatcccctgcgtgcccaaggacctgctgatgatgagcgagttcgtgctgcccagattcatcttctgcctgatccagtacctgagagagggctacaacgagcccgccgccgacggccccagcgagaaggacctgaacaaggtgctgcagctgctggagccccagatcagcttcctggaggacctgaccaagatgggcggcgccatgagaagcgtgctgacccaggtgctgaccaaccagcagaactacaaggacctgaccagcggcctgggcgagaacgcctgcgtgaagaagagccacgagaagtacctgatcgccctgaagagcagcggcctgacctaccccgaggacaagctggtgtacggcgtgcaggagcccagcgccggcaccagcagcctggccgtgcagggcttcatcggcgccaccggcaccctgggccaggtggacagcagcgacgaggacgaccaggacggcagccagggcctgggcaagagaaagagagtgaagctgagcagcggcaccaaggaccagagcatcatggacgtgctgaagcacaagagcttcctggaggagctgctgttctggaccatcaagtacgagttcccccagaagatggtgaccttcctgctgaacatgctgcccgaccaggagtacaaggtggccttcaccaagaccttcgtgcagcactacgccttcatcatgaagaccctgaagaagagccacgagagcgacaccatgagcaacagaatcgtgcacatcagcgtgcagctgttcagcaacgaggagctggccagacaggtgaccgaggagtgccagctgctggacatcatggtgaccgtgctgctgtacatgatggagagctgcctgatcaagagcgagctgcaggacgaggagaacagcctgcacgtggtggtgaactgcggcgaggccctgctgaagaacaacacctactggcccctggtgagcgacttcatcaacatcctgagccaccagagcgtggccaagagattcctggaggaccacggcctgctggtgacctggatgaacttcgtgagcttcttccagggcatgaacctgaacaagagagagctgaacgagcacgtggagttcgagagccagacctactacgccgccttcgccgccgagctggaggcctgcgcccagcccatgtggggcctgctgagccactgcaaggtgagagagacccaggagtacaccagaaacgtggtgagatactgcctggaggccctgcaggactggttcgacgccatcaacttcgtggacgagcccgcccccaaccaggtgaccttccacctgcccctgcacagatactacgccatgttcctgagcaaggccgtgaagtgccaggagctggacctggacagcgtgctgcccgaccaggagatgctgatgaagctgatgatccaccccctgcagatccaggccagcctggccgagatccacagcaacatgtgggtgagaaacggcctgcagatcaagggccaggccatgacctacgtgcagagccacttctgcaacagcatgatcgaccccgacatctacctgctgcaggtgtgcgccagcagactggaccccgactacttcatcagcagcgtgttcgagagattcaaggtggtggacctgctgaccatggccagccagcaccagaacaccgtgctggacgccgagcacgagagaagcatgctggagggcgccctgaccttcctggtgatcctgctgagcctgagactgcacctgggcatgagcgacgacgagatcctgagagccgagatggtggcccagctgtgcatgaacgacagaacccacagcagcctgctggacctgatccccgagaaccccaaccccaagagcggcatcatccccggcagctacagcttcgagagcgtgctgagcgccgtggccgacttcaaggcccccgtgttcgagcccggcggcagcatgcagcagggcatgtacacccccaaggccgaggtgtgggaccaggagttcgaccccgtgatggtgatcctgagaaccgtgtacagaagagacgtgcagagcgccatggacagatacaccgccttcctgaagcagagcggcaagttccccggcaacccctggcccccctacaagaagagaaccagcctgcaccccagctacaagggcctgatgagactgctgcactgcaagaccctgcacatcgtgctgttcaccctgctgtacaagatcctgatggaccaccagaacctgagcgagcacgtgctgtgcatggtgctgtacctgatcgagctgggcctggagaacagcgccgaggaggagagcgacgaggaggccagcgtgggcggccccgagagatgccacgacagctggttccccggcagcaacctggtgagcaacatgagacacttcatcaactacgtgagagtgagagtgcccgagaccgcccccgaggtgaagagagacagccccgccagcaccagcagcgacaacctgggcagcctgcagaacagcggcaccgcccaggtgttcagcctggtggccgagagaagaaagaagttccaggagatcatcaacagaagcagcagcgaggccaaccaggtggtgagacccaagaccagcagcaagtggagcgcccccggcagcgccccccagctgaccaccgccatcctggagatcaaggagagcatcctgagcctgctgatcaagctgcaccacaagctgagcggcaagcagaacagctactaccccccctggctggacgacatcgagatcctgatccagcccgagatccccaagtacagccacggcgacggcatcaccgccgtggagagaatcctgctgaaggccgccagccagagcagaatgaacaagagaatcatcgaggagatctgcagaaaggtgaccccccccgtgccccccaagaaggtgaccgccgccgagaagaagaccctggacaaggaggagagaagacagaaggccagagagagacagcagaagctgctggccgagttcgccagcagacagaagagcttcatggagaccgccatggacgtggacagccccgagaacgacatccccatggagatcaccaccgccgagccccaggtgagcgaggccgtgtacgactgcgtgatctgcggccagagcggccccagcagcgaggacagacccaccggcctggtggtgctgctgcaggccagcagcgtgctgggccagtgcagagacaacgtggagcccaagaagctgcccatcagcgaggaggagcagatctacccctgggacacctgcgccgccgtgcacgacgtgagactgagcctgctgcagagatacttcaaggacagcagctgcctgctggccgtgagcatcggctgggagggcggcgtgtacgtgcagacctgcggccacaccctgcacatcgactgccacaagagctacatggagagcctgagaaacgaccaggtgctgcagggcttcagcgtggacaagggcgagttcacctgccccctgtgcagacagttcgccaacagcgtgctgccctgctaccccggcagcaacgtggagaacaacccctggcagagacccagcaacaagagcatccaggacctgatcaaggaggtggaggagctgcagggcagacccggcgccttccccagcgagaccaacctgagcaaggagatggagagcgtgatgaaggacatcaagaacaccacccagaagaagtacagagactacagcaagacccccggcagccccgacaacgacttcctgttcatgtacagcgtggccagaaccaacctggagctggagctgatccacagaggcggcaacctgtgcagcggcggcgccagcaccgccggcaagagaagctgcctgaacttctgcttcatcatcttccccttcaccaagagcgagatcatcctgtgccagtacagaaagagccacgacaaggtgtaccccaagtaccagctgttccacgtgctggccctgcacatgagactgtacagcatcgacagcgagtacaacccctggagaaagctgacccagctggaggagatgaacccccagctgggctacgaggagcagcagcccgaggtgcccatcctgtaccacgacgtgaccagcctgctgctgatccagatcctgatgatgccccagcccctgagaaaggaccacttcacctgcatcgtgaaggtgctgttcaccctgctgtacacccaggccctggccgccctgagcgtgaagtgcagcgaggaggacagaagcgcctggaagcacgccggcgccctgaagaagagcacctgcgacgccgagaagagctacgaggtgctgctgagcttcgtgatcagcgagctgttcaagggcaagctgtaccacgaggagggcacccaggagtgcgccatggtgaaccccatcgcctggagccccgagagcatggagaagtgcctgcaggacttctgcctgcccttcctgagaatcaccagcctgctgcagcaccacctgttcggcgaggacctgcccagctgccaggaggaggaggagttcagcgtgctggccagctgcctgggcctgctgcccaccttctaccagaccgagcaccccttcatcagcgccagctgcctggactggcccgtgcccgccttcgacatcatcacccagtggtgcttcgagatcaagagcttcaccgagagacacgccgagcagggcaaggccctgctgatccaggagagcaagtggaagctgccccacctgctgcagctgcccgagaactacaacaccatcttccagtactaccacagaaagacctgcagcgtgtgcaccaaggtgcccaaggaccccgccgtgtgcctggtgtgcggcaccttcgtgtgcctgaagggcctgtgctgcaagcagcagagctactgcgagtgcgtgctgcacagccagaactgcggcgccggcaccggcatcttcctgctgatcaacgccagcgtgatcatcatcatcagaggccacagattctgcctgtggggcagcgtgtacctggacgcccacggcgaggaggacagagacctgagaagaggcaagcccctgtacatctgcaaggagagatacaaggtgctggagcagcagtggatcagccacaccttcgaccacatcaacaagagatggggcccccactacaacggcctgtag

SEQ ID NO: 104345 - DNA, 1278 bp, Artificial Sequence
  Description of Artificial Sequence: Synthetic coding sequence
atggccggcgccgagggcgccgccggcagacagagcgagctggagcccgtggtgagcctggtggacgtgctggaggaggacgaggagctggagaacgaggcctgcgccgtgctgggcggcagcgacagcgagaagtgcagctacagccagggcagcgtgaagagacaggccctgtacgcctgcagcacctgcacccccgagggcgaggagcccgccggcatctgcctggcctgcagctacgagtgccacggcagccacaagctgttcgagctgtacaccaagagaaacttcagatgcgactgcggcaacagcaagttcaagaacctggagtgcaagctgctgcccgacaaggccaaggtgaacagcggcaacaagtacaacgacaacttcttcggcctgtactgcatctgcaagagaccctaccccgaccccgaggacgagatccccgacgagatgatccagtgcgtggtgtgcgaggactggttccacggcagacacctgggcgccatcccccccgagagcggcgacttccaggagatggtgtgccaggcctgcatgaagagatgcagcttcctgtgggcctacgccgcccagctggccgtgaccaagatcagcaccgaggacgacggcctggtgagaaacatcgacggcatcggcgaccaggaggtgatcaagcccgagaacggcgagcaccaggacagcaccctgaaggaggacgtgcccgagcagggcaaggacgacgtgagagaggtgaaggtggagcagaacagcgagccctgcgccggcagcagcagcgagagcgacctgcagaccgtgttcaagaacgagagcctgaacgccgagagcaagagcggctgcaagctgcaggagctgaaggccaagcagctgatcaagaaggacaccgccacctactggcccctgaactggagaagcaagctgtgcacctgccaggactgcatgaagatgtacggcgacctggacgtgctgttcctgaccgacgagtacgacaccgtgctggcctacgagaacaagggcaagatcgcccaggccaccgacagaagcgaccccctgatggacaccctgagcagcatgaacagagtgcagcaggtggagctgatctgcgagtacaacgacctgaagaccgagctgaaggactacctgaagagattcgccgacgagggcaccgtggtgaagagagaggacatccagcagttcttcgaggagttccagagcaagaagagaagaagagtggacggcatgcagtactactgcagctag

SEQ ID NO: 104346 - DNA, 1050 bp, Artificial Sequence
  Description of Artificial Sequence: Synthetic coding sequence
atgagaagagccctgagctgggccgccgccacccccagaagcgcccccaccctgagaaacttcagatgcgactgcggcaacagcaagttcaagaacctggagtgcaagctgctgcccgacaaggccaaggtgaacagcggcaacaagtacaacgacaacttcttcggcctgtactgcatctgcaagagaccctaccccgaccccgaggacgagatccccgacgagatgatccagtgcgtggtgtgcgaggactggttccacggcagacacctgggcgccatcccccccgagagcggcgacttccaggagatggtgtgccaggcctgcatgaagagatgcagcttcctgtgggcctacgccgcccagctggccgtgaccaagatcagcaccgaggacgacggcctggtgagaaacatcgacggcatcggcgaccaggaggtgatcaagcccgagaacggcgagcaccaggacagcaccctgaaggaggacgtgcccgagcagggcaaggacgacgtgagagaggtgaaggtggagcagaacagcgagccctgcgccggcagcagcagcgagagcgacctgcagaccgtgttcaagaacgagagcctgaacgccgagagcaagagcggctgcaagctgcaggagctgaaggccaagcagctgatcaagaaggacaccgccacctactggcccctgaactggagaagcaagctgtgcacctgccaggactgcatgaagatgtacggcgacctggacgtgctgttcctgaccgacgagtacgacaccgtgctggcctacgagaacaagggcaagatcgcccaggccaccgacagaagcgaccccctgatggacaccctgagcagcatgaacagagtgcagcaggtggagctgatctgcgagtacaacgacctgaagaccgagctgaaggactacctgaagagattcgccgacgagggcaccgtggtgaagagagaggacatccagcagttcttcgaggagttccagagcaagaagagaagaagagtggacggcatgcagtactactgcagctag

SEQ ID NO: 104347 - DNA, 1083 bp, Artificial Sequence
  Description of Artificial Sequence: Synthetic coding sequence
atgagaagagccctgagctgggccgccgccacccccagaagcgcccccaccctgagaaacttcagatgcgactgcggcaacagcaagttcaagaacctggagtgcaagctgctgcccgacaaggccaaggtgaacagcggcaacaagtacaacgacaacttcttcggcctgtactgcatctgcaagagaccctaccccgaccccgaggacgagatccccgacgagatgatccagtgcgtggtgtgcgaggactggttccacggcagacacctgggcgccatcccccccgagagcggcgacttccaggagatggtgtgccaggcctgcatgaagagatgcagcttcctgtgggcctacgccgcccagctggccgtgaccaagatcagcaccgaggacgacggcctggtgagaaacatcgacggcatcggcgaccaggaggtgatcaagcccgagaacggcgagcaccaggacagcaccctgaaggaggacgtgcccgagcagggcaaggacgacgtgagagaggtgaaggtggagcagaacagcgagccctgcgccggcagcagcagcgagagcgacctgcagaccgtgttcaagaacgagagcctgaacgccgagagcaagagcggctgcaagctgcaggagctgaaggccaagcagctgatcaagaaggacaccgccacctactggcccctgaactggagaagcaagctgtgcacctgccaggactgcatgaagatgtacggcgacctggacgtgctgttcctgaccgacgagtacgacaccgtgctggcctacgagaacaagggcaagatcgcccaggccaccgacagaagcgaccccctgatggacaccctgagcagcatgaacagagtgcagcaggtggagctgatctgcgagtacaacgacctgaagaccgagctgaaggactacctgaagagattcgccgacgagggcaccgtggtgaagagagaggacatccagcagttcttcgaggagttccagaagaaggagaagaagagcggctgggacgccgtgctgctgcagctggagtggagcatgaagctgagccacagcagccagtag

SEQ ID NO: 104348 - DNA, 2121 bp, Artificial Sequence
  Description of Artificial Sequence: Synthetic coding sequence
atggccagccccgccgacagctgcatccagttcaccagacacgccagcgacgtgctgctgaacctgaacagactgagaagcagagacatcctgaccgacgtggtgatcgtggtgagcagagagcagttcagagcccacaagaccgtgctgatggcctgcagcggcctgttctacagcatcttcaccgaccagctgaagtgcaacctgagcgtgatcaacctggaccccgagatcaaccccgagggcttctgcatcctgctggacttcatgtacaccagcagactgaacctgagagagggcaacatcatggccgtgatggccaccgccatgtacctgcagatggagcacgtggtggacacctgcagaaagttcatcaaggccagcgaggccgagatggtgagcgccatcaagccccccagagaggagttcctgaacagcagaatgctgatgccccaggacatcatggcctacagaggcagagaggtggtggagaacaacctgcccctgagaagcgcccccggctgcgagagcagagccttcgcccccagcctgtacagcggcctgagcaccccccccgccagctacagcatgtacagccacctgcccgtgagcagcctgctgttcagcgacgaggagttcagagacgtgagaatgcccgtggccaaccccttccccaaggagagagccctgccctgcgacagcgccagacccgtgcccggcgagtacagcagacccaccctggaggtgagccccaacgtgtgccacagcaacatctacagccccaaggagaccatccccgaggaggccagaagcgacatgcactacagcgtggccgagggcctgaagcccgccgcccccagcgccagaaacgccccctacttcccctgcgacaaggccagcaaggaggaggagagacccagcagcgaggacgagatcgccctgcacttcgagccccccaacgcccccctgaacagaaagggcctggtgagcccccagagcccccagaagagcgactgccagcccaacagccccaccgagagctgcagcagcaagaacgcctgcatcctgcaggccagcggcagcccccccgccaagagccccaccgaccccaaggcctgcaactggaagaagtacaagttcatcgtgctgaacagcctgaaccagaacgccaagcccgagggccccgagcaggccgagctgggcagactgagccccagagcctacaccgccccccccgcctgccagccccccatggagcccgagaacctggacctgcagagccccaccaagctgagcgccagcggcgaggacagcaccatcccccaggccagcagactgaacaacatcgtgaacagaagcatgaccggcagccccagaagcagcagcgagagccacagccccctgtacatgcacccccccaagtgcaccagctgcggcagccagagcccccagcacgccgagatgtgcctgcacaccgccggccccaccttccccgaggagatgggcgagacccagagcgagtacagcgacagcagctgcgagaacggcgccttcttctgcaacgagtgcgactgcagattcagcgaggaggccagcctgaagagacacaccctgcagacccacagcgacaagccctacaagtgcgacagatgccaggccagcttcagatacaagggcaacctggccagccacaagaccgtgcacaccggcgagaagccctacagatgcaacatctgcggcgcccagttcaacagacccgccaacctgaagacccacaccagaatccacagcggcgagaagccctacaagtgcgagacctgcggcgccagattcgtgcaggtggcccacctgagagcccacgtgctgatccacaccggcgagaagccctacccctgcgagatctgcggcaccagattcagacacctgcagaccctgaagagccacctgagaatccacaccggcgagaagccctaccactgcgagaagtgcaacctgcacttcagacacaagagccagctgagactgcacctgagacagaagcacggcgccatcaccaacaccaaggtgcagtacagagtgagcgccaccgacctgccccccgagctgcccaaggcctgctag

SEQ ID NO: 104349 - DNA, 2619 bp, Artificial Sequence
  Description of Artificial Sequence: Synthetic coding sequence
atgagaagcgtgtgccacagaagcggcgagccccagagcgacgacatcgaggccagcagaatgaagagagccgccgccaagcacctgatcgagagatactaccaccagctgaccgagggctgcggcaacgaggcctgcaccaacgagttctgcgccagctgccccaccttcctgagaatggacaacaacgccgccgccatcaaggccctggagctgtacaagatcaacgccaagctgtgcgacccccaccccagcaagaagggcgccagcagcgcctacctggagaacagcaagggcgcccccaacaacagctgcagcgagatcaagatgaacaagaagggcgccagaatcgacttcaaggacgtgacctacctgaccgaggagaaggtgtacgagatcctggagctgtgcagagagagagaggactacagccccctgatcagagtgatcggcagagtgttcagcagcgccgaggccctggtgcagagcttcagaaaggtgaagcagcacaccaaggaggagctgaagagcctgcaggccaaggacgaggacaaggacgaggacgagaaggagaaggccgcctgcagcgccgccgccatggaggaggacagcgaggccagcagcagcagaatcggcgacagcagccagggcgacaacaacctgcagaagctgggccccgacgacgtgagcgtggacatcgacgccatcagaagagtgtacaccagactgctgagcaacgagaagatcgagaccgccttcctgaacgccctggtgtacctgagccccaacgtggagtgcgacctgacctaccacaacgtgtacagcagagaccccaactacctgaacctgttcatcatcgtgatggagaacagaaacctgcacagccccgagtacctggagatggccctgcccctgttctgcaaggccatgagcaagctgcccctggccgcccagggcaagctgatcagactgtggagcaagtacaacgccgaccagatcagaagaatgatggagaccttccagcagctgatcacctacaaggtgatcagcaacgagttcaacagcagaaacctggtgaacgacgacgacgccatcgtggccgccagcaagtgcctgaagatggtgtactacgccaacgtggtgggcggcgaggtggacaccaaccacaacgaggaggacgacgaggagcccatccccgagagcagcgagctgaccctgcaggagctgctgggcgaggagagaagaaacaagaagggccccagagtggaccccctggagaccgagctgggcgtgaagaccctggactgcagaaagcccctgatccccttcgaggagttcatcaacgagcccctgaacgaggtgctggagatggacaaggactacaccttcttcaaggtggagaccgagaacaagttcagcttcatgacctgccccttcatcctgaacgccgtgaccaagaacctgggcctgtactacgacaacagaatcagaatgtacagcgagagaagaatcaccgtgctgtacagcctggtgcagggccagcagctgaacccctacctgagactgaaggtgagaagagaccacatcatcgacgacgccctggtgagactggagatgatcgccatggagaaccccgccgacctgaagaagcagctgtacgtggagttcgagggcgagcagggcgtggacgagggcggcgtgagcaaggagttcttccagctggtggtggaggagatcttcaaccccgacatcggcatgttcacctacgacgagagcaccaagctgttctggttcaaccccagcagcttcgagaccgagggccagttcaccctgatcggcatcgtgctgggcctggccatctacaacaactgcatcctggacgtgcacttccccatggtggtgtacagaaagctgatgggcaagaagggcaccttcagagacctgggcgacagccaccccgtgctgtaccagagcctgaaggacctgctggagtacgagggcaacgtggaggacgacatgatgatcaccttccagatcagccagaccgacctgttcggcaaccccatgatgtacgacctgaaggagaacggcgacaagatccccatcaccaacgagaacagaaaggagttcgtgaacctgtacagcgactacatcctgaacaagagcgtggagaagcagttcaaggccttcagaagaggcttccacatggtgaccaacgagagccccctgaagtacctgttcagacccgaggagatcgagctgctgatctgcggcagcagaaacctggacttccaggccctggaggagaccaccgagtacgacggcggctacaccagagacagcgtgctgatcagagagttctgggagatcgtgcacagcttcaccgacgagcagaagagactgttcctgcagttcaccaccggcaccgacagagcccccgtgggcggcctgggcaagctgaagatgatcatcgccaagaacggccccgacaccgagagactgcccaccagccacacctgcttcaacgtgctgctgctgcccgagtacagcagcaaggagaagctgaaggagagactgctgaaggccatcacctacgccaagggcttcggcatgctgtag

SEQ ID NO: 104350 - DNA, 2628 bp, Artificial Sequence
  Description of Artificial Sequence: Synthetic coding sequence
atggagaagctgcaccagtgctactggaagagcggcgagccccagagcgacgacatcgaggccagcagaatgaagagagccgccgccaagcacctgatcgagagatactaccaccagctgaccgagggctgcggcaacgaggcctgcaccaacgagttctgcgccagctgccccaccttcctgagaatggacaacaacgccgccgccatcaaggccctggagctgtacaagatcaacgccaagctgtgcgacccccaccccagcaagaagggcgccagcagcgcctacctggagaacagcaagggcgcccccaacaacagctgcagcgagatcaagatgaacaagaagggcgccagaatcgacttcaaggacgtgacctacctgaccgaggagaaggtgtacgagatcctggagctgtgcagagagagagaggactacagccccctgatcagagtgatcggcagagtgttcagcagcgccgaggccctggtgcagagcttcagaaaggtgaagcagcacaccaaggaggagctgaagagcctgcaggccaaggacgaggacaaggacgaggacgagaaggagaaggccgcctgcagcgccgccgccatggaggaggacagcgaggccagcagcagcagaatcggcgacagcagccagggcgacaacaacctgcagaagctgggccccgacgacgtgagcgtggacatcgacgccatcagaagagtgtacaccagactgctgagcaacgagaagatcgagaccgccttcctgaacgccctggtgtacctgagccccaacgtggagtgcgacctgacctaccacaacgtgtacagcagagaccccaactacctgaacctgttcatcatcgtgatggagaacagaaacctgcacagccccgagtacctggagatggccctgcccctgttctgcaaggccatgagcaagctgcccctggccgcccagggcaagctgatcagactgtggagcaagtacaacgccgaccagatcagaagaatgatggagaccttccagcagctgatcacctacaaggtgatcagcaacgagttcaacagcagaaacctggtgaacgacgacgacgccatcgtggccgccagcaagtgcctgaagatggtgtactacgccaacgtggtgggcggcgaggtggacaccaaccacaacgaggaggacgacgaggagcccatccccgagagcagcgagctgaccctgcaggagctgctgggcgaggagagaagaaacaagaagggccccagagtggaccccctggagaccgagctgggcgtgaagaccctggactgcagaaagcccctgatccccttcgaggagttcatcaacgagcccctgaacgaggtgctggagatggacaaggactacaccttcttcaaggtggagaccgagaacaagttcagcttcatgacctgccccttcatcctgaacgccgtgaccaagaacctgggcctgtactacgacaacagaatcagaatgtacagcgagagaagaatcaccgtgctgtacagcctggtgcagggccagcagctgaacccctacctgagactgaaggtgagaagagaccacatcatcgacgacgccctggtgagactggagatgatcgccatggagaaccccgccgacctgaagaagcagctgtacgtggagttcgagggcgagcagggcgtggacgagggcggcgtgagcaaggagttcttccagctggtggtggaggagatcttcaaccccgacatcggcatgttcacctacgacgagagcaccaagctgttctggttcaaccccagcagcttcgagaccgagggccagttcaccctgatcggcatcgtgctgggcctggccatctacaacaactgcatcctggacgtgcacttccccatggtggtgtacagaaagctgatgggcaagaagggcaccttcagagacctgggcgacagccaccccgtgctgtaccagagcctgaaggacctgctggagtacgagggcaacgtggaggacgacatgatgatcaccttccagatcagccagaccgacctgttcggcaaccccatgatgtacgacctgaaggagaacggcgacaagatccccatcaccaacgagaacagaaaggagttcgtgaacctgtacagcgactacatcctgaacaagagcgtggagaagcagttcaaggccttcagaagaggcttccacatggtgaccaacgagagccccctgaagtacctgttcagacccgaggagatcgagctgctgatctgcggcagcagaaacctggacttccaggccctggaggagaccaccgagtacgacggcggctacaccagagacagcgtgctgatcagagagttctgggagatcgtgcacagcttcaccgacgagcagaagagactgttcctgcagttcaccaccggcaccgacagagcccccgtgggcggcctgggcaagctgaagatgatcatcgccaagaacggccccgacaccgagagactgcccaccagccacacctgcttcaacgtgctgctgctgcccgagtacagcagcaaggagaagctgaaggagagactgctgaaggccatcacctacgccaagggcttcggcatgctgtag

SEQ ID NO: 104351 - DNA, 2559 bp, Artificial Sequence
  Description of Artificial Sequence: Synthetic coding sequence
atgaagagagccgccgccaagcacctgatcgagagatactaccaccagctgaccgagggctgcggcaacgaggcctgcaccaacgagttctgcgccagctgccccaccttcctgagaatggacaacaacgccgccgccatcaaggccctggagctgtacaagatcaacgccaagctgtgcgacccccaccccagcaagaagggcgccagcagcgcctacctggagaacagcaagggcgcccccaacaacagctgcagcgagatcaagatgaacaagaagggcgccagaatcgacttcaaggacgtgacctacctgaccgaggagaaggtgtacgagatcctggagctgtgcagagagagagaggactacagccccctgatcagagtgatcggcagagtgttcagcagcgccgaggccctggtgcagagcttcagaaaggtgaagcagcacaccaaggaggagctgaagagcctgcaggccaaggacgaggacaaggacgaggacgagaaggagaaggccgcctgcagcgccgccgccatggaggaggacagcgaggccagcagcagcagaatcggcgacagcagccagggcgacaacaacctgcagaagctgggccccgacgacgtgagcgtggacatcgacgccatcagaagagtgtacaccagactgctgagcaacgagaagatcgagaccgccttcctgaacgccctggtgtacctgagccccaacgtggagtgcgacctgacctaccacaacgtgtacagcagagaccccaactacctgaacctgttcatcatcgtgatggagaacagaaacctgcacagccccgagtacctggagatggccctgcccctgttctgcaaggccatgagcaagctgcccctggccgcccagggcaagctgatcagactgtggagcaagtacaacgccgaccagatcagaagaatgatggagaccttccagcagctgatcacctacaaggtgatcagcaacgagttcaacagcagaaacctggtgaacgacgacgacgccatcgtggccgccagcaagtgcctgaagatggtgtactacgccaacgtggtgggcggcgaggtggacaccaaccacaacgaggaggacgacgaggagcccatccccgagagcagcgagctgaccctgcaggagctgctgggcgaggagagaagaaacaagaagggccccagagtggaccccctggagaccgagctgggcgtgaagaccctggactgcagaaagcccctgatccccttcgaggagttcatcaacgagcccctgaacgaggtgctggagatggacaaggactacaccttcttcaaggtggagaccgagaacaagttcagcttcatgacctgccccttcatcctgaacgccgtgaccaagaacctgggcctgtactacgacaacagaatcagaatgtacagcgagagaagaatcaccgtgctgtacagcctggtgcagggccagcagctgaacccctacctgagactgaaggtgagaagagaccacatcatcgacgacgccctggtgagactggagatgatcgccatggagaaccccgccgacctgaagaagcagctgtacgtggagttcgagggcgagcagggcgtggacgagggcggcgtgagcaaggagttcttccagctggtggtggaggagatcttcaaccccgacatcggcatgttcacctacgacgagagcaccaagctgttctggttcaaccccagcagcttcgagaccgagggccagttcaccctgatcggcatcgtgctgggcctggccatctacaacaactgcatcctggacgtgcacttccccatggtggtgtacagaaagctgatgggcaagaagggcaccttcagagacctgggcgacagccaccccgtgctgtaccagagcctgaaggacctgctggagtacgagggcaacgtggaggacgacatgatgatcaccttccagatcagccagaccgacctgttcggcaaccccatgatgtacgacctgaaggagaacggcgacaagatccccatcaccaacgagaacagaaaggagttcgtgaacctgtacagcgactacatcctgaacaagagcgtggagaagcagttcaaggccttcagaagaggcttccacatggtgaccaacgagagccccctgaagtacctgttcagacccgaggagatcgagctgctgatctgcggcagcagaaacctggacttccaggccctggaggagaccaccgagtacgacggcggctacaccagagacagcgtgctgatcagagagttctgggagatcgtgcacagcttcaccgacgagcagaagagactgttcctgcagttcaccaccggcaccgacagagcccccgtgggcggcctgggcaagctgaagatgatcatcgccaagaacggccccgacaccgagagactgcccaccagccacacctgcttcaacgtgctgctgctgcccgagtacagcagcaaggagaagctgaaggagagactgctgaaggccatcacctacgccaagggcttcggcatgctgtag

SEQ ID NO: 104352 - DNA, 2559 bp, Artificial Sequence; identical to SEQ ID NO: 104351
  Description of Artificial Sequence: Synthetic coding sequence

SEQ ID NO: 104353 - DNA, 3252 bp, Artificial Sequence
  Description of Artificial Sequence: Synthetic coding sequence
atgttcagcttcgagggcgacttcaagaccagacccaaggtgagcctgggcggcgccagcagaaaggaggagaaggccagcctgctgcacagaacccaggaggagagaagaaagagagaggaggagagaagaagactgaagaacgccatcatcatccagagcttcatcagaggctacagagacagaaagcagcagtacagcatccagagaagcgccttcgacagatgcgccaccctgagccagagcggcggcgccttccccatcgccaacggccccaacctgaccctgctggtgagacagctgctgttcttctacaagcagaacgaggacagcaagagactgatctggctgtaccagaacctgatcaagcacagcagcctgttcgtgaagcagctggacggcagcgagagactgacctgcctgttccagatcaagagactgatgagcctgtgctgcagactgctgcagaactgcaacgacgacagcctgaacgtggccctgcccatgagaatgctggaggtgttcagcagcgagaacacctacctgcccgtgctgcaggacgccagctacgtggtgagcgtgatcgagcagatcctgcactacatgatccacaacggctactacagaagcctgtacctgctgatcaacagcaagctgcccagcagcatcgagtacagcgacctgagcagagtgcccatcgccaagatcctgctggagaacgtgctgaagcccctgcacttcacctacaacagctgccccgagggcgccagacagcaggtgttcaccgccttcaccgaggagttcctggccgcccccttcaccgaccagatcttccacttcatcatccccgccctggccgacgcccagaccgtgttcccctacgagcccttcctgaacgccctgctgctgatcgagagcagatgcagcagaaagagcggcggcgccccctggctgttctacttcgtgctgaccgtgggcgagaactacctgggcgccctgagcgaggagggcctgctggtgtacctgagagtgctgcagaccttcctgagccagctgcccgtgagccccgccagcgccagctgccacgacagcgccagcgacagcgaggaggagagcgaggaggccgacaagcccagcagccccgaggacggcagactgagcgtgagctacatcaccgaggagtgcctgaagaagctggacaccaagcagcagaccaacaccctgctgaacctggtgtggagagacagcgccagcgaggaggtgttcaccaccatggccagcgtgtgccacaccctgatggtgcagcacagaatgatggtgcccaaggtgagactgctgtacagcctggccttcaacgccagattcctgagacacctgtggttcctgatcagcagcatgagcaccagaatgatcaccggcagcatggtgcccctgctgcaggtgatcagcagaggcagccccatgagcttcgaggacagcagcagaatcatccccctgttctacctgttcagcagcctgttcagccacagcctgatcagcatccacgacaacgagttcttcggcgaccccatcgaggtggtgggccagagacagagcagcatgatgcccttcaccctggaggagctgatcatgctgagcagatgcctgagagacgcctgcctgggcatcatcaagctggcctaccccgagaccaagcccgaggtgagagaggagtacatcaccgccttccagagcatcggcgtgaccaccagcagcgagatgcagcagtgcatccagatggagcagaagagatggatccagctgttcaaggtgatcaccaacctggtgaagatgctgaagagcagagacaccagaagaaacttctgcccccccaaccactggctgagcgagcaggaggacatcaaggccgacaaggtgacccagctgtacgtgcccgccagcagacacgtgtggagattcagaagaatgggcagaatcggccccctgcagagcaccctggacgtgggcctggagagcccccccctgagcgtgagcgaggagagacagctggccgtgctgaccgagctgcccttcgtggtgcccttcgaggagagagtgaagatcttccagagactgatctacgccgacaagcaggaggtgcagggcgacggccccttcctggacggcatcaacgtgaccatcagaagaaactacatctacgaggacgcctacgacaagctgagccccgagaacgagcccgacctgaagaagagaatcagagtgcacctgctgaacgcccacggcctggacgaggccggcatcgacggcggcggcatcttcagagagttcctgaacgagctgctgaagagcggcttcaaccccaaccagggcttcttcaagaccaccaacgagggcctgctgtaccccaaccccgccgcccagatgctggtgggcgacagcttcgccagacactactacttcctgggcagaatgctgggcaaggccctgtacgagaacatgctggtggagctgcccttcgccggcttcttcctgagcaagctgctgggcaccagcgccgacgtggacatccaccacctggccagcctggaccccgaggtgtacaagaacctgctgttcctgaagagctacgaggacgacgtggaggagctgggcctgaacttcaccgtggtgaacaacgacctgggcgaggcccaggtggtggagctgaagttcggcggcaaggacatccccgtgaccagcgccaacagaatcgcctacatccacctggtggccgactacagactgaacagacagatcagacagcactgcctggccttcagacagggcctggccaacgtggtgagcctggagtggctgagaatgttcgaccagcaggagatccaggtgctgatcagcggcgcccaggtgcccatcagcctggaggacctgaagagcttcaccaactacagcggcggctacagcgccgaccaccccgtgatcaaggtgttctggagagtggtggagggcttcaccgacgaggagaagagaaagctgctgaagttcgtgaccagctgcagcagaccccccctgctgggcttcaaggagctgtaccccgccttctgcatccacaacggcggcagcgacctggagagactgcccaccgccagcacctgcatgaacctgctgaagctgcccgagttctacgacgagaccctgctgagaagcaagctgctgtacgccatcgagtgcgccgccggcttcgagctgagctag

SEQ ID NO: 104354 - DNA, 1215 bp, Artificial Sequence
  Description of Artificial Sequence: Synthetic coding sequence
atgttcagcttcgagggcgacttcaagaccagacccaaggtgagcctgggcggcgccagcagaaagtacagcatccagagaagcgccttcgacagatgcgccaccctgagccagagcggcggcgccttccccatcgccaacggccccaacctgaccctgctggtgagacagctgctgttcttctacaagcagaacgaggacagcaagagactgatctggctgtaccagaacctgatcaagcacagcagcctgttcgtgaagcagctggacggcagcgagagactgacctgcctgttccagatcaagagactgatgagcctgtgctgcagactgctgcagaactgcaacgacgacagcctgaacgtggccctgcccatgagaatgctggaggtgttcagcagcgagaacacctacctgcccgtgctgcaggacgccagctacgtggtgagcgtgatcgagcagatcctgcactacatgatccacaacggctactacagaagcctgtacctgctgatcaacagcaagctgcccagcagcatcgagtacagcgacctgagcagagtgcccatcgccaagatcctgctggagaacgtgctgaagcccctgcacttcacctacaacagctgccccgagggcgccagacagcaggtgttcaccgccttcaccgaggagttcctggccgcccccttcaccgaccagatcttccacttcatcatccccgccctggccgacgcccagaccgtgttcccctacgagcccttcctgaacgccctgctgctgatcgagagcagatgcagcagaaagagcggcggcgccccctggctgttctacttcgtgctgaccgtgggcgagaactacctgggcgccctgagcgaggagggcctgctggtgtacctgagagtgctgcagaccttcctgagccagctgcccgtgagccccgccagcgccagctgccacgacagcgccagcgacagcgaggaggagagcgaggaggccgacaagcccagcagccccgaggacggcagactgagcgtgagctacatcaccgaggagtgcctgaagaagctggacaccaagcagcagaccaacaccctgctgaacctggtgtggagagacagcgccagcgaggaggtgttcaccaccatggccagcgtgtgccacaccctgatggtgcagcacagaatgatggtgcccaaggtgagagtgtacaagtag

SEQ ID NO: 104355 - DNA, 192 bp, Artificial Sequence
  Description of Artificial Sequence: Synthetic coding sequence
atggccgcccccctgagcgtggaggtggagttcggcagcagccccggctgcctgttcctgtggagcagcttcgccgaggtggtgagaagcagctgcctgaccgtgctgagaaacatcgagagcctgtgcctggacagaagaaaccccggcaccagcggcacctgcagcagcggcagcagaagaatctgctag

SEQ ID NO: 104356 - DNA, 192 bp, Artificial Sequence
  Description of Artificial Sequence: Synthetic coding sequence
atggccgcccccctgagcgtggaggtggagttcggcggcggcgccgagctgctgttcgacggcatcaagaagcacagagtgaccctgcccggccaggaggagccctgggacatcagaaacctgctgatctggatcaagaagaacctgctgaaggagagacccgagctgttcatccagggcgacagcgtgtag

SEQ ID NO: 104357 - DNA, 306 bp, Artificial Sequence
  Description of Artificial Sequence: Synthetic coding sequence
atggccgcccccctgagcgtggaggtggagttcggcggcggcgccgagctgctgttcgacggcatcaagaagcacagagtgaccctgcccggccaggaggagccctgggacatcagaaacctgctgatctggatcaagaagaacctgctgaaggagagacccgagctgttcatccagggcgacagcgtgagacccggcatcctggtgctgatcaacgacgccgactgggagctgctgggcgagctggactaccagctgcaggaccaggacagcgtgctgttcatcagcaccctgcacggcggctag

SEQ ID NO: 104358 - DNA, 441 bp, Artificial Sequence
  Description of Artificial Sequence: Synthetic coding sequence
atggccgcccccctgagcgtggaggtggagttcggcggcggcgccgagctgctgttcgacggcatcaagaagcacagagtgaccctgcccggccaggaggagccctgggacatcagaaacctgctgatctggatcaagaagaacctgctgaaggagagacccgagctgttcatccagggcgacagcgtgagacccggcatcctggtgctgatcaacgacgccgactgggagctgctggtgagcaccctgggcgacatccccccccccgcccccgccctggccgccagcgtgggcaagagatgggccagcccccaggcccacatcgagtggctgggcaacccccccccccacagcagccccaccctgagactgctggagagccccacccccggcgaggagggcatgggcagctggggccacggcagcaccccccccagctag

SEQ ID NO: 104359 - DNA, 2358 bp, Artificial Sequence
  Description of Artificial Sequence: Synthetic coding sequence
atgcccggcgtgatccccagcgagagcaacggcctgagcagaggcagccccagcaagaagaacagactgagcctgaagttcttccagaagaaggagaccaagagagccctggacttcaccgacagccaggagaacgaggagaaggccagcgagtacagagccagcgagatcgaccaggtggtgcccgccgcccagagcagccccatcaactgcgagaagagagagaacctgctgcccttcgtgggcctgaacaacctgggcaacacctgctacctgaacagcatcctgcaggtgctgtacttctgccccggcttcaagagcggcgtgaagcacctgttcaacatcatcagcagaaagaaggaggccctgaaggacgaggccaaccagaaggacaagggcaactgcaaggaggacagcctggccagctacgagctgatctgcagcctgcagagcctgatcatcagcgtggagcagctgcaggccagcttcctgctgaaccccgagaagtacaccgacgagctggccacccagcccagaagactgctgaacaccctgagagagctgaaccccatgtacgagggctacctgcagcacgacgcccaggaggtgctgcagtgcatcctgggcaacatccaggagacctgccagctgctgaagaaggaggaggtgaagaacgtggccgagctgcccaccaaggtggaggagatcccccaccccaaggaggagatgaacggcatcaacagcatcgagatggacagcatgagacacagcgaggacttcaaggagaagctgcccaagggcaacggcaagagaaagagcgacaccgagttcggcaacatgaagaagaaggtgaagctgagcaaggagcaccagagcctggaggagaaccagagacagaccagaagcaagagaaaggccaccagcgacaccctggagagcccccccaagatcatccccaagtacatcagcgagaacgagagccccagacccagccagaagaagagcagagtgaagatcaactggctgaagagcgccaccaagcagcccagcatcctgagcaagttctgcagcctgggcaagatcaccaccaaccagggcgtgaagggccagagcaaggagaacgagtgcgaccccgaggaggacctgggcaagtgcgagagcgacaacaccaccaacggctgcggcctggagagccccggcaacaccgtgacccccgtgaacgtgaacgaggtgaagcccatcaacaagggcgaggagcagatcggcttcgagctggtggagaagctgttccagggccagctggtgctgagaaccagatgcctggagtgcgagagcctgaccgagagaagagaggacttccaggacatcagcgtgcccgtgcaggaggacgagctgagcaaggtggaggagagcagcgagatcagccccgagcccaagaccgagatgaagaccctgagatgggccatcagccagttcgccagcgtggagagaatcgtgggcgaggacaagtacttctgcgagaactgccaccactacaccgaggccgagagaagcctgctgttcgacaagatgcccgaggtgatcaccatccacctgaagtgcttcgccgccagcggcctggagttcgactgctacggcggcggcctgagcaagatcaacacccccctgctgacccccctgaagctgagcctggaggagtggagcaccaagcccaccaacgacagctacggcctgttcgccgtggtgatgcacagcggcatcaccatcagcagcggccactacaccgccagcgtgaaggtgaccgacctgaacagcctggagctggacaagggcaacttcgtggtggaccagatgtgcgagatcggcaagcccgagcccctgaacgaggaggaggccagaggcgtggtggagaactacaacgacgaggaggtgagcatcagagtgggcggcaacacccagcccagcaaggtgctgaacaagaagaacgtggaggccatcggcctgctgggcggccagaagagcaaggccgactacgagctgtacaacaaggccagcaaccccgacaaggtggccagcaccgccttcgccgagaacagaaacagcgagaccagcgacaccaccggcacccacgagagcgacagaaacaaggagagcagcgaccagaccggcatcaacatcagcggcttcgagaacaagatcagctacgtggtgcagagcctgaaggagtacgagggcaagtggctgctgttcgacgacagcgaggtgaaggtgaccgaggagaaggacttcctgaacagcctgagccccagcaccagccccaccagcaccccctacctgctgttctacaagaagctgtag

SEQ ID NO: 104360 - DNA, 2358 bp, Artificial Sequence; identical to SEQ ID NO: 104359
  Description of Artificial Sequence: Synthetic coding sequence

SEQ ID NO: 104361 - DNA, 264 bp, Artificial Sequence
  Description of Artificial Sequence: Synthetic coding sequence
atgcccggcgtgatccccagcgagagcaacggcctgagcagaggcagccccagcaagaagaacagactgagcctgaagttcttccagaagaaggagaccaagagagccctggacttcaccgacagccaggagaacgaggagaaggccagcgagtacagagccagcgagatcgaccaggtggtgcccgccgcccagagcagccccatcaactgcgagaagagagagaacctgctgcccttcgtgggcctgaacaacctgggctag

SEQ ID NO: 104362 - DNA, 561 bp, Artificial Sequence
  Description of Artificial Sequence: Synthetic coding sequence
atgcccggcgtgatccccagcgagagcaacggcctgagcagaggcagccccagcaagaagaacagactgagcctgaagttcttccagaagaaggagaccaagagagccctggacttcaccgacagccaggagaacgaggagaaggccagcgagtacagagccagcgagatcgaccaggtggtgcccgccgcccagagcagccccatcaactgcgagaagagagagaacctgctgcccttcgtgggcctgaacaacctgggcaacacctgctacctgaacagcatcctgcaggtgctgtacttctgccccggcttcaagagcggcgtgaagcacctgttcaacatcatcagcagaaagaaggaggccctgaaggacgaggccaaccagaaggacaagggcaactgcaaggaggacagcctggccagctacgagctgatctgcagcctgcagagcctgatcatcagcgtggagcagctgcaggccagcttcctgctgaaccccgagaagtacaccgacgagctggccacccagcccagaagactgctgaacaccctgagatag

SEQ ID NO: 104363 - DNA, 663 bp, Artificial Sequence
  Description of Artificial Sequence: Synthetic coding sequence
atgcccctgaccggcgtgggccccggcagctgcagaagacagatcatcagagccctgtgcctgctgctgctgctgctgcacgccggcagcgccaagaacatctggaagagagccctgcccgccagactggccgagaagagcagagccgaggaggccggcgcccccggcggccccagacagcccagagccgacagatgcccccccccccccagaaccctgccccccggcgcctgccaggccgccagatgccaggccgacagcgagtgccccagacacagaagatgctgctacaacggctgcgcctacgcctgcctggaggccgtgccccccccccccgtgctggactggctggtgcagcccaagcccagatggctgggcggcaacggctggctgctggacggccccgaggaggtgctgcaggccgaggcctgcagcaccaccgaggacggcgccgagcccctgctgtgccccagcggctacgagtgccacatcctgagccccggcgacgtggccgagggcatccccaacagaggccagtgcgtgaagcagagaagacaggccgacggcagaatcctgagacacaagctgtacaaggagtaccccgagggcgacagcaagaacgtggccgagcccggcagaggccagcagaagcacttccagtag

SEQ ID NO: 104364 - DNA, 687 bp, Artificial Sequence
  Description of Artificial Sequence: Synthetic coding sequence
atgtaccacctgatgaagttcatccccctgtacagcaaggtgcagagaccctgcaccagcacccccatgatcgacagcttcgtgagactgatgaacgagttcaccaacatgcccgtgccccccaagcccagacaggccctgggcgacaagatcgtgagagacatcagacccggcgccgccttcgagcccacctacatctacagactgctgaccgtgaacaagagcagcctgagcgagaagggcagacaggaggacgccgaggagtacctgggcttcatcctgaacggcctgcacgaggagatgctgaacctgaagaagctgctgagccccagcaacgagaagctgaccatcagcaacggccccaagaaccacagcgtgaacgaggaggagcaggaggagcagggcgagggcagcgaggacgagtgggagcaggtgggccccagaaacaagaccagcgtgaccagacaggccgacttcgtgcagacccccatcaccggcttctggtggacccaccaggtgtgcggcctgcccgccgagttcaagagaatctgccacttcgccgccatcttccacgtggccgtgggctaccccgtgagacaggacacccacagccccggctgcaccggcgagctgggcggcaagagaatctgccccagactgtaccacaagaaccagaccagaggctag

SEQ ID NO: 104365 - DNA, 189 bp, Artificial Sequence
  Description of Artificial Sequence: Synthetic coding sequence
atggccctgcacagcccccagtacatcttcggcgacttcagccccgacgagttcaaccagttcttcgtgacccccagaagcagcgtggaggacaagaacatcagagagctgagcctggtgagcatgaagagcctgaaccccgtgaccctgtgcagagagccccccgccaccgtgttccaggcccactag

SEQ ID NO: 104366 - DNA, 2472 bp, Artificial Sequence
  Description of Artificial Sequence: Synthetic coding sequence
atgaagagacacagacccgtgagcagcagcgacagcagcgacgagagccccagcaccagcttcaccagcggcagcatgtacagaatcaagagcaagatccccaacgagcacaagaagcccgccgaggtgttcagaaaggacctgatcagcgccatgaagctgcccgacagccaccacatcaaccccgacagctactacctgttcgccgacacctggaaggaggagtgggagaagggcgtgcaggtgcccgccagccccgacaccgtgccccagcccagcctgagaatcatcgccgagaaggtgaaggacgtgctgttcatcagacccagaaagtacatccactgcagcagccccgacaccaccgagcccggctacatcaacatcatggagctggccgccagcgtgtgcagatacgacctggacgacatggacatcttctggctgcaggagctgaacgaggacctggccgagatgggctgcggccccgtggacgagaacctgatggagaagaccgtggaggtgctggagagacactgccacgagaacatgaaccacgccatcgagaccgaggagggcctgggcatcgagtacgacgaggacgtgatctgcgacgtgtgcagaagccccgacagcgaggagggcaacgacatggtgttctgcgacaagtgcaacgtgtgcgtgcaccaggcctgctacggcatcctgaaggtgcccgagggcagctggctgtgcagaagctgcgtgctgggcatctacccccagtgcgtgctgtgccccaagaagggcggcgccctgaagaccaccaagaccggcaccaagtgggcccacgtgagctgcgccctgtggatccccgaggtgagcatcgcctgccccgagagaatggagcccatcaccaagatcagccacatcccccccagcagatgggccctggtgtgcaacctgtgcaagctgaagaccggcgcctgcatccagtgcagcatcaagagctgcatcaccgccttccacgtgacctgcgccttcgagcacggcctggagatgaagaccatcctggacgagggcgacgaggtgaagttcaagagctactgcctgaagcacagccagaacagacagaagctgggcgaggccgagtacccccaccacagagccaaggagcagagccaggccaagagcgagaagaccagcctgagagcccagaagctgagagagctggaggaggagttctacagcctggtgagagtggaggacgtggccgccgagctgggcatgcccaccctggccgtggacttcatctacaactactggaagctgaagagaaagagcaacttcaacaagcccctgttcccccccaaggaggacgaggagaacggcctggtgcagcccaaggaggagagcatccacaccagaatgagaatgttcatgcacctgagacaggacctggagagagtgagaaacctgtgctacatgatcagcagaagagagaagctgaagctgagccacaacaagatccaggagcagatcttcggcctgcaggtgcagctgctgaaccaggagatcgacgccggcctgcccctgaccaacgccctggagaacagcctgttctaccccccccccagaatcaccctgaagctgaagatgcccaagagcacccccgaggaccacagaaacagcagcaccgagaccgaccagcagccccacagccccgacagcagcagcagcgtgcacagcatcagaaacatgcaggtgccccaggagagcctggagatgagaaccaagagctaccccagataccccctggagagcaagaacaacagactgctggccagcctgagccacagcagaagcgaggccaaggagagcagccccgcctggagaacccccagcagcgagtgctaccacggccagagcctgggcaagcccctggtgctgcaggccgccctgcacggccagagcagcatcggcaacggcaagagccagcccaacagcaagttcgccaagagcaacggcctggagggcagctggagcggcaacgtgacccagaaggacagcagcagcgagatgttctgcgaccaggagcccgtgttcagcccccacctggtgagccagggcagcttcagaaagagcaccgtggagcacttcagcagaagcttcaaggagaccaccaacagatgggtgaagaacaccgaggacctgcagtgctacgtgaagcccaccaagaacatgagccccaaggagcagttctggggcagacaggtgctgagaagaagcgccggcagagccccctaccaggagaacgacggctactgccccgacctggagctgagcgacagcgaggccgagagcgacggcaacaaggagaaggtgagagtgagaaaggacagcagcgacagagagaaccccccccacgacagcagaagagactgccacggcaagagcaagacccaccccctgagccacagcagcatgcagagatag

SEQ ID NO: 104367 - DNA, 2763 bp, Artificial Sequence
  Description of Artificial Sequence: Synthetic coding sequence
atggccaccgtggccgccaaccccgccgccgccgccgccgccgtggccgccgccgccgccgtgaccgaggacagagagccccagcacgaggagctgcccggcctggacagccagtggagacagatcgagaacggcgagagcggcagagagagacccctgagagccggcgagagctggttcctggtggagaagcactggtacaagcagtgggaggcctacgtgcagggcggcgaccaggacagcagcaccttccccggctgcatcaacaacgccaccctgttccaggacgagatcaactggagactgaaggagggcctggtggagggcgaggactacgtgctgctgcccgccgccgcctggcactacctggtgagctggtacggcctggagcacggccagccccccatcgagagaaaggtgatcgagctgcccaacatccagaaggtggaggtgtaccccgtggagctgctgctggtgagacacaacgacctgggcaagagccacaccgtgcagttcagccacaccgacagcatcggcctggtgctgagaaccgccagagagagattcctggtggagccccaggaggacaccagactgtgggccaagaacagcgagggcagcctggacagactgtacgacacccacatcaccgtgctggacgccgccctggagaccggccagctgatcatcatggagaccagaaagaaggacggcacctggcccagcgcccagctgcacgtgatgaacaacaacatgagcgaggaggacgaggacttcaagggccagcccggcatctgcggcctgaccaacctgggcaacacctgcttcatgaacagcgccctgcagtgcctgagcaacgtgccccagctgaccgagtacttcctgaacaactgctacctggaggagctgaacttcagaaaccccctgggcatgaagggcgagatcgccgaggcctacgccgacctggtgaagcaggcctggagcggccaccacagaagcatcgtgccccacgtgttcaagaacaaggtgggccacttcgccagccagttcctgggctaccagcagcacgacagccaggagctgctgagcttcctgctggacggcctgcacgaggacctgaacagagtgaagaagaaggagtacgtggagctgtgcgacgccgccggcagacccgaccaggaggtggcccaggaggcctggcagaaccacaagagaagaaacgacagcgtgatcgtggacaccttccacggcctgttcaagagcaccctggtgtgccccgactgcggcaacgtgagcgtgaccttcgaccccttctgctacctgagcgtgcccctgcccatcagccacaagagagtgctggaggtgttcttcatccccatggaccccagaagaaagcccgagcagcacagactggtggtgcccaagaagggcaagatcagcgacctgtgcgtggccctgagcaagcacaccggcatcagccccgagagaatgatggtggccgacgtgttcagccacagattctacaagctgtaccagctggaggagcccctgagcagcatcctggacagagacgacatcttcgtgtacgaggtgagcggcagaatcgaggccatcgagggcagcagagaggacatcgtggtgcccgtgtacctgagagagagaacccccgccagagactacaacaacagctactacggcctgatgctgttcggccaccccctgctggtgagcgtgcccagagacagattcacctgggagggcctgtacaacgtgctgatgtacagactgagcagatacgtgaccaagcccaacagcgacgacgaggacgacggcgacgagaaggaggacgacgaggaggacaaggacgacgtgcccggccccagcaccggcggcagcctgagagaccccgagcccgagcaggccggccccagcagcggcgtgaccaacagatgccccttcctgctggacaactgcctgggcaccagccagtggccccccagaagaagaagaaagcagctgttcaccctgcagaccgtgaacagcaacggcaccagcgacagaaccaccagccccgaggaggtgcacgcccagccctacatcgccatcgactgggagcccgagatgaagaagagatactacgacgaggtggaggccgagggctacgtgaagcacgactgcgtgggctacgtgatgaagaaggcccccgtgagactgcaggagtgcatcgagctgttcaccaccgtggagaccctggagaaggagaacccctggtactgccccagctgcaagcagcaccagctggccaccaagaagctggacctgtggatgctgcccgagatcctgatcatccacctgaagagattcagctacaccaagttcagcagagagaagctggacaccctggtggagttccccatcagagacctggacttcagcgagttcgtgatccagccccagaacgagagcaaccccgagctgtacaagtacgacctgatcgccgtgagcaaccactacggcggcatgagagacggccactacaccaccttcgcctgcaacaaggacagcggccagtggcactacttcgacgacaacagcgtgagccccgtgaacgagaaccagatcgagagcaaggccgcctacgtgctgttctaccagagacaggacgtggccagaagactgctgagccccgccggcagcagcggcgcccccgccagccccgcctgcagcagcccccccagcagcgagttcatggacgtgaactag

SEQ ID NO: 104368 - DNA, 1113 bp, Artificial Sequence
  Description of Artificial Sequence: Synthetic coding sequence
atggagatcctgatgaccgtgagcaagttcgccagcatctgcaccatgggcgccaacgccagcgccctggagaaggagatcggccccgagcagttccccgtgaacgagcactacttcggcctggtgaacttcggcaacacctgctactgcaacagcgtgctgcaggccctgtacttctgcagacccttcagagagaaggtgctggcctacaagagccagcccagaaagaaggagagcctgctgacctgcctggccgacctgttccacagcatcgccacccagaagaagaaggtgggcgtgatcccccccaagaagttcatcaccagactgagaaaggagaacgagctgttcgacaactacatgcagcaggacgcccacgagttcctgaactacctgctgaacaccatcgccgacatcctgcaggaggagagaaagcaggagaagcagaacggcagactgcccaacggcaacatcgacaacgagaacaacaacagcacccccgaccccacctgggtgcacgagatcttccagggcaccctgaccaacgagaccagatgcctgacctgcgagaccatcagcagcaaggacgaggacttcctggacctgagcgtggacgtggagcagaacaccagcatcacccactgcctgagaggcttcagcaacaccgagaccctgtgcagcgagtacaagtactactgcgaggagtgcagaagcaagcaggaggcccacaagagaatgaaggtgaagaagctgcccatgatcctggccctgcacctgaagagattcaagtacatggaccagctgcacagatacaccaagctgagctacagagtggtgttccccctggagctgagactgttcaacaccagcggcgacgccaccaaccccgacagaatgtacgacctggtggccgtggtggtgcactgcggcagcggccccaacagaggccactacatcgccatcgtgaagagccacgacttctggctgctgttcgacgacgacatcgtggagaagatcgacgcccaggccatcgaggagttctacggcctgaccagcgacatcagcaagaacagcgagagcggctacatcctgttctaccagagcagagactag

SEQ ID NO: 104369 - DNA, 2592 bp, Artificial Sequence
  Description of Artificial Sequence: Synthetic coding sequence
atgcagagaagaggcgccctgttcggcatgcccggcggcagcggcggcagaaagatggccgccggcgacatcggcgagctgctggtgccccacatgcccaccatcagagtgcccagaagcggcgacagagtgtacaagaacgagtgcgccttcagctacgacagccccaacagcgagggcggcctgtacgtgtgcatgaacaccttcctggccttcggcagagagcacgtggagagacacttcagaaagaccggccagagcgtgtacatgcacctgaagagacacgtgagagagaaggtgagaggcgccagcggcggcgccctgcccaagagaagaaacagcaagatcttcctggacctggacaccgacgacgacctgaacagcgacgactacgagtacgaggacgaggccaagctggtgatcttccccgaccactacgagatcgccctgcccaacatcgaggagctgcccgccctggtgaccatcgcctgcgacgccgtgctgagcagcaagagcccctacagaaagcaggaccccgacacctgggagaacgagctgcccgtgagcaagtacgccaacaacctgacccagctggacaacggcgtgagaatcccccccagcggctggaagtgcgccagatgcgacctgagagagaacctgtggctgaacctgaccgacggcagcgtgctgtgcggcaagtggttcttcgacagcagcggcggcaacggccacgccctggagcactacagagacatgggctaccccctggccgtgaagctgggcaccatcacccccgacggcgccgacgtgtacagcttccaggaggaggagcccgtgctggacccccacctggccaagcacctggcccacttcggcatcgacatgctgcacatgcacggcaccgagaacggcctgcaggacaacgacatcaagctgagagtgagcgagtgggaggtgatccaggagagcggcaccaagctgaagcccatgtacggccccggctacaccggcctgaagaacctgggcaacagctgctacctgagcagcgtgatgcaggccatcttcagcatccccgagttccagagagcctacgtgggcaacctgcccagaatcttcgactacagccccctggaccccacccaggacttcaacacccagatgaccaagctgggccacggcctgctgagcggccagtacagcaagccccccgtgaagagcgagctgatcgagcaggtgatgaaggaggagcacaagccccagcagaacggcatcagccccagaatgttcaaggccttcgtgagcaagagccaccccgagttcagcagcaacagacagcaggacgcccaggagttcttcctgcacctggtgaacctggtggagagaaacagaatcggcagcgagaaccccagcgacgtgttcagattcctggtggaggagagaatccagtgctgccagaccagaaaggtgagatacaccgagagagtggactacctgatgcagctgcccgtggccatggaggccgccaccaacaaggacgagctgatcgcctacgagctgaccagaagagaggccgaggccaacagaagacccctgcccgagctggtgagagccaagatccccttcagcgcctgcctgcaggccttcagcgagcccgagaacgtggacgacttctggagcagcgccctgcaggccaagagcgccggcgtgaagaccagcagattcgccagcttccccgagtacctggtggtgcagatcaagaagttcaccttcggcctggactgggtgcccaagaagttcgacgtgagcatcgacatgcccgacctgctggacatcaaccacctgagagccagaggcctgcagcccggcgaggaggagctgcccgacatcagcccccccatcgtgatccccgacgacagcaaggacagactgatgaaccagctgatcgaccccagcgacatcgacgagagcagcgtgatgcagctggccgagatgggcttccccctggaggcctgcagaaaggccgtgtacttcaccggcaacatgggcgccgaggtggccttcaactggatcatcgtgcacatggaggagcccgacttcgccgagcccctgaccatgcccggctacggcggcgccgccagcgccggcgccagcgtgttcggcgccagcggcctggacaaccagccccccgaggagatcgtggccatcatcaccagcatgggcttccagagaaaccaggccatccaggccctgagagccaccaacaacaacctggagagagccctggactggatcttcagccaccccgagttcgaggaggacagcgacttcgtgatcgagatggagaacaacgccaacgccaacatcatcagcgaggccaagcccgagggccccagagtgaaggacggcagcggcacctacgagctgttcgccttcatcagccacatgggcaccagcaccatgagcggccactacatctgccacatcaagaaggagggcagatgggtgatctacaacgaccacaaggtgtgcgccagcgagagaccccccaaggacctgggctacatgtacttctacagaagaatccccagctag

SEQ ID NO: 104370 - DNA, 1485 bp, Artificial Sequence
  Description of Artificial Sequence: Synthetic coding sequence
atgcccctgtacagcgtgaccgtgaagtggggcaaggagaagttcgagggcgtggagctgaacaccgacgagccccccatggtgttcaaggcccagctgttcgccctgaccggcgtgcagcccgccagacagaaggtgatggtgaagggcggcaccctgaaggacgacgactggggcaacatcaagatcaagaacggcatgaccctgctgatgatgggcagcgccgacgccctgcccgaggagcccagcgccaagaccgtgttcgtggaggacatgaccgaggagcagctggccagcgccatggagctgccctgcggcctgaccaacctgggcaacacctgctacatgaacgccaccgtgcagtgcatcagaagcgtgcccgagctgaaggacgccctgaagagatacgccggcgccctgagagccagcggcgagatggccagcgcccagtacatcaccgccgccctgagagacctgttcgacagcatggacaagaccagcagcagcatcccccccatcatcctgctgcagttcctgcacatggccttcccccagttcgccgagaagggcgagcagggccagtacctgcagcaggacgccaacgagtgctggatccagatgatgagagtgctgcagcagaagctggaggccatcgaggacgacagcgtgaaggagaccgacagcagcagcgccagcgccgccacccccagcaagaagaagagcctgatcgaccagttcttcggcgtggagttcgagaccaccatgaagtgcaccgagagcgaggaggaggaggtgaccaagggcaaggagaaccagctgcagctgagctgcttcatcaaccaggaggtgaagtacctgttcaccggcctgaagctgagactgcaggaggagatcaccaagcagagccccaccctgcagagaaacgccctgtacatcaagagcagcaagatcagcagactgcccgcctacctgaccatccagatggtgagattcttctacaaggagaaggagagcgtgaacgccaaggtgctgaaggacgtgaagttccccctgatgctggacatgtacgagctgtgcacccccgagctgcaggagaagatggtgagcttcagaagcaagttcaaggacctggaggacaagaaggtgaaccagcagcccaacaccagcgacaagaagagcagcccccagaaggaggtgaagtacgagcccttcagcttcgccgacgacatcggcagcaacaactgcggctactacgacctgcaggccgtgctgacccaccagggcagaagcagcagcagcggccactacgtgagctgggtgaagagaaagcaggacgagtggatcaagttcgacgacgacaaggtgagcatcgtgacccccgaggacatcctgagactgagcggcggcggcgactggcacatcgcctacgtgctgctgtacggccccagaagagtggagatcatggaggaggagagcgagcagtag

SEQ ID NO: 104371 - DNA, 1380 bp, Artificial Sequence
  Description of Artificial Sequence: Synthetic coding sequence
atgcccctgtacagcgtgaccgtgaagtggggcaaggagaagttcgagggcgtggagctgaacaccgacgagccccccatggtgttcaaggcccagctgttcgccctgaccggcgtgcagcccgccagacagaaggtgatggtgaagggcggcaccctgaaggacgacgactggggcaacatcaagatcaagaacatggagctgccctgcggcctgaccaacctgggcaacacctgctacatgaacgccaccgtgcagtgcatcagaagcgtgcccgagctgaaggacgccctgaagagatacgccggcgccctgagagccagcggcgagatggccagcgcccagtacatcaccgccgccctgagagacctgttcgacagcatggacaagaccagcagcagcatcccccccatcatcctgctgcagttcctgcacatggccttcccccagttcgccgagaagggcgagcagggccagtacctgcagcaggacgccaacgagtgctggatccagatgatgagagtgctgcagcagaagctggaggccatcgaggacgacagcgtgaaggagaccgacagcagcagcgccagcgccgccacccccagcaagaagaagagcctgatcgaccagttcttcggcgtggagttcgagaccaccatgaagtgcaccgagagcgaggaggaggaggtgaccaagggcaaggagaaccagctgcagctgagctgcttcatcaaccaggaggtgaagtacctgttcaccggcctgaagctgagactgcaggaggagatcaccaagcagagccccaccctgcagagaaacgccctgtacatcaagagcagcaagatcagcagactgcccgcctacctgaccatccagatggtgagattcttctacaaggagaaggagagcgtgaacgccaaggtgctgaaggacgtgaagttccccctgatgctggacatgtacgagctgtgcacccccgagctgcaggagaagatggtgagcttcagaagcaagttcaaggacctggaggacaagaaggtgaaccagcagcccaacaccagcgacaagaagagcagcccccagaaggaggtgaagtacgagcccttcagcttcgccgacgacatcggcagcaacaactgcggctactacgacctgcaggccgtgctgacccaccagggcagaagcagcagcagcggccactacgtgagctgggtgaagagaaagcaggacgagtggatcaagttcgacgacgacaaggtgagcatcgtgacccccgaggacatcctgagactgagcggcggcggcgactggcacatcgcctacgtgctgctgtacggccccagaagagtggagatcatggaggaggagagcgagcagtag

SEQ ID NO: 104372 - DNA, 1452 bp, Artificial Sequence
  Description of Artificial Sequence: Synthetic coding sequence
atgcccctgtacagcgtgaccgtgaagtggggcaaggagaagttcgagggcgtggagctgaacaccgacgagccccccatggtgttcaaggcccagctgttcgccctgaccggcgtgcagcccgccagacagaaggtgatggtgaagggcggcaccctgaagggcatgaccctgctgatgatgggcagcgccgacgccctgcccgaggagcccagcgccaagaccgtgttcgtggaggacatgaccgaggagcagctggccagcgccatggagctgccctgcggcctgaccaacctgggcaacacctgctacatgaacgccaccgtgcagtgcatcagaagcgtgcccgagctgaaggacgccctgaagagatacgccggcgccctgagagccagcggcgagatggccagcgcccagtacatcaccgccgccctgagagacctgttcgacagcatggacaagaccagcagcagcatcccccccatcatcctgctgcagttcctgcacatggccttcccccagttcgccgagaagggcgagcagggccagtacctgcagcaggacgccaacgagtgctggatccagatgatgagagtgctgcagcagaagctggaggccatcgaggacgacagcgtgaaggagaccgacagcagcagcgccagcgccgccacccccagcaagaagaagagcctgatcgaccagttcttcggcgtggagttcgagaccaccatgaagtgcaccgagagcgaggaggaggaggtgaccaagggcaaggagaaccagctgcagctgagctgcttcatcaaccaggaggtgaagtacctgttcaccggcctgaagctgagactgcaggaggagatcaccaagcagagccccaccctgcagagaaacgccctgtacatcaagagcagcaagatcagcagactgcccgcctacctgaccatccagatggtgagattcttctacaaggagaaggagagcgtgaacgccaaggtgctgaaggacgtgaagttccccctgatgctggacatgtacgagctgtgcacccccgagctgcaggagaagatggtgagcttcagaagcaagttcaaggacctggaggacaagaaggtgaaccagcagcccaacaccagcgacaagaagagcagcccccagaaggaggtgaagtacgagcccttcagcttcgccgacgacatcggcagcaacaactgcggctactacgacctgcaggccgtgctgacccaccagggcagaagcagcagcagcggccactacgtgagctgggtgaagagaaagcaggacgagtggatcaagttcgacgacgacaaggtgagcatcgtgacccccgaggacatcctgagactgagcggcggcggcgactggcacatcgcctacgtgctgctgtacggccccagaagagtggagatcatggaggaggagagcgagcagtag

SEQ ID NO: 104373 - DNA, 1380 bp, Artificial Sequence; identical to SEQ ID NO: 104371
  Description of Artificial Sequence: Synthetic coding sequence

SEQ ID NO: 104374 - DNA, 2382 bp, Artificial Sequence
  Description of Artificial Sequence: Synthetic coding sequence
atgcccgccggccccgtgcaggccgtgcccccccccccccccgtgcccaccgagcccaagcagcccaccgaggaggaggccagcagcaaggaggacagcgcccccagcaagcccgtggtgggcatcatctaccccccccccgaggtgagaaacatcgtggacaagaccgccagcttcgtggccagaaacggccccgagttcgaggccagaatcagacagaacgagatcaacaaccccaagttcaacttcctgaaccccaacgacccctaccacgcctactacagacacaaggtgagcgagttcaaggagggcaaggcccaggagcccagcgccgccatccccaaggtgatgcagcagcagcagcagaccacccagcagcagctgccccagaaggtgcaggcccaggtgatccaggagaccatcgtgcccaaggagcccccccccgagttcgagttcatcgccgacccccccagcatcagcgccttcgacctggacgtggtgaagctgaccgcccagttcgtggccagaaacggcagacagttcctgacccagctgatgcagaaggagcagagaaactaccagttcgacttcctgagaccccagcacagcctgttcaactacttcaccaagctggtggagcagtacaccaagatcctgatcccccccaagggcctgttcagcaagctgaagaaggaggccgagaaccccagagaggtgctggaccaggtgtgctacagagtggagtgggccaagttccaggagagagagagaaagaaggaggaggaggagaaggagaaggagagagtggcctacgcccagatcgactggcacgacttcgtggtggtggagaccgtggacttccagcccaacgagcagggcaacttccccccccccaccacccccgaggagctgggcgccagaatcctgatccaggagagatacgagaagttcggcgagagcgaggaggtggagatggaggtggagagcgacgaggaggacgacaagcaggagaaggccgaggagccccccagccagctggaccaggacacccaggtgcaggacatggacgagggcagcgacgacgaggaggagggccagaaggtgccccccccccccgagacccccatgcccccccccctgccccccacccccgaccaggtgatcgtgagaaaggactacgaccccaaggccagcaagcccctgccccccgcccccgcccccgacgagtacctggtgagccccatcaccggcgagaagatccccgccagcaagatgcaggagcacatgagaatcggcctgctggaccccagatggctggagcagagagacagaagcatcagagagaagcagagcgacgacgaggtgtacgcccccggcctggacatcgagagcagcctgaagcagctggccgagagaagaaccgacatcttcggcgtggaggagaccgccatcggcaagaagatcggcgaggaggagatccagaagcccgaggagaaggtgacctgggacggccacagcggcagcatggccagaacccagcaggccgcccaggccaacatcaccctgcaggagcagatcgaggccatccacaaggccaagggcctggtgcccgaggacgacaccaaggagaagatcggccccagcaagcccaacgagatcccccagcagccccccccccccagcagcgccaccaacatccccagcagcgccccccccatcaccagcgtgcccagaccccccaccatgcccccccccgtgagaaccaccgtggtgagcgccgtgcccgtgatgcccagaccccccatggccagcgtggtgagactgccccccggcagcgtgatcgcccccatgccccccatcatccacgcccccagaatcaacgtggtgcccatgccccccagcgccccccccatcatggcccccagacccccccccatgatcgtgcccaccgccttcgtgcccgccccccccgtggcccccgtgcccgcccccgcccccatgccccccgtgcacccccccccccccatggaggacgagcccaccagcaagaagctgaagaccgaggacagcctgatgcccgaggaggagttcctgagaagaaacaagggccccgtgagcatcaaggtgcaggtgcccaacatgcaggacaagaccgagtggaagctgaacggccaggtgctggtgttcaccctgcccctgaccgaccaggtgagcgtgatcaaggtgaagatccacgaggccaccggcatgcccgccggcaagcagaagctgcagtacgagggcatcttcatcaaggacagcaacagcctggcctactacaacatggccaacggcgccgtgatccacctggccctgaaggagagaggcggcagaaagaagtag

SEQ ID NO: 104375 - DNA, 732 bp, Artificial Sequence
  Description of Artificial Sequence: Synthetic coding sequence
accatcagagtgaaggacagcctgatctgcgtggactgcgccatggagagcagcagaaacagcagcatgctgaccctgcccctgagcctgttcgacgtggacagcaagcccctgaagaccctggaggacgccctgcactgcttcttccagcccagagagctgagcagcaagagcaagtgcttctgcgagaactgcggcaagaagaccagaggcaagcaggtgctgaagctgacccacctgccccagaccctgaccatccacctgatgagattcagcatcagaaacagccagaccagaaagatctgccacagcctgtacttcccccagagcctggacttcagccagatcctgcccatgaagagagagagctgcgacgccgaggagcagagcggcggccagtacgagctgttcgccgtgatcgcccacgtgggcatggccgacagcggccactactgcgtgtacatcagaaacgccgtggacggcaagtggttctgcttcaacgacagcaacatctgcctggtgagctgggaggacatccagtgcacctacggcaaccccaactaccactggccccccttcctgtgccacgcctgcatcctgatcgaggacggcgagtacctgagactgttcagacccgccaacatcagacagttcaccagcagagaggagacctgggtggagtgctggtgcgtgctgaccctgcagtgcaagcagctgcagcaggtgtggtag

SEQ ID NO: 104376 - DNA, 1698 bp, Artificial Sequence
  Description of Artificial Sequence: Synthetic coding sequence
atgccccaggccagcgagcacagactgggcagaaccagagagccccccgtgaacatccagcccagagtgggcagcaagctgcccttcgcccccagagccagaagcaaggagagaagaaaccccgccagcggccccaaccccatgctgagacccctgccccccagacccggcctgcccgacgagagactgaagaagctggagctgggcagaggcagaaccagcggccccagacccagaggccccctgagagccgaccacggcgtgcccctgcccggcagccccccccccaccgtggccctgcccctgcccagcagaaccaacctggccagaagcaagagcgtgagcagcggcgacctgagacccatgggcatcgccctgggcggccacagaggcaccggcgagctgggcgccgccctgagcagactggccctgagacccgagccccccaccctgagaagaagcaccagcctgagaagactgggcggcttccccggcccccccaccctgttcagcatcagaaccgagccccccgccagccacggcagcttccacatgatcagcgccagaagcagcgagcccttctacagcgacgacaagatggcccaccacaccctgctgctgggcagcggccacgtgggcctgagaaacctgggcaacacctgcttcctgaacgccgtgctgcagtgcctgagcagcaccagacccctgagagacttctgcctgagaagagacttcagacaggaggtgcccggcggcggcagagcccaggagctgaccgaggccttcgccgacgtgatcggcgccctgtggcaccccgacagctgcgaggccgtgaaccccaccagattcagagccgtgttccagaagtacgtgcccagcttcagcggctacagccagcaggacgcccaggagttcctgaagctgctgatggagagactgcacctggagatcaacagaagaggcagaagagccccccccatcctggccaacggccccgtgcccagcccccccagaagaggcggcgccctgctggaggagcccgagctgagcgacgacgacagagccaacctgatgtggaagagatacctggagagagaggacagcaagatcgtggacctgttcgtgggccagctgaagagctgcctgaagtgccaggcctgcggctacagaagcaccaccttcgaggtgttctgcgacctgagcctgcccatccccaagaagggcttcgccggcggcaaggtgagcctgagagactgcttcaacctgttcaccaaggaggaggagctggagagcgagaacgcccccgtgtgcgacagatgcagacagaagaccagaagcaccaagaagctgaccgtgcagagattccccagaatcctggtgctgcacctgaacagattcagcgccagcagaggcagcatcaagaagagcagcgtgggcgtggacttccccctgcagagactgagcctgggcgacttcgccagcgacaaggccggcagccccgtgtaccagctgtacgccctgtgcaaccacagcggcagcgtgcactacggccactacaccgccctgtgcagatgccagaccggctggcacgtgtacaacgacagcagagtgagccccgtgagcgagaaccaggtggccagcagcgagggctacgtgctgttctaccagctgatgcaggagccccccagatgcctgtag

SEQ ID NO: 104377 - DNA, 1656 bp, Artificial Sequence
  Description of Artificial Sequence: Synthetic coding sequence
atgccccaggccagcgagcacagactgggcagaaccagagagccccccgtgaacatccagcccagagtgggcagcaagctgcccttcgcccccagagccagaagcaaggagagaagaaaccccgccagcggccccaaccccatgctgagacccctgccccccagacccggcctgcccgacgagagactgaagaagctggagctgggcagaggcagaaccagcggccccagacccagaggccccctgagagccgaccacggcgtgcccctgcccggcagccccccccccaccgtggccctgcccctgcccagcagaaccaacctggccagaagcaagagcgtgagcagcggcgacctgagacccatgggcatcgccctgggcggccacagaggcaccggcgagctgggcgccgccctgagcagactggccctgagacccgagccccccaccctgagaagaagcaccagcctgagaagactgggcggcttccccggcccccccaccctgttcagcatcagaaccgagccccccgccagccacggcagcttccacatgatcagcgccagaagcagcgagcccttctacagcgacgacaagatggcccaccacaccctgctgctgggcagcggccacgtgggcctgagaaacctgggcaacacctgcttcctgaacgccgtgctgcagtgcctgagcagcaccagacccctgagagacttctgcctgagaagagacttcagacaggaggtgcccggcggcggcagagcccaggagctgaccgaggccttcgccgacgtgatcggcgccctgtggcaccccgacagctgcgaggccgtgaaccccaccagattcagagccgtgttccagaagtacgtgcccagcttcagcggctacagccagcaggacgcccaggagttcctgaagctgctgatggagagactgcacctggagatcaacagaagaggcagaagagccccccccatcctggccaacggccccgtgcccagcccccccagaagaggcggcgccctgctggaggagcccgagctgagcgacgacgacagagccaacctgatgtggaagagatacctggagagagaggacagcaagatcgtggacctgttcgtgggccagctgaagagctgcctgaagtgccaggcctgcggctacagaagcaccaccttcgaggtgttctgcgacctgagcctgcccatccccaagaagggcttcgccggcggcaaggtgagcctgagagactgcttcaacctgttcaccaaggaggaggagctggagagcgagaacgcccccgtgtgcgacagatgcagacagaagaccagaagcaccaagaagctgaccgtgcagagattccccagaatcctggtgctgcacctgaacagattcagcgccagcagaggcagcatcaagaagagcagcgtgggcgtggacttccccctgcagagactgagcctgggcgacttcgccagcgacaaggccggcagcgtgcactacggccactacaccgccctgtgcagatgccagaccggctggcacgtgtacaacgacagcagagtgagccccgtgagcgagaaccaggtggccagcagcgagggctacgtgctgttctaccagctgatgcaggagccccccagatgcctgtag

SEQ ID NO: 104378 - DNA, 1698 bp, Artificial Sequence; identical to SEQ ID NO: 104376
  Description of Artificial Sequence: Synthetic coding sequence

SEQ ID NO: 104379 - DNA, 1578 bp, Artificial Sequence
  Description of Artificial Sequence: Synthetic coding sequence
atggtgagcagacccgagcccgagggcgaggccatggacgccgagctggccgtggccccccccggctgcagccacctgggcagcttcaaggtggacaactggaagcagaacctgagagccatctaccagtgcttcgtgtggagcggcaccgccgaggccagaaagagaaaggccaagagctgcatctgccacgtgtgcggcgtgcacctgaacagactgcacagctgcctgtactgcgtgttcttcggctgcttcaccaagaagcacatccacgagcacgccaaggccaagagacacaacctggccatcgacctgatgtacggcggcatctactgcttcctgtgccaggactacatctacgacaaggacatggagatcatcgccaaggaggagcagagaaaggcctggaagatgcagggcgtgggcgagaagttcagcacctgggagcccaccaagagagagctggagctgctgaagcacaaccccaagagaagaaagatcaccagcaactgcaccatcggcctgagaggcctgatcaacctgggcaacacctgcttcatgaactgcatcgtgcaggccctgacccacacccccctgctgagagacttcttcctgagcgacagacacagatgcgagatgcagagccccagcagctgcctggtgtgcgagatgagcagcctgttccaggagttctacagcggccacagaagcccccacatcccctacaagctgctgcacctggtgtggacccacgccagacacctggccggctacgagcagcaggacgcccacgagttcctgatcgccgccctggacgtgctgcacagacactgcaagggcgacgacaacggcaagaaggccaacaaccccaaccactgcaactgcatcatcgaccagatcttcaccggcggcctgcagagcgacgtgacctgccaggtgtgccacggcgtgagcaccaccatcgaccccttctgggacatcagcctggacctgcccggcagcagcacccccttctggcccctgagccccggcagcgagggcaacgtggtgaacggcgagagccacgtgagcggcaccaccaccctgaccgactgcctgagaagattcaccagacccgagcacctgggcagcagcgccaagatcaagtgcagcggctgccacagctaccaggagagcaccaagcagctgaccatgaagaagctgcccatcgtggcctgcttccacctgaagagattcgagcacagcgccaagctgagaagaaagatcaccacctacgtgagcttccccctggagctggacatgacccccttcatggccagcagcaaggagagcagaatgaacggccagtaccagcagcccaccgacagcctgaacaacgacaacaagtacagcctgttcgccgtggtgaaccaccagggcaccctggagagcggccactacaccagcttcatcagacagcacaaggaccagtggttcaagtgcgacgacgccatcatcaccaaggccagcatcaaggacgtgctggacagcgagggctacctgctgttctaccacaagcagttcctggagtacgagtag

SEQ ID NO: 104380 - DNA, 1782 bp, Artificial Sequence
  Description of Artificial Sequence: Synthetic coding sequence
gccgccgccgccagaggcagatgcctgccctgcagcctgcccagcgccatcgcccagccccacctgtgccccgccagcgccctgtgcagcagaagacccggcctgggccagcccggccagccccccagcagcccccacgccgccctggccagcagcagcccccccagcccccccccccccgccagaggcagagccctgccccccatggtgagcagacccgagcccgagggcgaggccatggacgccgagctggccgtggccccccccggctgcagccacctgggcagcttcaaggtggacaactggaagcagaacctgagagccatctaccagtgcttcgtgtggagcggcaccgccgaggccagaaagagaaaggccaagagctgcatctgccacgtgtgcggcgtgcacctgaacagactgcacagctgcctgtactgcgtgttcttcggctgcttcaccaagaagcacatccacgagcacgccaaggccaagagacacaacctggccatcgacctgatgtacggcggcatctactgcttcctgtgccaggactacatctacgacaaggacatggagatcatcgccaaggaggagcagagaaaggcctggaagatgcagggcgtgggcgagaagttcagcacctgggagcccaccaagagagagctggagctgctgaagcacaaccccaagagaagaaagatcaccagcaactgcaccatcggcctgagaggcctgatcaacctgggcaacacctgcttcatgaactgcatcgtgcaggccctgacccacacccccctgctgagagacttcttcctgagcgacagacacagatgcgagatgcagagccccagcagctgcctggtgtgcgagatgagcagcctgttccaggagttctacagcggccacagaagcccccacatcccctacaagctgctgcacctggtgtggacccacgccagacacctggccggctacgagcagcaggacgcccacgagttcctgatcgccgccctggacgtgctgcacagacactgcaagggcgacgacaacggcaagaaggccaacaaccccaaccactgcaactgcatcatcgaccagatcttcaccggcggcctgcagagcgacgtgacctgccaggtgtgccacggcgtgagcaccaccatcgaccccttctgggacatcagcctggacctgcccggcagcagcacccccttctggcccctgagccccggcagcgagggcaacgtggtgaacggcgagagccacgtgagcggcaccaccaccctgaccgactgcctgagaagattcaccagacccgagcacctgggcagcagcgccaagatcaagtgcagcggctgccacagctaccaggagagcaccaagcagctgaccatgaagaagctgcccatcgtggcctgcttccacctgaagagattcgagcacagcgccaagctgagaagaaagatcaccacctacgtgagcttccccctggagctggacatgacccccttcatggccagcagcaaggagagcagaatgaacggccagtaccagcagcccaccgacagcctgaacaacgacaacaagtacagcctgttcgccgtggtgaaccaccagggcaccctggagagcggccactacaccagcttcatcagacagcacaaggaccagtggttcaagtgcgacgacgccatcatcaccaaggccagcatcaaggacgtgctggacagcgagggctacctgctgttctaccacaagcagttcctggagtacgagtag

SEQ ID NO: 104381 - DNA, 1542 bp, Artificial Sequence
  Description of Artificial Sequence: Synthetic coding sequence
atggcccccggctggcccagcctgagcgccggcagcagacaggaggccccccagctggccgccggcggcagcgcctaccaggccgtgggcagacagttccagcccagagccaccgccctgcagggccccagccaggccaagagctgcatctgccacgtgtgcggcgtgcacctgaacagactgcacagctgcctgtactgcgtgttcttcggctgcttcaccaagaagcacatccacgagcacgccaaggccaagagacacaacctggccatcgacctgatgtacggcggcatctactgcttcctgtgccaggactacatctacgacaaggacatggagatcatcgccaaggaggagcagagaaaggcctggaagatgcagggcgtgggcgagaagttcagcacctgggagcccaccaagagagagctggagctgctgaagcacaaccccaagagaagaaagatcaccagcaactgcaccatcggcctgagaggcctgatcaacctgggcaacacctgcttcatgaactgcatcgtgcaggccctgacccacacccccctgctgagagacttcttcctgagcgacagacacagatgcgagatgcagagccccagcagctgcctggtgtgcgagatgagcagcctgttccaggagttctacagcggccacagaagcccccacatcccctacaagctgctgcacctggtgtggacccacgccagacacctggccggctacgagcagcaggacgcccacgagttcctgatcgccgccctggacgtgctgcacagacactgcaagggcgacgacaacggcaagaaggccaacaaccccaaccactgcaactgcatcatcgaccagatcttcaccggcggcctgcagagcgacgtgacctgccaggtgtgccacggcgtgagcaccaccatcgaccccttctgggacatcagcctggacctgcccggcagcagcacccccttctggcccctgagccccggcagcgagggcaacgtggtgaacggcgagagccacgtgagcggcaccaccaccctgaccgactgcctgagaagattcaccagacccgagcacctgggcagcagcgccaagatcaagtgcagcggctgccacagctaccaggagagcaccaagcagctgaccatgaagaagctgcccatcgtggcctgcttccacctgaagagattcgagcacagcgccaagctgagaagaaagatcaccacctacgtgagcttccccctggagctggacatgacccccttcatggccagcagcaaggagagcagaatgaacggccagtaccagcagcccaccgacagcctgaacaacgacaacaagtacagcctgttcgccgtggtgaaccaccagggcaccctggagagcggccactacaccagcttcatcagacagcacaaggaccagtggttcaagtgcgacgacgccatcatcaccaaggccagcatcaaggacgtgctggacagcgagggctacctgctgttctaccacaagcagttcctggagtacgagtag

SEQ ID NO: 104382 - DNA, 7863 bp, Artificial Sequence
  Description of Artificial Sequence: Synthetic coding sequence
atggagagcgaggaggagcagcacatgaccaccctgctgtgcatgggcttcagcgaccccgccaccatcagaaaggccctgagactggccaagaacgacatcaacgaggccgtggccctgctgaccaacgagagacccggcctggactacggcggctacgagcccatggacagcggcggcggccccagccccggccccggcggcggccccagaggcgacggcggcggcgacggcggcggcggcggccccagcagaggcggcagcaccggcggcggcggcggcttcgaccccccccccgcctaccacgaggtggtggacgccgagaagaacgacgagaacggcaactgcagcggcgagggcatcgagttccccaccaccaacctgtacgagctggagagcagagtgctgaccgaccactggagcatcccctacaagagagaggagagcctgggcaagtgcctgctggccagcacctacctggccagactgggcctgagcgagagcgacgagaactgcagaagattcatggacagatgcatgcccgaggccttcaagaagctgctgaccagcagcgccgtgcacaagtggggcaccgagatccacgagggcatctacaacatgctgatgctgctgatcgagctggtggccgagagaatcaagcaggaccccatccccaccggcctgctgggcgtgctgaccatggccttcaaccccgacaacgagtaccacttcaagaacagaatgaaggtgagccagagaaactgggccgaggtgttcggcgagggcaacatgttcgccgtgagccccgtgagcaccttccagaaggagccccacggctgggtggtggacctggtgaacaagttcggcgagctgggcggcttcgccgccatccaggccaagctgcacagcgaggacatcgagctgggcgccgtgagcgccctgatccagcccctgggcgtgtgcgccgagtacctgaacagcagcgtggtgcagcccatgctggaccccgtgatcctgaccaccatccaggacgtgagaagcgtggaggagaaggacctgaaggacaagagactggtgagcatccccgagctgctgagcgccgtgaagctgctgtgcatgagattccagcccgacctggtgaccatcgtggacgacctgagactggacatcctgctgagaatgctgaagagcccccacttcagcgccaagatgaacagcctgaaggaggtgaccaagctgatcgaggacagcaccctgagcaagagcgtgaagaacgccatcgacaccgacagactgctggactggctggtggagaacagcgtgctgagcatcgccctggagggcaacatcgaccaggcccagtactgcgacagaatcaagggcatcatcgagctgctgggcagcaagctgagcctggacgagctgaccaagatctggaagatccagagcggccagagcagcaccgtgatcgagaacatccacaccatcatcgccgccgccgccgtgaagttcaacagcgaccagctgaaccacctgttcgtgctgatccagaagagctgggagaccgagagcgacagagtgagacagaagctgctgagcctgatcggcagaatcggcagagaggccagattcgagaccaccagcggcaaggtgctggacgtgctgtgggagctggcccacctgcccaccctgcccagcagcctgatccagcaggccctggaggagcacctgaccatcctgagcgacgcctacgccgtgaaggaggccatcaagagaagctacatcatcaagtgcatcgaggacatcaagagacccggcgagtggagcggcctggagaagaacaagaaggacggcttcaagagcagccagctgaacaacccccagttcgtgtgggtggtgcccgccctgagacagctgcacgagatcaccagaagcttcatcaagcagacctaccagaagcaggacaagagcatcatccaggacctgaagaagaacttcgagatcgtgaagctggtgaccggcagcctgatcgcctgccacagactggccgccgccgtggccggccccggcggcctgagcggcagcaccctggtggacggcagatacacctacagagagtacctggaggcccacctgaagttcctggccttcttcctgcaggaggccaccctgtacctgggctggaacagagccaaggagatctgggagtgcctggtgaccggccaggacgtgtgcgagctggacagagagatgtgcttcgagtggttcaccaagggccagcacgacctggagagcgacgtgcagcagcagctgttcaaggagaagatcctgaagctggagagctacgagatcaccatgaacggcttcaacctgttcaagaccttcttcgagaacgtgaacctgtgcgaccacagactgaagagacagggcgcccagctgtacgtggagaagctggagctgatcggcatggacttcatctggaagatcgccatggagagccccgacgaggagatcgccaacgaggccatccagctgatcatcaactacagctacatcaacctgaaccccagactgaagaaggacagcgtgagcctgcacaagaagttcatcgccgactgctacaccagactggaggccgccagcagcgccctgggcggccccaccctgacccacgccgtgaccagagccaccaagatgctgaccgccaccgccatgcccaccgtggccaccagcgtgcagagcccctacagaagcaccaagctggtgatcatcgagagactgctgctgctggccgagagatacgtgatcaccatcgaggacttctacagcgtgcccagaaccatcctgccccacggcgccagcttccacggccacctgctgaccctgaacgtgacctacgagagcaccaaggacaccttcaccgtggaggcccacagcaacgagaccatcggcagcgtgagatggaagatcgccaagcagctgtgcagccccgtggacaacatccagatcttcaccaacgacagcctgctgaccgtgaacaaggaccagaagctgctgcaccagctgggcttcagcgacgagcagatcctgaccgtgaagaccagcggcagcggcacccccagcggcagcagcgccgacagcagcaccagcagcagcagcagcagcagcggcgtgttcagcagcagctacgccatggagcaggagaagagcctgcccggcgtggtgatggccctggtgtgcaacgtgttcgacatgctgtaccagctggccaacctggaggagcccagaatcaccctgagagtgagaaagctgctgctgctgatccccaccgaccccgccatccaggaggccctggaccagctggacagcctgggcagaaagaagaccctgctgagcgagagcagcagccagagcagcaagagccccagcctgagcagcaagcagcagcaccagcccagcgccagcagcatcctggagagcctgttcagaagcttcgcccccggcatgagcaccttcagagtgctgtacaacctggaggtgctgagcagcaagctgatgcccaccgccgacgacgacatggccagaagctgcgccaagagcttctgcgagaacttcctgaaggccggcggcctgagcctggtggtgaacgtgatgcagagagacagcatccccagcgaggtggactacgagaccagacagggcgtgtacagcatctgcctgcagctggccagattcctgctggtgggccagaccatgcccaccctgctggacgaggacctgaccaaggacggcatcgaggccctgagcagcagacccttcagaaacgtgagcagacagaccagcagacagatgagcctgtgcggcacccccgagaagagcagctacagacagctgagcgtgagcgacagaagcagcatcagagtggaggagatcatccccgccgccagagtggccatccagaccatggaggtgagcgacttcaccagcaccgtggcctgcttcatgagactgagctgggccgccgccgccggcagactggacctggtgggcagcagccagcccatcaaggagagcaacagcctgtgccccgccggcatcagaaacagactgagcagcagcggcagcaactgcagcagcggcagcgagggcgagcccgtggccctgcacgccggcatctgcgtgagacagcagagcgtgagcaccaaggacagcctgatcgccggcgaggccctgagcctgctggtgacctgcctgcagctgagaagccagcagctggccagcttctacaacctgccctgcgtggccgacttcatcatcgacatcctgctgggcagccccagcgccgagatcagaagagtggcctgcgaccagctgtacaccctgagccagaccgacaccagcgcccaccccgacgtgcagaagcccaaccagttcctgctgggcgtgatcctgaccgcccagctgcccctgtggagccccaccagcatcatgagaggcgtgaaccagagactgctgagccagtgcatggagtacttcgacctgagatgccagctgctggacgacctgaccaccagcgagatggagcagctgagaatcagccccgccaccatgctggaggacgagatcacctggctggacaacttcgagcccaacagaaccgccgagtgcgagaccagcgaggccgacaacatcctgctggccggccacctgagactgatcaagaccctgctgagcctgtgcggcgccgagaaggagatgctgggcagcagcctgatcaagcccctgctggacgacttcctgttcagagccagcagaatcatcctgaacagccacagccccgccggcagcgccgccatcagccagcaggacttccaccccaagtgcagcaccgccaacagcagactggccgcctacgaggtgctggtgatgctggccgacagcagccccagcaacctgcagatcatcatcaaggagctgctgagcatgcaccaccagcccgaccccgccctgaccaaggagttcgactacctgccccccgtggacagcagaagcagcagcggcttcgtgggcctgagaaacggcggcgccacctgctacatgaacgccgtgttccagcagctgtacatgcagcccggcctgcccgagagcctgctgagcgtggacgacgacaccgacaaccccgacgacagcgtgttctaccaggtgcagagcctgttcggccacctgatggagagcaagctgcagtactacgtgcccgagaacttctggaagatcttcaagatgtggaacaaggagctgtacgtgagagagcagcaggacgcctacgagttcttcaccagcctgatcgaccagatggacgagtacctgaagaagatgggcagagaccagatcttcaagaacaccttccagggcatctacagcgaccagaagatctgcaaggactgcccccacagatacgagagagaggaggccttcatggccctgaacctgggcgtgaccagctgccagagcctggagatcagcctggaccagttcgtgagaggcgaggtgctggagggcagcaacgcctactactgcgagaagtgcaaggagaagagaatcaccgtgaagagaacctgcatcaagagcctgcccagcgtgctggtgatccacctgatgagattcggcttcgactgggagagcggcagaagcatcaagtacgacgagcagatcagattcccctggatgctgaacatggagccctacaccgtgagcggcatggccagacaggacagcagcagcgaggtgggcgagaacggcagaagcgtggaccagggcggcggcggcagccccagaaagaaggtggccctgaccgagaactacgagctggtgggcgtgatcgtgcacagcggccaggcccacgccggccactactacagcttcatcaaggacagaagaggctgcggcaagggcaagtggtacaagttcaacgacaccgtgatcgaggagttcgacctgaacgacgagaccctggagtacgagtgcttcggcggcgagtacagacccaaggtgtacgaccagaccaacccctacaccgacgtgagaagaagatactggaacgcctacatgctgttctaccagagagtgagcgaccagaacagccccgtgctgcccaagaagagcagagtgagcgtggtgagacaggaggccgaggacctgagcctgagcgcccccagcagccccgagatcagcccccagagcagccccagaccccacagacccaacaacgacagactgagcatcctgaccaagctggtgaagaagggcgagaagaagggcctgttcgtggagaagatgcccgccagaatctaccagatggtgagagacgagaacctgaagttcatgaagaacagagacgtgtacagcagcgactacttcagcttcgtgctgagcctggccagcctgaacgccaccaagctgaagcacccctactacccctgcatggccaaggtgagcctgcagctggccatccagttcctgttccagacctacctgagaaccaagaagaagctgagagtggacaccgaggagtggatcgccaccatcgaggccctgctgagcaagagcttcgacgcctgccagtggctggtggagtacttcatcagcagcgagggcagagagctgatcaagatcttcctgctggagtgcaacgtgagagaggtgagagtggccgtggccaccatcctggagaagaccctggacagcgccctgttctaccaggacaagctgaagagcctgcaccagctgctggaggtgctgctggccctgctggacaaggacgtgcccgagaactgcaagaactgcgcccagtacttcttcctgttcaacaccttcgtgcagaagcagggcatcagagccggcgacctgctgctgagacacagcgccctgagacacatgatcagcttcctgctgggcgccagcagacagaacaaccagatcagaagatggagcagcgcccaggccagagagttcggcaacctgcacaacaccgtggccctgctggtgctgcacagcgacgtgagcagccagagaaacgtggcccccggcatcttcaagcagagaccccccatcagcatcgcccccagcagccccctgctgcccctgcacgaggaggtggaggccctgctgttcatgagcgagggcaagccctacctgctggaggtgatgttcgccctgagagagctgaccggcagcctgctggccctgatcgagatggtggtgtactgctgcttctgcaacgagcacttcagcttcaccatgctgcacttcatcaagaaccagctggagaccgcccccccccacgagctgaagaacaccttccagctgctgcacgagatcctggtgatcgaggaccccatccaggtggagagagtgaagttcgtgttcgagaccgagaacggcctgctggccctgatgcaccacagcaaccacgtggacagcagcagatgctaccagtgcgtgaagttcctggtgaccctggcccagaagtgccccgccgccaaggagtacttcaaggagaacagccaccactggagctgggccgtgcagtggctgcagaagaagatgagcgagcactactggaccccccagagcaacgtgagcaacgagaccagcaccggcaagaccttccagagaaccatcagcgcccaggacaccctggcctacgccaccgccctgctgaacgagaaggagcagagcggcagcagcaacggcagcgagagcagccccgccaacgagaacggcgacagacacctgcagcagggcagcgagagccccatgatgatcggcgagctgagaagcgacctggacgacgtggacccctag

SEQ ID NO: 104383 - DNA, 7383 bp, Artificial Sequence
  Description of Artificial Sequence: Synthetic coding sequence
atgaccaccctgctgtgcatgggcttcagcgaccccgccaccatcagaaaggccctgagactggccaagaacgacatcaacgaggccgtggccctgctgaccaacgagagacccggcctggactacggcggctacgagcccatggacagcggcggcctgagcgagagcgacgagaactgcagaagattcatggacagatgcatgcccgaggccttcaagaagctgctgaccagcagcgccgtgcacaagtggggcaccgagatccacgagggcatctacaacatgctgatgctgctgatcgagctggtggccgagagaatcaagcaggaccccatccccaccggcctgctgggcgtgctgaccatggccttcaaccccgacaacgagtaccacttcaagaacagaatgaaggtgagccagagaaactgggccgaggtgttcggcgagggcaacatgttcgccgtgagccccgtgagcaccttccagaaggagccccacggctgggtggtggacctggtgaacaagttcggcgagctgggcggcttcgccgccatccaggccaagctgcacagcgaggacatcgagctgggcgccgtgagcgccctgatccagcccctgggcgtgtgcgccgagtacctgaacagcagcgtggtgcagcccatgctggaccccgtgatcctgaccaccatccaggacgtgagaagcgtggaggagaaggacctgaaggacaagagactggtgagcatccccgagctgctgagcgccgtgaagctgctgtgcatgagattccagcccgacctggtgaccatcgtggacgacctgagactggacatcctgctgagaatgctgaagagcccccacttcagcgccaagatgaacagcctgaaggaggtgaccaagctgatcgaggacagcaccctgagcaagagcgtgaagaacgccatcgacaccgacagactgctggactggctggtggagaacagcgtgctgagcatcgccctggagggcaacatcgaccaggcccagtactgcgacagaatcaagggcatcatcgagctgctgggcagcaagctgagcctggacgagctgaccaagatctggaagatccagagcggccagagcagcaccgtgatcgagaacatccacaccatcatcgccgccgccgccgtgaagttcaacagcgaccagctgaaccacctgttcgtgctgatccagaaggtgctggacgtgctgtgggagctggcccacctgcccaccctgcccagcagcctgatccagcaggccctggaggagcacctgaccatcctgagcgacgcctacgccgtgaaggaggccatcaagagaagctacatcatcaagtgcatcgaggacatcaagagaagcagccagctgaacaacccccagttcgtgtgggtggtgcccgccctgagacagctgcacgagatcaccagaagcttcatcaagcagacctaccagaagcaggacaagagcatcatccaggacctgaagaagaacttcgagatcgtgaagctggtgaccggcagcctgatcgcctgccacagactggccgccgccgtggccggccccggcggcctgagcggcagcaccctggtggacggcagatacacctacagagagtacctggaggcccacctgaagttcctggccttcttcctgcaggaggccaccctgtacctgggctggaacagagccaaggagatctgggagtgcctggtgaccggccaggacgtgtgcgagctggacagagagatgtgcttcgagtggttcaccaagggccagcacgacctggagagcgacgtgcagcagcagctgttcaaggagaagatcctgaagctggagagctacgagatcaccatgaacggcttcaacctgttcaagaccttcttcgagaacgtgaacctgtgcgaccacagactgaagagacagggcgcccagctgtacgtggagaagctggagctgatcggcatggacttcatctggaagatcgccatggagagccccgacgaggagatcgccaacgaggccatccagctgatcatcaactacagctacatcaacctgaaccccagactgaagaaggacagcgtgagcctgcacaagaagttcatcgccgactgctacaccagactggaggccgccagcagcgccctgggcggccccaccctgacccacgccgtgaccagagccaccaagatgctgaccgccaccgccatgcccaccgtggccaccagcgtgcagagcccctacagaagcaccaagctggtgatcatcgagagactgctgctgctggccgagagatacgtgatcaccatcgaggacttctacagcgtgcccagaaccatcctgccccacggcgccagcttccacggccacctgctgaccctgaacgtgacctacgagagcaccaaggacaccttcaccgtggaggcccacagcaacgagaccatcggcagcgtgagatggaagatcgccaagcagctgtgcagccccgtggacaacatccagatcttcaccaacgacagcctgctgaccgtgaacaaggaccagaagctgctgcaccagctgggcttcagcgacgagcagatcctgaccgtgaagaccagcggcagcggcacccccagcggcagcagcgccgacagcagcaccagcagcagcagcagcagcagcggcgtgttcagcagcagctacgccatggagcaggagaagagcctgcccggcgtggtgatggccctggtgtgcaacgtgttcgacatgctgtaccagctggccaacctggaggagcccagaatcaccctgagagtgagaaagctgctgctgctgatccccaccgaccccgccatccaggaggccctggaccagctggacagcctgggcagaaagaagaccctgctgagcgagagcagcagccagagcagcaagagccccagcctgagcagcaagcagcagcaccagcccagcgccagcagcatcctggagagcctgttcagaagcttcgcccccggcatgagcaccttcagagtgctgtacaacctggaggtgctgagcagcaagctgatgcccaccgccgacgacgacatggccagaagctgcgccaagagcttctgcgagaacttcctgaaggccggcggcctgagcctggtggtgaacgtgatgcagagagacagcatccccagcgaggtggactacgagaccagacagggcgtgtacagcatctgcctgcagctggccagattcctgctggtgggccagaccatgcccaccctgctggacgaggacctgaccaaggacggcatcgaggccctgagcagcagacccttcagaaacgtgagcagacagaccagcagacagatgagcctgtgcggcacccccgagaagagcagctacagacagctgagcgtgagcgacagaagcagcatcagagtggaggagatcatccccgccgccagagtggccatccagaccatggaggtgagcgacttcaccagcaccgtggcctgcttcatgagactgagctgggccgccgccgccggcagactggacctggtgggcagcagccagcccatcaaggagagcaacagcctgtgccccgccggcatcagaaacagactgagcagcagcggcagcaactgcagcagcggcagcgagggcgagcccgtggccctgcacgccggcatctgcgtgagacagcagagcgtgagcaccaaggacagcctgatcgccggcgaggccctgagcctgctggtgacctgcctgcagctgagaagccagcagctggccagcttctacaacctgccctgcgtggccgacttcatcatcgacatcctgctgggcagccccagcgccgagatcagaagagtggcctgcgaccagctgtacaccctgagccagaccgacaccagcgcccaccccgacgtgcagaagcccaaccagttcctgctgggcgtgatcctgaccgcccagctgcccctgtggagccccaccagcatcatgagaggcgtgaaccagagactgctgagccagtgcatggagtacttcgacctgagatgccagctgctggacgacctgaccaccagcgagatggagcagctgagaatcagccccgccaccatgctggaggacgagatcacctggctggacaacttcgagcccaacagaaccgccgagtgcgagaccagcgaggccgacaacatcctgctggccggccacctgagactgatcaagaccctgctgagcctgtgcggcgccgagaaggagatgctgggcagcagcctgatcaagcccctgctggacgacttcctgttcagagccagcagaatcatcctgaacagccacagccccgccggcagcgccgccatcagccagcaggacttccaccccaagtgcagcaccgccaacagcagactggccgcctacgaggtgctggtgatgctggccgacagcagccccagcaacctgcagatcatcatcaaggagctgctgagcatgcaccaccagcccgaccccgccctgaccaaggagttcgactacctgccccccgtggacagcagaagcagcagcggcttcgtgggcctgagaaacggcggcgccacctgctacatgaacgccgtgttccagcagctgtacatgcagcccggcctgcccgagagcctgctgagcgtggacgacgacaccgacaaccccgacgacagcgtgttctaccaggtgcagagcctgttcggccacctgatggagagcaagctgcagtactacgtgcccgagaacttctggaagatcttcaagatgtggaacaaggagctgtacgtgagagagcagcaggacgcctacgagttcttcaccagcctgatcgaccagatggacgagtacctgaagaagatgggcagagaccagatcttcaagaacaccttccagggcatctacagcgaccagaagatctgcaaggactgcccccacagatacgagagagaggaggccttcatggccctgaacctgggcgtgaccagctgccagagcctggagatcagcctggaccagttcgtgagaggcgaggtgctggagggcagcaacgcctactactgcgagaagtgcaaggagaagagaatcaccgtgaagagaacctgcatcaagagcctgcccagcgtgctggtgatccacctgatgagattcggcttcgactgggagagcggcagaagcatcaagtacgacgagcagatcagattcccctggatgctgaacatggagccctacaccgtgagcggcatggccagacaggacagcagcagcgaggtgggcgagaacggcagaagcgtggaccagggcggcggcggcagccccagaaagaaggtggccctgaccgagaactacgagctggtgggcgtgatcgtgcacagcggccaggcccacgccggccactactacagcttcatcaaggacagaagaggctgcggcaagggcaagtggtacaagttcaacgacaccgtgatcgaggagttcgacctgaacgacgagaccctggagtacgagtgcttcggcggcgagtacagacccaaggtgtacgaccagaccaacccctacaccgacgtgagaagaagatactggaacgcctacatgctgttctaccagagagtgagcgaccagaacagccccgtgctgcccaagaagagcagagtgagcgtggtgagacaggaggccgaggacctgagcctgagcgcccccagcagccccgagatcagcccccagagcagccccagaccccacagacccaacaacgacagactgagcatcctgaccaagctggtgaagaagggcgagaagaagggcctgttcgtggagaagatgcccgccagaatctaccagatggtgagagacgagaacctgaagttcatgaagaacagagacgtgtacagcagcgactacttcagcttcgtgctgagcctggccagcctgaacgccaccaagctgaagcacccctactacccctgcatggccaaggtgagcctgcagctggccatccagttcctgttccagacctacctgagaaccaagaagaagctgagagtggacaccgaggagtggatcgccaccatcgaggccctgctgagcaagagcttcgacgcctgccagtggctggtggagtacttcatcagcagcgagggcagagagctgatcaagatcttcctgctggagtgcaacgtgagagaggtgagagtggccgtggccaccatcctggagaagaccctggacagcgccctgttctaccaggacaagctgaagagcctgcaccagctgctggaggtgctgctggccctgctggacaaggacgtgcccgagaactgcaagaactgcgcccagtacttcttcctgttcaacaccttcgtgcagaagcagggcatcagagccggcgacctgctgctgagacacagcgccctgagacacatgatcagcttcctgctgggcgccagcagacagaacaaccagatcagaagatggagcagcgcccaggccagagagttcggcaacctgcacaacaccgtggccctgctggtgctgcacagcgacgtgagcagccagagaaacgtggcccccggcatcttcaagcagagaccccccatcagcatcgcccccagcagccccctgctgcccctgcacgaggaggtggaggccctgctgttcatgagcgagggcaagccctacctgctggaggtgatgttcgccctgagagagctgaccggcagcctgctggccctgatcgagatggtggtgtactgctgcttctgcaacgagcacttcagcttcaccatgctgcacttcatcaagaaccagctggagaccgcccccccccacgagctgaagaacaccttccagctgctgcacgagatcctggtgatcgaggaccccatccaggtggagagagtgaagttcgtgttcgagaccgagaacggcctgctggccctgatgcaccacagcaaccacgtggacagcagcagatgctaccagtgcgtgaagttcctggtgaccctggcccagaagtgccccgccgccaaggagtacttcaaggagaacagccaccactggagctgggccgtgcagtggctgcagaagaagatgagcgagcactactggaccccccagagcaacgtgagcaacgagaccagcaccggcaagaccttccagagaaccatcagcgcccaggacaccctggcctacgccaccgccctgctgaacgagaaggagcagagcggcagcagcaacggcagcgagagcagccccgccaacgagaacggcgacagacacctgcagcagggcagcgagagccccatgatgatcggcgagctgagaagcgacctggacgacgtggacccctag

SEQ ID NO: 104384 - DNA, 2742 bp, Artificial Sequence
  Description of Artificial Sequence: Synthetic coding sequence
atggccgccctgttcctgagaggcttcgtgcagatcggcaactgcaagaccggcatcagcaagagcaaggaggccttcatcgaggccgtggagagaaagaagaaggacagactggtgctgtacttcaagagcggcaagtacagcaccttcagactgagcgacaacatccagaacgtggtgctgaagagctacagaggcaaccagaaccacctgcacctgaccctgcagaacaacaacggcctgttcatcgagggcctgagcagcaccgacgccgagcagctgaagatcttcctggacagagtgcaccagaacgaggtgcagccccccgtgagacccggcaagggcggcagcgtgttcagcagcaccacccagaaggagatcaacaagaccagcttccacaaggtggacgagaagagcagcagcaagagcttcgagatcgccaagggcagcggcaccggcgtgctgcagagaatgcccctgctgaccagcaagctgaccctgacctgcggcgagctgagcgagaaccagcacaagaagagaaagagaatgctgagcagcagcagcgagatgaacgaggagttcctgaaggagaacaacagcgtggagtacaagaagagcaaggccgactgcagcagatgcgtgagctacaacagagagaagcagctgaagctgaaggagctggaggagaacaagaagctggagtgcgagagcagctgcatcatgaacgccaccggcaacccctacctggacgacatcggcctgctgcaggccctgaccgagaagatggtgctggtgttcctgctgcagcagggctacagcgacggctacaccaagtgggacaagctgaagctgttcttcgagctgttccccgagaagatctgccacggcctgcccaacctgggcaacacctgctacatgaacgccgtgctgcagagcctgctgagcatccccagcttcgccgacgacctgctgaaccagagcttcccctggggcaagatccccctgaacgccctgaccatgtgcctggccagactgctgttcttcaaggacacctacaacatcgagatcaaggagatgctgctgctgaacctgaagaaggccatcagcgccgccgccgagatcttccacggcaacgcccagaacgacgcccacgagttcctggcccactgcctggaccagctgaaggacaacatggagaagctgaacaccatctggaagcccaagagcgagttcggcgaggacaacttccccaagcaggtgttcgccgacgaccccgacaccagcggcttcagctgccccgtgatcaccaacttcgagctggagctgctgcacagcatcgcctgcaaggcctgcggccaggtgatcctgaagaccgagctgaacaactacctgagcatcaacctgccccagagaatcaaggcccaccccagcagcatccagagcaccttcgacctgttcttcggcgccgaggagctggagtacaagtgcgccaagtgcgagcacaagaccagcgtgggcgtgcacagcttcagcagactgcccagaatcctgatcgtgcacctgaagagatacagcctgaacgagttctgcgccctgaagaagaacgaccaggaggtgatcatcagcaagtacctgaaggtgagcagccactgcaacgagggcaccagaccccccctgcccctgagcgaggacggcgagatcaccgacttccagctgctgaaggtgatcagaaagatgaccagcggcaacatcagcgtgagctggcccgccaccaaggagagcaaggacatcctggccccccacatcggcagcgacaaggagagcgagcagaagaagggccagaccgtgttcaagggcgccagcagaagacagcagcagaagtacctgggcaagaacagcaagcccaacgagctggagagcgtgtacagcggcgacagagccttcatcgagaaggagcccctggcccacctgatgacctacctggaggacaccagcctgtgccagttccacaaggccggcggcaagcccgccagcagccccggcacccccctgagcaaggtggacttccagaccgtgcccgagaaccccaagagaaagaagtacgtgaagaccagcaagttcgtggccttcgacagaatcatcaaccccaccaaggacctgtacgaggacaagaacatcagaatccccgagagattccagaaggtgagcgagcagacccagcagtgcgacggcatgagaatctgcgagcaggccccccagcaggccctgccccagagcttccccaagcccggcacccagggccacaccaagaacctgctgagacccaccaagctgaacctgcagaagagcaacagaaacagcctgctggccctgggcagcaacaagaaccccagaaacaaggacatcctggacaagatcaagagcaaggccaaggagaccaagagaaacgacgacaagggcgaccacacctacagactgatcagcgtggtgagccacctgggcaagaccctgaagagcggccactacatctgcgacgcctacgacttcgagaagcagatctggttcacctacgacgacatgagagtgctgggcatccaggaggcccagatgcaggaggacagaagatgcaccggctacatcttcttctacatgcacaacgagatcttcgaggagatgctgaagagagaggagaacgcccagctgaacagcaaggaggtggaggagaccctgcagaaggagtag

SEQ ID NO: 104385 - DNA, 2742 bp, Artificial Sequence; identical to SEQ ID NO: 104384
  Description of Artificial Sequence: Synthetic coding sequence

SEQ ID NO: 104386 - DNA, 3234 bp, Artificial Sequence
  Description of Artificial Sequence: Synthetic coding sequence
atgaccgccgagctgcagcaggacgacgccgccggcgccgccgacggccacggcagcagctgccagatgctgctgaaccagctgagagagatcaccggcatccaggaccccagcttcctgcacgaggccctgaaggccagcaacggcgacatcacccaggccgtgagcctgctgaccgacgagagagtgaaggagcccagccaggacaccgtggccaccgagcccagcgaggtggagggcagcgccgccaacaaggaggtgctggccaaggtgatcgacctgacccacgacaacaaggacgacctgcaggccgccatcgccctgagcctgctggagagccccaagatccaggccgacggcagagacctgaacagaatgcacgaggccaccagcgccgagaccaagagaagcaagagaaagagatgcgaggtgtggggcgagaaccccaaccccaacgactggagaagagtggacggctggcccgtgggcctgaagaacgtgggcaacacctgctggttcagcgccgtgatccagagcctgttccagctgcccgagttcagaagactggtgctgagctacagcctgccccagaacgtgctggagaactgcagaagccacaccgagaagagaaacatcatgttcatgcaggagctgcagtacctgttcgccctgatgatgggcagcaacagaaagttcgtggaccccagcgccgccctggacctgctgaagggcgccttcagaagcagcgaggagcagcagcaggacgtgagcgagttcacccacaagctgctggactggctggaggacgccttccagctggccgtgaacgtgaacagccccagaaacaagagcgagaaccccatggtgcagctgttctacggcaccttcctgaccgagggcgtgagagagggcaagcccttctgcaacaacgagaccttcggccagtaccccctgcaggtgaacggctacagaaacctggacgagtgcctggagggcgccatggtggagggcgacgtggagctgctgcccagcgaccacagcgtgaagtacggccaggagagatggttcaccaagctgccccccgtgctgaccttcgagctgagcagattcgagttcaaccagagcctgggccagcccgagaagatccacaacaagctggagttcccccagatcatctacatggacagatacatgtacagaagcaaggagctgatcagaaacaagagagagtgcatcagaaagctgaaggaggagatcaagatcctgcagcagaagctggagagatacgtgaagtacggcagcggccccgccagattccccctgcccgacatgctgaagtacgtgatcgagttcgccagcaccaagcccgccagcgagagctgcccccccgagagcgacacccacatgaccctgcccctgagcagcgtgcactgcagcgtgagcgaccagaccagcaaggagagcaccagcaccgagagcagcagccaggacgtggagagcaccttcagcagccccgaggacagcctgcccaagagcaagcccctgaccagcagcagaagcagcatggagatgcccagccagcccgcccccagaaccgtgaccgacgaggagatcaacttcgtgaagacctgcctgcagagatggagaagcgagatcgagcaggacatccaggacctgaagacctgcatcgccagcaccacccagaccatcgagcagatgtactgcgaccccctgctgagacaggtgccctacagactgcacgccgtgctggtgcacgagggccaggccaacgccggccactactgggcctacatctacaaccagcccagacagagctggctgaagtacaacgacatcagcgtgaccgagagcagctgggaggaggtggagagagacagctacggcggcctgagaaacgtgagcgcctactgcctgatgtacatcaacgacaagctgccctacttcaacgccgaggccgcccccaccgagagcgaccagatgagcgaggtggaggccctgagcgtggagctgaagcactacatccaggaggacaactggagattcgagcaggaggtggaggagtgggaggaggagcagagctgcaagatcccccagatggagagcagcaccaacagcagcagccaggactacagcaccagccaggagcccagcgtggccagcagccacggcgtgagatgcctgagcagcgagcacgccgtgatcgtgaaggagcagaccgcccaggccatcgccaacaccgccagagcctacgagaagagcggcgtggaggccgccctgagcgaggtgatgctgagccccgccatgcagggcgtgatcctggccatcgccaaggccagacagaccttcgacagagacggcagcgaggccggcctgatcaaggccttccacgaggagtacagcagactgtaccagctggccaaggagacccccaccagccacagcgaccccagactgcagcacgtgctggtgtacttcttccagaacgaggcccccaagagagtggtggagagaaccctgctggagcagttcgccgacaagaacctgagctacgacgagagaagcatcagcatcatgaaggtggcccaggccaagctgaaggagatcggccccgacgacatgaacatggaggagtacaagaagtggcacgaggactacagcctgttcagaaaggtgagcgtgtacctgctgaccggcctggagctgtaccagaagggcaagtaccaggaggccctgagctacctggtgtacgcctaccagagcaacgccgccctgctgatgaagggccccagaagaggcgtgaaggagagcgtgatcgccctgtacagaagaaagtgcctgctggagctgaacgccaaggccgccagcctgttcgagaccaacgacgaccacagcgtgaccgagggcatcaacgtgatgaacgagctgatcatcccctgcatccacctgatcatcaacaacgacatcagcaaggacgacctggacgccatcgaggtgatgagaaaccactggtgcagctacctgggccaggacatcgccgagaacctgcagctgtgcctgggcgagttcctgcccagactgctggaccccagcgccgagatcatcgtgctgaaggagccccccaccatcagacccaacagcccctacgacctgtgcagcagattcgccgccgtgatggagagcatccagggcgtgagcaccgtgaccgtgaagtag

SEQ ID NO: 104387 - DNA, 3138 bp, Artificial Sequence
  Description of Artificial Sequence: Synthetic coding sequence
atgaccgccgagctgcagcaggacgacgccgccggcgccgccgacggccacggcagcagctgccagatgctgctgaaccagctgagagagatcaccggcatccaggaccccagcttcctgcacgaggccctgaaggccagcaacggcgacatcacccaggccgtgagcctgctgaccgacgagagagtgaaggagcccagccaggacaccgtggccaccgagcccagcgaggtggagggcagcgccgccaacaaggaggtgctggccaaggtgatcgacctgacccacgacaacaaggacgacctgcaggccgccatcgccctgagcctgctggagagccccaagatccaggccgacggcagagacctgaacagaatgcacgaggccaccagcgccgagaccaagagaagcaagagaaagagatgcgaggtgtggggcgagaaccccaaccccaacgactggagaagagtggacggctggcccgtgggcctgaagaacgtgggcaacacctgctggttcagcgccgtgatccagagcctgttccagctgcccgagttcagaagactggtgctgagctacagcctgccccagaacgtgctggagaactgcagaagccacaccgagaagagaaacatcatgttcatgcaggagctgcagtacctgttcgccctgatgatgggcagcaacagaaagttcgtggaccccagcgccgccctggacctgctgaagggcgccttcagaagcagcgaggagcagcagcaggacgtgagcgagttcacccacaagctgctggactggctggaggacgccttccagctggccgtgaacgtgaacagccccagaaacaagagcgagaaccccatggtgcagctgttctacggcaccttcctgaccgagggcgtgagagagggcaagcccttctgcaacaacgagaccttcggccagtaccccctgcaggtgaacggctacagaaacctggacgagtgcctggagggcgccatggtggagggcgacgtggagctgctgcccagcgaccacagcgtgaagtacggccaggagagatggttcaccaagctgccccccgtgctgaccttcgagctgagcagattcgagttcaaccagagcctgggccagcccgagaagatccacaacaagctggagttcccccagatcatctacatggacagatacatgtacagaagcaaggagctgatcagaaacaagagagagtgcatcagaaagctgaaggaggagatcaagatcctgcagcagaagctggagagatacgtgaagtacggcagcggccccgccagattccccctgcccgacatgctgaagtacgtgatcgagttcgccagcaccaagcccgccagcgagagctgcccccccgagagcgacacccacatgaccctgcccctgagcagcgtgcactgcagcgtgagcgaccagaccagcaaggagagcaccagcaccgagagcagcagccaggacgtggagagcaccttcagcagccccgaggacagcctgcccaagagcaagcccctgaccagcagcagaagcagcatggagatgcccagccagcccgcccccagaaccgtgaccgacgaggagatcaacttcgtgaagacctgcctgcagagatggagaagcgagatcgagcaggacatccaggacctgaagacctgcatcgccagcaccacccagaccatcgagcagatgtactgcgaccccctgctgagacaggtgccctacagactgcacgccgtgctggtgcacgagggccaggccaacgccggccactactgggcctacatctacaaccagcccagacagagctggctgaagtacaacgacatcagcgtgaccgagagcagctgggaggaggtggagagagacagctacggcggcctgagaaacgtgagcgcctactgcctgatgtacatcaacgacaagctgccctacttcaacgccgaggccgcccccaccgagagcgaccagatgagcgaggtggaggccctgagcgtggagctgaagcactacatccaggaggacaactggagattcgagcaggaggtggaggagtgggaggaggagcagagctgcaagatcccccagatggagagcagcaccaacagcagcagccaggactacagcaccagccaggagcccagcgtggccagcagccacggcgtgagatgcctgagcagcgagcacgccgtgatcgtgaaggagcagaccgcccaggccatcgccaacaccgccagagcctacgagaagagcggcgtggaggccgccctgagcgaggccttccacgaggagtacagcagactgtaccagctggccaaggagacccccaccagccacagcgaccccagactgcagcacgtgctggtgtacttcttccagaacgaggcccccaagagagtggtggagagaaccctgctggagcagttcgccgacaagaacctgagctacgacgagagaagcatcagcatcatgaaggtggcccaggccaagctgaaggagatcggccccgacgacatgaacatggaggagtacaagaagtggcacgaggactacagcctgttcagaaaggtgagcgtgtacctgctgaccggcctggagctgtaccagaagggcaagtaccaggaggccctgagctacctggtgtacgcctaccagagcaacgccgccctgctgatgaagggccccagaagaggcgtgaaggagagcgtgatcgccctgtacagaagaaagtgcctgctggagctgaacgccaaggccgccagcctgttcgagaccaacgacgaccacagcgtgaccgagggcatcaacgtgatgaacgagctgatcatcccctgcatccacctgatcatcaacaacgacatcagcaaggacgacctggacgccatcgaggtgatgagaaaccactggtgcagctacctgggccaggacatcgccgagaacctgcagctgtgcctgggcgagttcctgcccagactgctggaccccagcgccgagatcatcgtgctgaaggagccccccaccatcagacccaacagcccctacgacctgtgcagcagattcgccgccgtgatggagagcatccagggcgtgagcaccgtgaccgtgaagtag

SEQ ID NO: 104388 - DNA, 1497 bp, Artificial Sequence
  Description of Artificial Sequence: Synthetic coding sequence
atgcagagccccccccacctggccgtgtgcagaagcaacaagagcccctgggtgtgcctgacctgcagcagcgtgcactgcggcagatacgtgaacggccacgccaagaagcactacgaggacgcccaggtgcccctgaccaaccacaagaagagcgagaagcaggacaaggtgcagcacaccgtgtgcatggactgcagcagctacagcacctactgctacagatgcgacgacttcgtggtgaacgacaccaagctgggcctggtgcagaaggtgagagagcacctgcagaacctggagaacagcgccttcaccgccgacagacacaagaagagaaagctgctggagaacagcaccctgaacagcaagctgctgaaggtgaacggcagcaccaccgccatctgcgccaccggcctgagaaacctgggcaacacctgcttcatgaacgccatcctgcagagcctgagcaacatcgagcagttctgctgctacttcaaggagctgcccgccgtggagctgagaaacggcaagaccgccggcagaagaacctaccacaccagaagccagggcgacaacaacgtgagcctggtggaggagttcagaaagaccctgtgcgccctgtggcagggcagccagaccgccttcagccccgagagcctgttctacgtggtgtggaagatcatgcccaacttcagaggctaccagcagcaggacgcccacgagttcatgagatacctgctggaccacctgcacctggagctgcagggcggcttcaacggcgtgagcagaagcgccatcctgcaggagaacagcaccctgagcgccagcaacaagtgctgcatcaacggcgccagcaccgtggtgaccgccatcttcggcggcatcctgcagaacgaggtgaactgcctgatctgcggcaccgagagcagaaagttcgaccccttcctggacctgagcctggacatccccagccagttcagaagcaagagaagcaagaaccaggagaacggccccgtgtgcagcctgagagactgcctgagaagcttcaccgacctggaggagctggacgagaccgagctgtacatgtgccacaagtgcaagaagaagcagaagagcaccaagaagttctggatccagaagctgcccaaggtgctgtgcctgcacctgaagagattccactggaccgcctacctgagaaacaaggtggacacctacgtggagttccccctgagaggcctggacatgaagtgctacctgctggagcccgagaacagcggccccgagagctgcctgtacgacctggccgccgtggtggtgcaccacggcagcggcgtgggcagcggccactacaccgcctacgccacccacgagggcagatggttccacttcaacgacagcaccgtgaccctgaccgacgaggagaccgtggtgaaggccaaggcctacatcctgttctacgtggagcaccaggccaaggccggcagcgacaagctgtag

SEQ ID NO: 104389 - DNA, 1563 bp, Artificial Sequence
  Description of Artificial Sequence: Synthetic coding sequence
atggagtgcccccacctgagcagcagcgtgtgcatcgcccccgacagcgccaagttccccaacggcagccccagcagctggtgctgcagcgtgtgcagaagcaacaagagcccctgggtgtgcctgacctgcagcagcgtgcactgcggcagatacgtgaacggccacgccaagaagcactacgaggacgcccaggtgcccctgaccaaccacaagaagagcgagaagcaggacaaggtgcagcacaccgtgtgcatggactgcagcagctacagcacctactgctacagatgcgacgacttcgtggtgaacgacaccaagctgggcctggtgcagaaggtgagagagcacctgcagaacctggagaacagcgccttcaccgccgacagacacaagaagagaaagctgctggagaacagcaccctgaacagcaagctgctgaaggtgaacggcagcaccaccgccatctgcgccaccggcctgagaaacctgggcaacacctgcttcatgaacgccatcctgcagagcctgagcaacatcgagcagttctgctgctacttcaaggagctgcccgccgtggagctgagaaacggcaagaccgccggcagaagaacctaccacaccagaagccagggcgacaacaacgtgagcctggtggaggagttcagaaagaccctgtgcgccctgtggcagggcagccagaccgccttcagccccgagagcctgttctacgtggtgtggaagatcatgcccaacttcagaggctaccagcagcaggacgcccacgagttcatgagatacctgctggaccacctgcacctggagctgcagggcggcttcaacggcgtgagcagaagcgccatcctgcaggagaacagcaccctgagcgccagcaacaagtgctgcatcaacggcgccagcaccgtggtgaccgccatcttcggcggcatcctgcagaacgaggtgaactgcctgatctgcggcaccgagagcagaaagttcgaccccttcctggacctgagcctggacatccccagccagttcagaagcaagagaagcaagaaccaggagaacggccccgtgtgcagcctgagagactgcctgagaagcttcaccgacctggaggagctggacgagaccgagctgtacatgtgccacaagtgcaagaagaagcagaagagcaccaagaagttctggatccagaagctgcccaaggtgctgtgcctgcacctgaagagattccactggaccgcctacctgagaaacaaggtggacacctacgtggagttccccctgagaggcctggacatgaagtgctacctgctggagcccgagaacagcggccccgagagctgcctgtacgacctggccgccgtggtggtgcaccacggcagcggcgtgggcagcggccactacaccgcctacgccacccacgagggcagatggttccacttcaacgacagcaccgtgaccctgaccgacgaggagaccgtggtgaaggccaaggcctacatcctgttctacgtggagcaccaggccaaggccggcagcgacaagctgtag

SEQ ID NO: 104390 - DNA, 471 bp, Artificial Sequence
  Description of Artificial Sequence: Synthetic coding sequence
atggagtgcccccacctgagcagcagcgtgtgcatcgcccccgacagcgccaagttccccaacggcagccccagcagctggtgctgcagcgtgtgcagaagcaacaagagcccctgggtgtgcctgacctgcagcagcgtgcactgcggcagatacgtgaacggccacgccaagaagcactacgaggacgcccaggtgcccctgaccaaccacaagaagagcgagaagcaggacaaggtgcagcacaccgtgtgcatggactgcagcagctacagcacctactgctacagatgcgacgacttcgtggtgaacgacaccaagctgggcctggtgcagaaggtgagagagcacctgcagaacctggagaacagcgccttcaccgccgacagacacaagaagagaaagctgctggagaacagcaccctgaacagcaagctgctgaaggtgaacgtgttcggcagaagagtgtag

SEQ ID NO: 104391 - DNA, 1071 bp, Artificial Sequence
  Description of Artificial Sequence: Synthetic coding sequence
atggactgcagcagctacagcacctactgctacagatgcgacgacttcgtggtgaacgacaccaagctgggcctggtgcagaaggtgagagagcacctgcagaacctggagaacagcgccttcaccgccgacagacacaagaagagaaagctgctggagaacagcaccctgaacagcaagctgctgaaggtgaacggcagcaccaccgccatctgcgccaccggcctgagaaacctgggcaacacctgcttcatgaacgccatcctgcagagcctgagcaacatcgagcagttctgctgctacttcaaggagctgcccgccgtggagctgagaaacggcaagaccgccggcagaagaacctaccacaccagaagccagggcgacaacaacgtgagcctggtggaggagttcagaaagaccctgtgcgccctgtggcagggcagccagaccgccttcagccccgagagcctgttctacgtggtgtggaagatcatgcccaacttcagaggctaccagcagcaggacgcccacgagttcatgagatacctgctggaccacctgcacctggagctgcagggcggcttcaacggcgtgagcagaagcgccatcctgcaggagaacagcaccctgagcgccagcaacaagtgctgcatcaacggcgccagcaccgtggtgaccgccatcttcggcggcatcctgcagaacgaggtgaactgcctgatctgcggcaccgagagcagaaagttcgaccccttcctggacctgagcctggacatccccagccagttcagaagcaagagaagcaagaaccaggagaacggccccgtgtgcagcctgagagactgcctgagaagcttcaccgacctggaggagctggacgagaccgagctgtacatgtgccacaagtgcaagaagaagcagaagagcaccaagaagttctggatccagaagctgcccaaggtgctgtgcctgcacctgaagagattccactggaccgcctacctgagaaacaaggtggacacctacgtggagttccccctgagaggcctggacatgaagtgctactactag

SEQ ID NO: 104392 - DNA, 816 bp, Artificial Sequence
  Description of Artificial Sequence: Synthetic coding sequence
atgcccaacttcagaggctaccagcagcaggacgcccacgagttcatgagatacctgctggaccacctgcacctggagctgcagggcggcttcaacggcgtgagcagaagcgccatcctgcaggagaacagcaccctgagcgccagcaacaagtgctgcatcaacggcgccagcaccgtggtgaccgccatcttcggcggcatcctgcagaacgaggtgaactgcctgatctgcggcaccgagagcagaaagttcgaccccttcctggacctgagcctggacatccccagccagttcagaagcaagagaagcaagaaccaggagaacggccccgtgtgcagcctgagagactgcctgagaagcttcaccgacctggaggagctggacgagaccgagctgtacatgtgccacaagtgcaagaagaagcagaagagcaccaagaagttctggatccagaagctgcccaaggtgctgtgcctgcacctgaagagattccactggaccgcctacctgagaaacaaggtggacacctacgtggagttccccctgagaggcctggacatgaagtgctacctgctggagcccgagaacagcggccccgagagctgcctgtacgacctggccgccgtggtggtgcaccacggcagcggcgtgggcagcggccactacaccgcctacgccacccacgagggcagatggttccacttcaacgacagcaccgtgaccctgaccgacgaggagaccgtggtgaaggccaaggcctacatcctgttctacgtggagcaccaggccaaggccggcagcgacaagctgtag

SEQ ID NO: 104393 - DNA, 1431 bp, Artificial Sequence
  Description of Artificial Sequence: Synthetic coding sequence
atggagtgcccccacctgagcagcagcgtgtgcatcgcccccgacagcgccaagttccccaacggcagccccagcagctggtgctgcagcgtgtgcagaagcaacaagagcccctgggtgtgcctgacctgcagcagcgtgcactgcggcagctacagatgcgacgacttcgtggtgaacgacaccaagctgggcctggtgcagaaggtgagagagcacctgcagaacctggagaacagcgccttcaccgccgacagacacaagaagagaaagctgctggagaacagcaccctgaacagcaagctgctgaaggtgaacggcagcaccaccgccatctgcgccaccggcctgagaaacctgggcaacacctgcttcatgaacgccatcctgcagagcctgagcaacatcgagcagttctgctgctacttcaaggagctgcccgccgtggagctgagaaacggcaagaccgccggcagaagaacctaccacaccagaagccagggcgacaacaacgtgagcctggtggaggagttcagaaagaccctgtgcgccctgtggcagggcagccagaccgccttcagccccgagagcctgttctacgtggtgtggaagatcatgcccaacttcagaggctaccagcagcaggacgcccacgagttcatgagatacctgctggaccacctgcacctggagctgcagggcggcttcaacggcgtgagcagaagcgccatcctgcaggagaacagcaccctgagcgccagcaacaagtgctgcatcaacggcgccagcaccgtggtgaccgccatcttcggcggcatcctgcagaacgaggtgaactgcctgatctgcggcaccgagagcagaaagttcgaccccttcctggacctgagcctggacatccccagccagttcagaagcaagagaagcaagaaccaggagaacggccccgtgtgcagcctgagagactgcctgagaagcttcaccgacctggaggagctggacgagaccgagctgtacatgtgccacaagtgcaagaagaagcagaagagcaccaagaagttctggatccagaagctgcccaaggtgctgtgcctgcacctgaagagattccactggaccgcctacctgagaaacaaggtggacacctacgtggagttccccctgagaggcctggacatgaagtgctacctgctggagcccgagaacagcggccccgagagctgcctgtacgacctggccgccgtggtggtgcaccacggcagcggcgtgggcagcggccactacaccgcctacgccacccacgagggcagatggttccacttcaacgacagcaccgtgaccctgaccgacgaggagaccgtggtgaaggccaaggcctacatcctgttctacgtggagcaccaggccaaggccggcagcgacaagctgtag

SEQ ID NO: 104394 - DNA, 168 bp, Artificial Sequence
  Description of Artificial Sequence: Synthetic coding sequence
atggagtgcccccacctgagcagcagcgtgtgcatcgcccccgacagcgccaagttccccaacggcagccccagcagctggtgctgcagcgtgtgcagaagcaacaagagcccctgggtgtgcctgacctgcagcagcgtgcactgcggcagaatctggggcacctag

SEQ ID NO: 104395 - DNA, 1554 bp, Artificial Sequence
  Description of Artificial Sequence: Synthetic coding sequence
atgctgagcagcagagccgaggccgccatgaccgccgccgacagagccatccagagattcctgagaaccggcgccgccgtgagatacaaggtgatgaagaactggggcgtgatcggcggcatcgccgccgccctggccgccggcatctacgtgatctggggccccatcaccgagagaaagaagagaagaaagggcctggtgcccggcctggtgaacctgggcaacacctgcttcatgaacagcctgctgcagggcctgagcgcctgccccgccttcatcagatggctggaggagttcaccagccagtacagcagagaccagaaggagccccccagccaccagtacctgagcctgaccctgctgcacctgctgaaggccctgagctgccaggaggtgaccgacgacgaggtgctggacgccagctgcctgctggacgtgctgagaatgtacagatggcagatcagcagcttcgaggagcaggacgcccacgagctgttccacgtgatcaccagcagcctggaggacgagagagacagacagcccagagtgacccacctgttcgacgtgcacagcctggagcagcagagcgagatcacccccaagcagatcacctgcagaaccagaggcagcccccaccccaccagcaaccactggaagagccagcaccccttccacggcagactgaccagcaacatggtgtgcaagcactgcgagcaccagagccccgtgagattcgacaccttcgacagcctgagcctgagcatccccgccgccacctggggccaccccctgaccctggaccactgcctgcaccacttcatcagcagcgagagcgtgagagacgtggtgtgcgacaactgcaccaagatcgaggccaagggcaccctgaacggcgagaaggtggagcaccagagaaccaccttcgtgaagcagctgaagctgggcaagctgccccagtgcctgtgcatccacctgcagagactgagctggagcagccacggcacccccctgaagagacacgagcacgtgcagttcaacgagttcctgatgatggacatctacaagtaccacctgctgggccacaagcccagccagcacaaccccaagctgaacaagaaccccggccccaccctggagctgcaggacggccccggcgcccccacccccgtgctgaaccagcccggcgcccccaagacccagatcttcatgaacggcgcctgcagccccagcctgctgcccaccctgagcgcccccatgcccttccccctgcccgtggtgcccgactacagcagcagcacctacctgttcagactgatggccgtggtggtgcaccacggcgacatgcacagcggccacttcgtgacctacagaagaagcccccccagcgccagaaaccccctgagcaccagcaaccagtggctgtgggtgagcgacgacaccgtgagaaaggccagcctgcaggaggtgctgagcagcagcgcctacctgctgttctacgagagagtgctgagcagaatgcagcaccagagccaggagtgcaagagcgaggagtag

SEQ ID NO: 104396 - DNA, 4815 bp, Artificial Sequence
  Description of Artificial Sequence: Synthetic coding sequence
atgggcgccaaggagagcagaatcggcttcctgagctacgaggaggccctgagaagagtgaccgacgtggagctgaagagactgaaggacgccttcaagagaacctgcggcctgagctactacatgggccagcactgcttcatcagagaggtgctgggcgacggcgtgccccccaaggtggccgaggtgatctactgcagcttcggcggcaccagcaagggcctgcacttcaacaacctgatcgtgggcctggtgctgctgaccagaggcaaggacgaggagaaggccaagtacatcttcagcctgttcagcagcgagagcggcaactacgtgatcagagaggagatggagagaatgctgcacgtggtggacggcaaggtgcccgacaccctgagaaagtgcttcagcgagggcgagaaggtgaactacgagaagttcagaaactggctgttcctgaacaaggacgccttcaccttcagcagatggctgctgagcggcggcgtgtacgtgaccctgaccgacgacagcgacacccccaccttctaccagaccctggccggcgtgacccacctggaggagagcgacatcatcgacctggagaagagatactggctgctgaaggcccagagcagaaccggcagattcgacctggagaccttcggccccctggtgagcccccccatcagacccagcctgagcgagggcctgttcaacgccttcgacgagaacagagacaaccacatcgacttcaaggagatcagctgcggcctgagcgcctgctgcagaggccccctggccgagagacagaagttctgcttcaaggtgttcgacgtggacagagacggcgtgctgagcagagtggagctgagagacatggtggtggccctgctggaggtgtggaaggacaacagaaccgacgacatccccgagctgcacatggacctgagcgacatcgtggagggcatcctgaacgcccacgacaccaccaagatgggccacctgaccctggaggactaccagatctggagcgtgaagaacgtgctggccaacgagttcctgaacctgctgttccaggtgtgccacatcgtgctgggcctgagacccgccacccccgaggaggagggccagatcatcagaggctggctggagagagagagcagatacggcctgcaggccggccacaactggttcatcatcagcatgcagtggtggcagcagtggaaggagtacgtgaagtacgacgccaaccccgtggtgatcgagcccagcagcgtgctgaacggcggcaagtacagcttcggcaccgccgcccaccccatggagcaggtggaggacagaatcggcagcagcctgagctacgtgaacaccaccgaggagaagttcagcgacaacatcagcaccgccagcgaggccagcgagaccgccggcagcggcttcctgtacagcgccacccccggcgccgacgtgtgcttcgccagacagcacaacaccagcgacaacaacaaccagtgcctgctgggcgccaacggcaacatcctgctgcacctgaacccccagaagcccggcgccatcgacaaccagcccctggtgacccaggagcccgtgaaggccaccagcctgaccctggagggcggcagactgaagagaaccccccagctgatccacggcagagactacgagatggtgcccgagcccgtgtggagagccctgtaccactggtacggcgccaacctggccctgcccagacccgtgatcaagaacagcaagaccgacatccccgagctggagctgttccccagatacctgctgttcctgagacagcagcccgccaccagaacccagcagagcaacatctgggtgaacatgggcaacgtgcccagccccaacgcccccctgaagagagtgctggcctacaccggctgcttcagcagaatgcagaccatcaaggagatccacgagtacctgagccagagactgagaatcaaggaggaggacatgagactgtggctgtacaacagcgagaactacctgaccctgctggacgacgaggaccacaagctggagtacctgaagatccaggacgagcagcacctggtgatcgaggtgagaaacaaggacatgagctggcccgaggagatgagcttcatcgccaacagcagcaagatcgacagacacaaggtgcccaccgagaagggcgccaccggcctgagcaacctgggcaacacctgcttcatgaacagcagcatccagtgcgtgagcaacacccagcccctgacccagtacttcatcagcggcagacacctgtacgagctgaacagaaccaaccccatcggcatgaagggccacatggccaagtgctacggcgacctggtgcaggagctgtggagcggcacccagaagaacgtggcccccctgaagctgagatggaccatcgccaagtacgcccccagattcaacggcttccagcagcaggacagccaggagctgctggccttcctgctggacggcctgcacgaggacctgaacagagtgcacgagaagccctacgtggagctgaaggacagcgacggcagacccgactgggaggtggccgccgaggcctgggacaaccacctgagaagaaacagaagcatcgtggtggacctgttccacggccagctgagaagccaggtgaagtgcaagacctgcggccacatcagcgtgagattcgaccccttcaacttcctgagcctgcccctgcccatggacagctacatgcacctggagatcaccgtgatcaagctggacggcaccacccccgtgagatacggcctgagactgaacatggacgagaagtacaccggcctgaagaagcagctgagcgacctgtgcggcctgaacagcgagcagatcctgctggccgaggtgcacggcagcaacatcaagaacttcccccaggacaaccagaaggtgagactgagcgtgagcggcttcctgtgcgccttcgagatccccgtgcccgtgagccccatcagcgccagcagccccacccagaccgacttcagcagcagccccagcaccaacgagatgttcaccctgaccaccaacggcgacctgcccagacccatcttcatccccaacggcatgcccaacaccgtggtgccctgcggcaccgagaagaacttcaccaacggcatggtgaacggccacatgcccagcctgcccgacagccccttcaccggctacatcatcgccgtgcacagaaagatgatgagaaccgagctgtacttcctgagcagccagaagaacagacccagcctgttcggcatgcccctgatcgtgccctgcaccgtgcacaccagaaagaaggacctgtacgacgccgtgtggatccaggtgagcagactggccagccccctgcccccccaggaggccagcaaccacgcccaggactgcgacgacagcatgggctaccagtaccccttcaccctgagagtggtgcagaaggacggcaacagctgcgcctggtgcccctggtacagattctgcagaggctgcaagatcgactgcggcgaggacagagccttcatcggcaacgcctacatcgccgtggactgggaccccaccgccctgcacctgagataccagaccagccaggagagagtggtggacgagcacgagagcgtggagcagagcagaagagcccaggccgagcccatcaacctggacagctgcctgagagccttcaccagcgaggaggagctgggcgagaacgagatgtactactgcagcaagtgcaagacccactgcctggccaccaagaagctggacctgtggagactgccccccatcctgatcatccacctgaagagattccagttcgtgaacggcagatggatcaagagccagaagatcgtgaagttccccagagagagcttcgaccccagcgccttcctggtgcccagagaccccgccctgtgccagcacaagcccctgaccccccagggcgacgagctgagcgagcccagaatcctggccagagaggtgaagaaggtggacgcccagagcagcgccggcgaggaggacgtgctgctgagcaagagccccagcagcctgagcgccaacatcatcagcagccccaagggcagccccagcagcagcagaaagagcggcaccagctgccccagcagcaagaacagcagccccaacagcagccccagaaccctgggcagaagcaagggcagactgagactgccccagatcggcagcaagaacaagctgagcagcagcaaggagaacctggacgccagcaaggagaacggcgccggccagatctgcgagctggccgacgccctgagcagaggccacgtgctgggcggcagccagcccgagctggtgaccccccaggaccacgaggtggccctggccaacggcttcctgtacgagcacgaggcctgcggcaacggctacagcaacggccagctgggcaaccacagcgaggaggacagcaccgacgaccagagagaggacaccagaatcaagcccatctacaacctgtacgccatcagctgccacagcggcatcctgggcggcggccactacgtgacctacgccaagaaccccaactgcaagtggtactgctacaacgacagcagctgcaaggagctgcaccccgacgagatcgacaccgacagcgcctacatcctgttctacgagcagcagggcatcgactacgcccagttcctgcccaagaccgacggcaagaagatggccgacaccagcagcatggacgaggacttcgagagcgactacaagaagtactgcgtgctgcagtag

SEQ ID NO: 104397 - DNA, 1173 bp, Artificial Sequence
  Description of Artificial Sequence: Synthetic coding sequence
atgggcgccaaggagagcagaatcggcttcctgagctacgaggaggccctgagaagagtgaccgacgtggagctgaagagactgaaggacgccttcaagagaacctgcggcctgagctactacatgggccagcactgcttcatcagagaggtgctgggcgacggcgtgccccccaaggtggccgaggtgatctactgcagcttcggcggcaccagcaagggcctgcacttcaacaacctgatcgtgggcctggtgctgctgaccagaggcaaggacgaggagaaggccaagtacatcttcagcctgttcagcagcgagagcggcaactacgtgatcagagaggagatggagagaatgctgcacgtggtggacggcaaggtgcccgacaccctgagaaagtgcttcagcgagggcgagaaggtgaactacgagaagttcagaaactggctgttcctgaacaaggacgccttcaccttcagcagatggctgctgagcggcggcgtgtacgtgaccctgaccgacgacagcgacacccccaccttctaccagaccctggccggcgtgacccacctggaggagagcgacatcatcgacctggagaagagatactggctgctgaaggcccagagcagaaccggcagattcgacctggagaccttcggccccctggtgagcccccccatcagacccagcctgagcgagggcctgttcaacgccttcgacgagaacagagacaaccacatcgacttcaaggagatcagctgcggcctgagcgcctgctgcagaggccccctggccgagagacagaagttctgcttcaaggtgttcgacgtggacagagacggcgtgctgagcagagtggagctgagagacatggtggtggccctgctggaggtgtggaaggacaacagaaccgacgacatccccgagctgcacatggacctgagcgacatcgtggagggcatcctgaacgcccacgacaccaccaagatgggccacctgaccctggaggactaccagatctggagcgtgaagaacgtgctggccaacgagttcctgaacctgctgttccaggtgtgccacatcgtgctgggcctgagacccgccacccccgaggaggagggccagatcatcagaaccctggagaccgaccagatctacaccagaaactag

SEQ ID NO: 104398 - DNA, 3372 bp, Artificial Sequence
  Description of Artificial Sequence: Synthetic coding sequence
atgcccatcgtggacaagctgaaggaggccctgaagcccggcagaaaggacagcgccgacgacggcgagctgggcaagctgctggccagcagcgccaagaaggtgctgctgcagaagatcgagttcgagcccgccagcaagagcttcagctaccagctggaggccctgaagagcaagtacgtgctgctgaaccccaagaccgagggcgccagcagacacaagagcggcgacgacccccccgccagaagacagggcagcgagcacacctacgagagctgcggcgacggcgtgcccgccccccagaaggtgctgttccccaccgagagactgagcctgagatgggagagagtgttcagagtgggcgccggcctgcacaacctgggcaacacctgcttcctgaacgccaccatccagtgcctgacctacaccccccccctggccaactacctgctgagcaaggagcacgccagaagctgccaccagggcagcttctgcatgctgtgcgtgatgcagaaccacatcgtgcaggccttcgccaacagcggcaacgccatcaagcccgtgagcttcatcagagacctgaagaagatcgccagacacttcagattcggcaaccaggaggacgcccacgagttcctgagatacaccatcgacgccatgcagaaggcctgcctgaacggctgcgccaagctggacagacagacccaggccaccaccctggtgcaccagatcttcggcggctacctgagaagcagagtgaagtgcagcgtgtgcaagagcgtgagcgacacctacgacccctacctggacgtggccctggagatcagacaggccgccaacatcgtgagagccctggagctgttcgtgaaggccgacgtgctgagcggcgagaacgcctacatgtgcgccaagtgcaagaagaaggtgcccgccagcaagagattcaccatccacagaaccagcaacgtgctgaccctgagcctgaagagattcgccaacttcagcggcggcaagatcaccaaggacgtgggctaccccgagttcctgaacatcagaccctacatgagccagaacaacggcgaccccgtgatgtacggcctgtacgccgtgctggtgcacagcggctacagctgccacgccggccactactactgctacgtgaaggccagcaacggccagtggtaccagatgaacgacagcctggtgcacagcagcaacgtgaaggtggtgctgaaccagcaggcctacgtgctgttctacctgagaatccccggcagcaagaagagccccgagggcctgatcagcagaaccggcagcagcagcctgcccggcagacccagcgtgatccccgaccacagcaagaagaacatcggcaacggcatcatcagcagccccctgaccggcaagagacaggacagcggcaccatgaagaagccccacaccaccgaggagatcggcgtgcccatcagcagaaacggcagcaccctgggcctgaagagccagaacggctgcatcccccccaagctgcccagcggcagccccagccccaagctgagccagacccccacccacatgcccaccatcctggacgaccccggcaagaaggtgaagaagcccgcccccccccagcacttcagccccagaaccgcccagggcctgcccggcaccagcaacagcaacagcagcagaagcggcagccagagacagggcagctgggacagcagagacgtggtgctgagcaccagccccaagctgctggccaccgccaccgccaacggccacggcctgaagggcaacgacgagagcgccggcctggacagaagaggcagcagcagcagcagccccgagcacagcgccagcagcgacagcaccaaggccccccagacccccagaagcggcgccgcccacctgtgcgacagccaggagaccaactgcagcaccgccggccacagcaagaccccccccagcggcgccgacagcaagaccgtgaagctgaagagccccgtgctgagcaacaccaccaccgagcccgccagcaccatgagccccccccccgccaagaagctggccctgagcgccaagaaggccagcaccctgtggagagccaccggcaacgacctgagaccccccccccccagccccagcagcgacctgacccaccccatgaagaccagccaccccgtggtggccagcacctggcccgtgcacagagccagagccgtgagccccgccccccagagcagcagcagactgcagccccccttcagcccccaccccaccctgctgagcagcacccccaagccccccggcaccagcgagcccagaagctgcagcagcatcagcaccgccctgccccaggtgaacgaggacctggtgagcctgccccaccagctgcccgaggccagcgagcccccccagagccccagcgagaagagaaagaagaccttcgtgggcgagccccagagactgggcagcgagaccagactgccccagcacatcagagaggccaccgccgccccccacggcaagagaaagagaaagaagaagaagagacccgaggacaccgccgccagcgccctgcaggagggccagacccagagacagcccggcagccccatgtacagaagagagggccaggcccagctgcccgccgtgagaagacaggaggacggcacccagccccaggtgaacggccagcaggtgggctgcgtgaccgacggccaccacgccagcagcagaaagagaagaagaaagggcgccgagggcctgggcgaggagggcggcctgcaccaggaccccctgagacacagctgcagccccatgggcgacggcgaccccgaggccatggaggagagccccagaaagaagaagaagaagaagagaaagcaggagacccagagagccgtggaggaggacggccacctgaagtgccccagaagcgccaagccccaggacgccgtggtgcccgagagcagcagctgcgcccccagcgccaacggctggtgccccggcgacagaatgggcctgagccaggccccccccgtgagctggaacggcgagagagagagcgacgtggtgcaggagctgctgaagtacagcagcgacaaggcctacggcagaaaggtgctgacctgggacggcaagatgagcgccgtgagccaggacgccatcgaggacagcagacaggccagaaccgagaccgtggtggacgactgggacgaggagttcgacagaggcaaggagaagaagatcaagaagttcaagagagagaagagaagaaacttcaacgccttccagaagctgcagaccagaagaaacttctggagcgtgacccaccccgccaaggccgccagcctgagctacagaagatag

SEQ ID NO: 104399 - DNA, 1647 bp, Artificial Sequence
  Description of Artificial Sequence: Synthetic coding sequence
atgcccatcgtggacaagctgaaggaggccctgaagcccggcagaaaggacagcgccgacgacggcgagctgggcaagctgctggccagcagcgccaagaaggtgctgctgcagaagatcgagttcgagcccgccagcaagagcttcagctaccagctggaggccctgaagagcaagtacgtgctgctgaaccccaagaccgagggcgccagcagacacaagagcggcgacgacccccccgccagaagacagggcagcgagcacacctacgagagctgcggcgacggcgtgcccgccccccagaaggtgctgttccccaccgagagactgagcctgagatgggagagagtgttcagagtgggcgccggcctgcacaacctgggcaacacctgcttcctgaacgccaccatccagtgcctgacctacaccccccccctggccaactacctgctgagcaaggagcacgccagaagctgccaccagggcagcttctgcatgctgtgcgtgatgcagaaccacatcgtgcaggccttcgccaacagcggcaacgccatcaagcccgtgagcttcatcagagacctgaagaagatcgccagacacttcagattcggcaaccaggaggacgcccacgagttcctgagatacaccatcgacgccatgcagaaggcctgcctgaacggctgcgccaagctggacagacagacccaggccaccaccctggtgcaccagatcttcggcggctacctgagaagcagagtgaagtgcagcgtgtgcaagagcgtgagcgacacctacgacccctacctggacgtggccctggagatcagacaggccgccaacatcgtgagagccctggagctgttcgtgaaggccgacgtgctgagcggcgagaacgcctacatgtgcgccaagtgcaagaagaaggtgcccgccagcaagagattcaccatccacagaaccagcaacgtgctgaccctgagcctgaagagattcgccaacttcagcggcggcaagatcaccaaggacgtgggctaccccgagttcctgaacatcagaccctacatgagccagaacaacggcgaccccgtgatgtacggcctgtacgccgtgctggtgcacagcggctacagctgccacgccggccactactactgctacgtgaaggccagcaacggccagtggtaccagatgaacgacagcctggtgcacagcagcaacgtgaaggtggtgctgaaccagcaggcctacgtgctgttctacctgagaatccccggcagcaagaagagccccgagggcctgatcagcagaaccggcagcagcagcctgcccggcagacccagcgtgatccccgaccacagcaagaagaacatcggcaacggcatcatcagcagccccctgaccggcaagagacaggacagcggcaccatgaagaagccccacaccaccgaggagatcggcgtgcccatcagcagaaacggcagcaccctgggcctgaagagccagaacggctgcatcccccccaagctgcccagcggcagccccagccccaagctgagccagacccccacccacatgcccaccatcctggacgaccccggcaagaaggtgaagaagcccgccccccccctgcccaccggcatgggctag

SEQ ID NO: 104400 - DNA, 2187 bp, Artificial Sequence
  Description of Artificial Sequence: Synthetic coding sequence
atgtgcgccaagtgcaagaagaaggtgcccgccagcaagagattcaccatccacagaaccagcaacgtgctgaccctgagcctgaagagattcgccaacttcagcggcggcaagatcaccaaggacgtgggctaccccgagttcctgaacatcagaccctacatgagccagaacaacggcgaccccgtgatgtacggcctgtacgccgtgctggtgcacagcggctacagctgccacgccggccactactactgctacgtgaaggccagcaacggccagtggtaccagatgaacgacagcctggtgcacagcagcaacgtgaaggtggtgctgaaccagcaggcctacgtgctgttctacctgagaatccccggcagcaagaagagccccgagggcctgatcagcagaaccggcagcagcagcctgcccggcagacccagcgtgatccccgaccacagcaagaagaacatcggcaacggcatcatcagcagccccctgaccggcaagagacaggacagcggcaccatgaagaagccccacaccaccgaggagatcggcgtgcccatcagcagaaacggcagcaccctgggcctgaagagccagaacggctgcatcccccccaagctgcccagcggcagccccagccccaagctgagccagacccccacccacatgcccaccatcctggacgaccccggcaagaaggtgaagaagcccgcccccccccagcacttcagccccagaaccgcccagggcctgcccggcaccagcaacagcaacagcagcagaagcggcagccagagacagggcagctgggacagcagagacgtggtgctgagcaccagccccaagctgctggccaccgccaccgccaacggccacggcctgaagggcaacgacgagagcgccggcctggacagaagaggcagcagcagcagcagccccgagcacagcgccagcagcgacagcaccaaggccccccagacccccagaagcggcgccgcccacctgtgcgacagccaggagaccaactgcagcaccgccggccacagcaagaccccccccagcggcgccgacagcaagaccgtgaagctgaagagccccgtgctgagcaacaccaccaccgagcccgccagcaccatgagccccccccccgccaagaagctggccctgagcgccaagaaggccagcaccctgtggagagccaccggcaacgacctgagaccccccccccccagccccagcagcgacctgacccaccccatgaagaccagccaccccgtggtggccagcacctggcccgtgcacagagccagagccgtgagccccgccccccagagcagcagcagactgcagccccccttcagcccccaccccaccgccgccagcgccctgcaggagggccagacccagagacagcccggcagccccatgtacagaagagagggccaggcccagctgcccgccgtgagaagacaggaggacggcacccagccccaggtgaacggccagcaggtgggctgcgtgaccgacggccaccacgccagcagcagaaagagaagaagaaagggcgccgagggcctgggcgaggagggcggcctgcaccaggaccccctgagacacagctgcagccccatgggcgacggcgaccccgaggccatggaggagagccccagaaagaagaagaagaagaagagaaagcaggagacccagagagccgtggaggaggacggccacctgaagtgccccagaagcgccaagccccaggacgccgtggtgcccgagagcagcagctgcgcccccagcgccaacggctggtgccccggcgacagaatgggcctgagccaggccccccccgtgagctggaacggcgagagagagagcgacgtggtgcaggagctgctgaagtacagcagcgacaaggcctacggcagaaaggtgctgacctgggacggcaagatgagcgccgtgagccaggacgccatcgaggacagcagacaggccagaaccgagaccgtggtggacgactgggacgaggagttcgacagaggcaaggagaagaagatcaagaagttcaagagagagaagagaagaaacttcaacgccttccagaagctgcagaccagaagaaacttctggagcgtgacccaccccgccaaggccgccagcctgagctacagaagatag

SEQ ID NO: 104401 - DNA, 3372 bp, Artificial Sequence; identical to SEQ ID NO: 104398
  Description of Artificial Sequence: Synthetic coding sequence

SEQ ID NO: 104402 - DNA, 1698 bp, Artificial Sequence
  Description of Artificial Sequence: Synthetic coding sequence
atgagcggcagaagcaagagagagagcagaggcagcaccagaggcaagagagagagcgagagcagaggcagcagcggcagagtgaagagagagagagacagagagagagagcccgaggccgccagcagcagaggcagccccgtgagagtgaagagagagttcgagcccgccagcgccagagaggcccccgccagcgtggtgcccttcgtgagagtgaagagagagagagaggtggacgaggacagcgagcccgagagagaggtgagagccaagaacggcagagtggacagcgaggacagaagaagcagacactgcccctacctggacaccatcaacagaagcgtgctggacttcgacttcgagaagctgtgcagcatcagcctgagccacatcaacgcctacgcctgcctggtgtgcggcaagtacttccagggcagaggcctgaagagccacgcctacatccacagcgtgcagttcagccaccacgtgttcctgaacctgcacaccctgaagttctactgcctgcccgacaactacgagatcatcgacagcagcctggaggacatcacctacgtgctgaagcccaccttcaccaagcagcagatcgccaacctggacaagcaggccaagctgagcagagcctacgacggcaccacctacctgcccggcatcgtgggcctgaacaacatcaaggccaacgactacgccaacgccgtgctgcaggccctgagcaacgtgccccccctgagaaactacttcctggaggaggacaactacaagaacatcaagagaccccccggcgacatcatgttcctgctggtgcagagattcggcgagctgatgagaaagctgtggaaccccagaaacttcaaggcccacgtgagcccccacgagatgctgcaggccgtggtgctgtgcagcaagaagaccttccagatcaccaagcagggcgacggcgtggacttcctgagctggttcctgaacgccctgcacagcgccctgggcggcaccaagaagaagaagaagaccatcgtgaccgacgtgttccagggcagcatgagaatcttcaccaagaagctgccccaccccgacctgcccgccgaggagaaggagcagctgctgcacaacgacgagtaccaggagaccatggtggagagcaccttcatgtacctgaccctggacctgcccaccgcccccctgtacaaggacgagaaggagcagctgatcatcccccaggtgcccctgttcaacatcctggccaagttcaacggcatcaccgagaaggagtacaagacctacaaggagaacttcctgaagagattccagctgaccaagctgcccccctacctgatcttctgcatcaagagattcaccaagaacaacttcttcgtggagaagaaccccaccatcgtgaacttccccatcaccaacgtggacctgagagagtacctgagcgaggaggtgcaggccgtgcacaagaacaccacctacgacctgatcgccaacatcgtgcacgacggcaagcccagcgagggcagctacagaatccacgtgctgcaccacggcaccggcaagtggtacgagctgcaggacctgcaggtgaccgacatcctgccccagatgatcaccctgagcgaggcctacatccagatctggaagagaagagacaacgacgagaccaaccagcagggcgcctag

SEQ ID NO: 104403 - DNA, 1698 bp, Artificial Sequence; identical to SEQ ID NO: 104402
  Description of Artificial Sequence: Synthetic coding sequence

SEQ ID NO: 104404 - DNA, 1389 bp, Artificial Sequence
  Description of Artificial Sequence: Synthetic coding sequence
atgctgaccgccgtgcccagccacctgttcagcgccaagaacggcagagtggacagcgaggacagaagaagcagacactgcccctacctggacaccatcaacagcttcagccccttccccaccggcagaggcctgaagagccacgcctacatccacagcgtgcagttcagccaccacgtgttcctgaacctgcacaccctgaagttctactgcctgcccgacaactacgagatcatcgacagcagcctggaggacatcacctacgtgctgaagcccaccttcaccaagcagcagatcgccaacctggacaagcaggccaagctgagcagagcctacgacggcaccacctacctgcccggcatcgtgggcctgaacaacatcaaggccaacgactacgccaacgccgtgctgcaggccctgagcaacgtgccccccctgagaaactacttcctggaggaggacaactacaagaacatcaagagaccccccggcgacatcatgttcctgctggtgcagagattcggcgagctgatgagaaagctgtggaaccccagaaacttcaaggcccacgtgagcccccacgagatgctgcaggccgtggtgctgtgcagcaagaagaccttccagatcaccaagcagggcgacggcgtggacttcctgagctggttcctgaacgccctgcacagcgccctgggcggcaccaagaagaagaagaagaccatcgtgaccgacgtgttccagggcagcatgagaatcttcaccaagaagctgccccaccccgacctgcccgccgaggagaaggagcagctgctgcacaacgacgagtaccaggagaccatggtggagagcaccttcatgtacctgaccctggacctgcccaccgcccccctgtacaaggacgagaaggagcagctgatcatcccccaggtgcccctgttcaacatcctggccaagttcaacggcatcaccgagaaggagtacaagacctacaaggagaacttcctgaagagattccagctgaccaagctgcccccctacctgatcttctgcatcaagagattcaccaagaacaacttcttcgtggagaagaaccccaccatcgtgaacttccccatcaccaacgtggacctgagagagtacctgagcgaggaggtgcaggccgtgcacaagaacaccacctacgacctgatcgccaacatcgtgcacgacggcaagcccagcgagggcagctacagaatccacgtgctgcaccacggcaccggcaagtggtacgagctgcaggacctgcaggtgaccgacatcctgccccagatgatcaccctgagcgaggcctacatccagatctggaagagaagagacaacgacgagaccaaccagcagggcgcctag

SEQ ID NO: 104405 - DNA, 1467 bp, Artificial Sequence
  Description of Artificial Sequence: Synthetic coding sequence
atgagcggcagaagcaagagagagagcagaggcagcaccagaggcaagagagagagcgagagcagaggcagcagcggcagagtgaagagagagagagacagagagagagagcccgaggccgccagcagcagaggcagccccgtgagagtgaagagagagttcgagcccgccagcgccagagaggcccccgccagcgtggtgcccttcgtgagagtgaagagagagagagaggtggacgaggacagcgagcccgagagagaggtgagagccaagaacggcagagtggacagcgaggacagaagaagcagacactgcccctacctggacaccatcaacagaagcgtgctggacttcgacttcgagaagctgtgcagcatcagcctgagccacatcaacgcctacgcctgcctggtgtgcggcaagtacttccagggcagaggcctgaagagccacgcctacatccacagcgtgcagttcagccaccacgtgttcctgaacctgcacaccctgaagttctactgcctgcccgacaactacgagatcatcgacagcagcctggaggacatcacctacgtgctgaagcccaccttcaccaagcagcagatcgccaacctggacaagcaggccaagctgagcagagcctacgacggcaccacctacctgcccggcatcgtgggcctgaacaacatcaaggccaacgactacgccaacgccgtgctgcaggccctgagcaacgtgccccccctgagaaactacttcctggaggaggacaactacaagaacatcaagagaccccccggcgacatcatgttcctgctggtgcagagattcggcgagctgatgagaaagctgtggaaccccagaaacttcaaggcccacgtgagcccccacgagatgctgcaggccgtggtgctgtgcagcaagaagaccttccagatcaccaagcagggcgacggcgtggacttcctgagctggttcctgaacgccctgcacagcgccctgggcggcaccaagaagaagaagaagaccatcgtgaccgacgtgttccagggcagcatgagaatcttcaccaagaagctgccccaccccgacctgcccgccgaggagaaggagcagctgctgcacaacgacgagtaccaggagaccatggtggagagcaccttcatgtacctgaccctggacctgcccaccgcccccctgtacaaggacgagaaggagcagctgatcatcccccaggtgcccctgttcaacatcctggccaagttcaacggcatcaccgagaaggagtacaagacctacaaggagaacttcctgaagagattccagctgaccaagctgcccccctacctgatcttctgcatcaagagattcaccaagaacaacttcttcgtggagaagaaccccaccatcgtgaacttccccatcaccggccaggccaacggcatgaactacaagaccagcagatag

SEQ ID NO: 104406 - DNA, 2892 bp, Artificial Sequence
  Description of Artificial Sequence: Synthetic coding sequence
atggccgagggcggcggctgcagagagagacccgacgccgagacccagaagagcgagctgggccccctgatgagaaccaccctgcagagaggcgcccagtggtacctgatcgacagcagatggttcaagcagtggaagaagtacgtgggcttcgacagctgggacatgtacaacgtgggcgagcacaacctgttccccggccccatcgacaacagcggcctgttcagcgaccccgagagccagaccctgaaggagcacctgatcgacgagctggactacgtgctggtgcccaccgaggcctggaacaagctgctgaactggtacggctgcgtggagggccagcagcccatcgtgagaaaggtggtggagcacggcctgttcgtgaagcactgcaaggtggaggtgtacctgctggagctgaagctgtgcgagaacagcgaccccaccaacgtgctgagctgccacttcagcaaggccgacaccatcgccaccatcgagaaggagatgagaaagctgttcaacatccccgccgagagagagaccagactgtggaacaagtacatgagcaacacctacgagcagctgagcaagctggacaacaccgtgcaggacgccggcctgtaccagggccaggtgctggtgatcgagccccagaacgaggacggcacctggcccagacagaccctgcagagcaagagcagcaccgcccccagcagaaacttcaccaccagccccaagagcagcgccagcccctacagcagcgtgagcgccagcctgatcgccaacggcgacagcaccagcacctgcggcatgcacagcagcggcgtgagcagaggcggcagcggcttcagcgccagctacaactgccaggagccccccagcagccacatccagcccggcctgtgcggcctgggcaacctgggcaacacctgcttcatgaacagcgccctgcagtgcctgagcaacaccgcccccctgaccgactacttcctgaaggacgagtacgaggccgagatcaacagagacaaccccctgggcatgaagggcgagatcgccgaggcctacgccgagctgatcaagcagatgtggagcggcagagacgcccacgtggcccccagaatgttcaagacccaggtgggcagattcgccccccagttcagcggctaccagcagcaggacagccaggagctgctggccttcctgctggacggcctgcacgaggacctgaacagagtgaagaagaagccctacctggagctgaaggacgccaacggcagacccgacgccgtggtggccaaggaggcctgggagaaccacagactgagaaacgacagcgtgatcgtggacaccttccacggcctgttcaagagcaccctggtgtgccccgagtgcgccaaggtgagcgtgaccttcgaccccttctgctacctgaccctgcccctgcccctgaagaaggacagagtgatggaggtgttcctggtgcccgccgacccccactgcagacccacccagtacagagtgaccgtgcccctgatgggcgccgtgagcgacctgtgcgaggccctgagcagactgagcggcatcgccgccgagaacatggtggtggccgacgtgtacaaccacagattccacaagatcttccagatggacgagggcctgaaccacatcatgcccagagacgacatcttcgtgtacgaggtgtgcagcaccagcgtggacggcagcgagtgcgtgaccctgcccgtgtacttcagagagagaaagagcagacccagcagcaccagcagcgccagcgccctgtacggccagcccctgctgctgagcgtgcccaagcacaagctgaccctggagagcctgtaccaggccgtgtgcgacagaatcagcagatacgtgaagcagcccctgcccgacgagttcggcagcagccccctggagcccggcgcctgcaacggcagcagaaacagctgcgagggcgaggacgaggaggagatggagcaccaggaggagggcaaggagcagctgagcgagaccgagggcagcggcgaggacgagcccggcaacgaccccagcgagaccacccagaagaagatcaagggccagccctgccccaagagactgttcaccttcagcctggtgaacagctacggcaccgccgacatcaacagcctggccgccgacggcaagctgctgaagctgaacagcagaagcaccctggccatggactgggacagcgagaccagaagactgtactacgacgagcaggagagcgaggcctacgagaagcacgtgagcatgctgcagccccagaagaagaagaagaccaccgtggccctgagagactgcatcgagctgttcaccaccatggagaccctgggcgagcacgacccctggtactgccccaactgcaagaagcaccagcaggccaccaagaagttcgacctgtggagcctgcccaagatcctggtggtgcacctgaagagattcagctacaacagatactggagagacaagctggacaccgtggtggagttccccatcagaggcctgaacatgagcgagttcgtgtgcaacctgagcgccagaccctacgtgtacgacctgatcgccgtgagcaaccactacggcgccatgggcgtgggccactacaccgcctacgccaagaacaagctgaacggcaagtggtactacttcgacgacagcaacgtgagcctggccagcgaggaccagatcgtgaccaaggccgcctacgtgctgttctaccagagaagagacgacgagttctacaagacccccagcctgagcagcagcggcagcagcgacggcggcaccagacccagcagcagccagcagggcttcggcgacgacgaggcctgcagcatggacaccaactag

SEQ ID NO: 104407 - DNA, 2751 bp, Artificial Sequence
  Description of Artificial Sequence: Synthetic coding sequence
atggccgagggcggcggctgcagagagagacccgacgccgagacccagaagagcgagctgggccccctgatgagaaccaccctgcagagaggcgcccagtggtacctgatcgacagcagatggttcaagcagtggaagaagtacgtgggcttcgacagctgggacatgtacaacgtgggcgagcacaacctgttccccggccccatcgacaacagcggcctgttcagcgaccccgagagccagaccctgaaggagcacctgatcgacgagctggactacgtgctggtgcccaccgaggcctggaacaagctgctgaactggtacggctgcgtggagggccagcagcccatcgtgagaaaggtggtggagcacggcctgttcgtgaagcactgcaaggtggaggtgtacctgctggagctgaagctgtgcgagaacagcgaccccaccaacgtgctgagctgccacttcagcaaggccgacaccatcgccaccatcgagaaggagatgagaaagctgttcaacatccccgccgagagagagaccagactgtggaacaagtacatgagcaacacctacgagcagctgagcaagctggacaacaccgtgcaggacgccggcctgtaccagggccaggtgctggtgatcgagccccagaacgaggacggcacctggcccagacagaccctgcagagcaacggcagcggcttcagcgccagctacaactgccaggagccccccagcagccacatccagcccggcctgtgcggcctgggcaacctgggcaacacctgcttcatgaacagcgccctgcagtgcctgagcaacaccgcccccctgaccgactacttcctgaaggacgagtacgaggccgagatcaacagagacaaccccctgggcatgaagggcgagatcgccgaggcctacgccgagctgatcaagcagatgtggagcggcagagacgcccacgtggcccccagaatgttcaagacccaggtgggcagattcgccccccagttcagcggctaccagcagcaggacagccaggagctgctggccttcctgctggacggcctgcacgaggacctgaacagagtgaagaagaagccctacctggagctgaaggacgccaacggcagacccgacgccgtggtggccaaggaggcctgggagaaccacagactgagaaacgacagcgtgatcgtggacaccttccacggcctgttcaagagcaccctggtgtgccccgagtgcgccaaggtgagcgtgaccttcgaccccttctgctacctgaccctgcccctgcccctgaagaaggacagagtgatggaggtgttcctggtgcccgccgacccccactgcagacccacccagtacagagtgaccgtgcccctgatgggcgccgtgagcgacctgtgcgaggccctgagcagactgagcggcatcgccgccgagaacatggtggtggccgacgtgtacaaccacagattccacaagatcttccagatggacgagggcctgaaccacatcatgcccagagacgacatcttcgtgtacgaggtgtgcagcaccagcgtggacggcagcgagtgcgtgaccctgcccgtgtacttcagagagagaaagagcagacccagcagcaccagcagcgccagcgccctgtacggccagcccctgctgctgagcgtgcccaagcacaagctgaccctggagagcctgtaccaggccgtgtgcgacagaatcagcagatacgtgaagcagcccctgcccgacgagttcggcagcagccccctggagcccggcgcctgcaacggcagcagaaacagctgcgagggcgaggacgaggaggagatggagcaccaggaggagggcaaggagcagctgagcgagaccgagggcagcggcgaggacgagcccggcaacgaccccagcgagaccacccagaagaagatcaagggccagccctgccccaagagactgttcaccttcagcctggtgaacagctacggcaccgccgacatcaacagcctggccgccgacggcaagctgctgaagctgaacagcagaagcaccctggccatggactgggacagcgagaccagaagactgtactacgacgagcaggagagcgaggcctacgagaagcacgtgagcatgctgcagccccagaagaagaagaagaccaccgtggccctgagagactgcatcgagctgttcaccaccatggagaccctgggcgagcacgacccctggtactgccccaactgcaagaagcaccagcaggccaccaagaagttcgacctgtggagcctgcccaagatcctggtggtgcacctgaagagattcagctacaacagatactggagagacaagctggacaccgtggtggagttccccatcagaggcctgaacatgagcgagttcgtgtgcaacctgagcgccagaccctacgtgtacgacctgatcgccgtgagcaaccactacggcgccatgggcgtgggccactacaccgcctacgccaagaacaagctgaacggcaagtggtactacttcgacgacagcaacgtgagcctggccagcgaggaccagatcgtgaccaaggccgcctacgtgctgttctaccagagaagagacgacgagttctacaagacccccagcctgagcagcagcggcagcagcgacggcggcaccagacccagcagcagccagcagggcttcggcgacgacgaggcctgcagcatggacaccaactag

SEQ ID NO: 104408 - DNA, 942 bp, Artificial Sequence
  Description of Artificial Sequence: Synthetic coding sequence
atggccgagggcggcggctgcagagagagacccgacgccgagacccagaagagcgagctgggccccctgatgagaaccaccctgcagagaggcgcccagtggtacctgatcgacagcagatggttcaagcagtggaagaagtacgtgggcttcgacagctgggacatgtacaacgtgggcgagcacaacctgttccccggccccatcgacaacagcggcctgttcagcgaccccgagagccagaccctgaaggagcacctgatcgacgagctggactacgtgctggtgcccaccgaggcctggaacaagctgctgaactggtacggctgcgtggagggccagcagcccatcgtgagaaaggtggtggagcacggcctgttcgtgaagcactgcaaggtggaggtgtacctgctggagctgaagctgtgcgagaacagcgaccccaccaacgtgctgagctgccacttcagcaaggccgacaccatcgccaccatcgagaaggagatgagaaagctgttcaacatccccgccgagagagagaccagactgtggaacaagtacatgagcaacacctacgagcagctgagcaagctggacaacaccgtgcaggacgccggcctgtaccagggccaggtgctggtgatcgagccccagaacgaggacggcacctggcccagacagaccctgcagagcaaggtgagcttcttcctgcccagactggagtgcaacggcgccatcctggcccactgcaacttctgcctgcccggcagcagcaacagccccgccagcgccagcagagtggcccccagccacctggccaacttcttcttcttcgagatggagagccacagcgtgaccaagctggagtgcggcggcgccgtgagcgcctacagcagagtgcaggtgatgctgctgccccagccccccgagtggctgggctag

SEQ ID NO: 104409 - DNA, 2139 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgcgtggactgcaacaccaccgagagcatctgggcctgcctgagctgcagccacgtggcctgcggcagatacatcgaggagcacgccctgaagcacttccaggagagcagccaccccgtggccctggaggtgaacgagatgtacgtgttctgctacctgtgcgacgactacgtgctgaacgacaacaccaccggcgacctgaagctgctgagaagaaccctgagcgccatcaagagccagaactaccactgcaccaccagaagcggcagattcctgagaagcatgggcaccggcgacgacagctacttcctgcacgacggcgcccagagcctgctgcagagcgaggaccagctgtacaccgccctgtggcacagaagaagaatcctgatgggcaagatcttcagaacctggttcgagcagagccccatcggcagaaagaagcaggaggagcccttccaggagaagatcgtggtgaagagagaggtgaagaagagaagacaggagctggagtaccaggtgaaggccgagctggagagcatgccccccagaaagagcctgagactgcagggcctggcccagagcaccatcatcgagatcgtgagcgtgcaggtgcccgcccagacccccgccagccccgccaaggacaaggtgctgagcaccagcgagaacgagatcagccagaaggtgagcgacagcagcgtgaagagaagacccatcgtgacccccggcgtgaccggcctgagaaacctgggcaacacctgctacatgaacagcgtgctgcaggtgctgagccacctgctgatcttcagacagtgcttcctgaagctggacctgaaccagtggctggccatgaccgccagcgagaagaccagaagctgcaagcacccccccgtgaccgacaccgtggtgtaccagatgaacgagtgccaggagaaggacaccggcttcgtgtgcagcagacagagcagcctgagcagcggcctgagcggcggcgccagcaagggcagaaagatggagctgatccagcccaaggagcccaccagccagtacatcagcctgtgccacgagctgcacaccctgttccaggtgatgtggagcggcaagtgggccctggtgagccccttcgccatgctgcacagcgtgtggagactgatccccgccttcagaggctacgcccagcaggacgcccaggagttcctgtgcgagctgctggacaagatccagagagagctggagaccaccggcaccagcctgcccgccctgatccccaccagccagagaaagctgatcaagcaggtgctgaacgtggtgaacaacatcttccacggccagctgctgagccaggtgacctgcctggcctgcgacaacaagagcaacaccatcgagcccttctgggacctgagcctggagttccccgagagataccagtgcagcggcaaggacatcgccagccagccctgcctggtgaccgagatgctggccaagttcaccgagaccgaggccctggagggcaagatctacgtgtgcgaccagtgcaacagcaagagaagaagattcagcagcaagcccgtggtgctgaccgaggcccagaagcagctgatgatctgccacctgccccaggtgctgagactgcacctgaagagattcagatggagcggcagaaacaacagagagaagatcggcgtgcacgtgggcttcgaggagatcctgaacatggagccctactgctgcagagagaccctgaagagcctgagacccgagtgcttcatctacgacctgagcgccgtggtgatgcaccacggcaagggcttcggcagcggccactacaccgcctactgctacaacagcgagggcggcttctgggtgcactgcaacgacagcaagctgagcatgtgcaccatggacgaggtgtgcaaggcccaggcctacatcctgttctacacccagagagtgaccgagaacggccacagcaagctgctgccccccgagctgctgctgggcagccagcaccccaacgaggacgccgacaccagcagcaacgagatcctgagctag

SEQ ID NO: 104410 - DNA, 2139 bp, Artificial Sequence; identical to SEQ ID NO: 104409
  Description of Artificial Sequence: Synthetic coding sequence

SEQ ID NO: 104411 - DNA, 2139 bp, Artificial Sequence; identical to SEQ ID NO: 104409
  Description of Artificial Sequence: Synthetic coding sequence

SEQ ID NO: 104412 - DNA, 336 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgcgtggactgcaacaccaccgagagcatctgggcctgcctgagctgcagccacgtggcctgcggcagatacatcgaggagcacgccctgaagcacttccaggagagcagccaccccgtggccctggaggtgaacgagatgtacgtgttctgctacctgtgcgacgactacgtgctgaacgacaacaccaccggcgacctgaagctgctgagaagaaccctgagcgccatcaagagccagaactaccactag

SEQ ID NO: 104413 - DNA, 495 bp, Artificial Sequence
  Description of Artificial Sequence: Synthetic coding sequence
atgctggccatggacacctgcaagcacgtgggccagctgcagctggcccaggaccacagcagcctgaacccccagaagtggcactgcgtggactgcaacaccaccgagagcatctgggcctgcctgagctgcagccacgtggcctgcggcagatacatcgaggagcacgccctgaagcacttccaggagagcagccaccccgtggccctggaggtgaacgagatgtacgtgttctgctacctgtgcgacgactacgtgctgaacgacaacaccaccggcgacctgaagctgctgagaagaaccctgagcgccatcaagagccagaactaccactgcaccaccagaagcggcagattcctgagaagcatgggcaccggcgacgacagctacttcctgcacgacggcgcccagagcctgctgcagagcgaggaccagctgtacaccgccctgtggcacagaagaagaatcctgatgggcaagatcttcagaacctag

SEQ ID NO: 104414 - DNA, 1101 bp, Artificial Sequence
  Description of Artificial Sequence: Synthetic coding sequence
atgaccgtgagaaacatcgccagcatctgcaacatgggcaccaacgccagcgccctggagaaggacatcggccccgagcagttccccatcaacgagcactacttcggcctggtgaacttcggcaacacctgctactgcaacagcgtgctgcaggccctgtacttctgcagacccttcagagagaacgtgctggcctacaaggcccagcagaagaagaaggagaacctgctgacctgcctggccgacctgttccacagcatcgccacccagaagaagaaggtgggcgtgatcccccccaagaagttcatcagcagactgagaaaggagaacgacctgttcgacaactacatgcagcaggacgcccacgagttcctgaactacctgctgaacaccatcgccgacatcctgcaggaggagaagaagcaggagaagcagaacggcaagctgaagaacggcaacatgaacgagcccgccgagaacaacaagcccgagctgacctgggtgcacgagatcttccagggcaccctgaccaacgagaccagatgcctgaactgcgagaccgtgagcagcaaggacgaggacttcctggacctgagcgtggacgtggagcagaacaccagcatcacccactgcctgagagacttcagcaacaccgagaccctgtgcagcgagcagaagtactactgcgagacctgctgcagcaagcaggaggcccagaagagaatgagagtgaagaagctgcccatgatcctggccctgcacctgaagagattcaagtacatggagcagctgcacagatacaccaagctgagctacagagtggtgttccccctggagctgagactgttcaacaccagcagcgacgccgtgaacctggacagaatgtacgacctggtggccgtggtggtgcactgcggcagcggccccaacagaggccactacatcaccatcgtgaagagccacggcttctggctgctgttcgacgacgacatcgtggagaagatcgacgcccaggccatcgaggagttctacggcctgaccagcgacatcagcaagaacagcgagagcggctacatcctgttctaccagagcagagagtag

SEQ ID NO: 104415 - DNA, 1080 bp, Artificial Sequence
  Description of Artificial Sequence: Synthetic coding sequence
atgaactgcttccagggcaccaacgccagcgccctggagaaggacatcggccccgagcagttccccatcaacgagcactacttcggcctggtgaacttcggcaacacctgctactgcaacagcgtgctgcaggccctgtacttctgcagacccttcagagagaacgtgctggcctacaaggcccagcagaagaagaaggagaacctgctgacctgcctggccgacctgttccacagcatcgccacccagaagaagaaggtgggcgtgatcccccccaagaagttcatcagcagactgagaaaggagaacgacctgttcgacaactacatgcagcaggacgcccacgagttcctgaactacctgctgaacaccatcgccgacatcctgcaggaggagaagaagcaggagaagcagaacggcaagctgaagaacggcaacatgaacgagcccgccgagaacaacaagcccgagctgacctgggtgcacgagatcttccagggcaccctgaccaacgagaccagatgcctgaactgcgagaccgtgagcagcaaggacgaggacttcctggacctgagcgtggacgtggagcagaacaccagcatcacccactgcctgagagacttcagcaacaccgagaccctgtgcagcgagcagaagtactactgcgagacctgctgcagcaagcaggaggcccagaagagaatgagagtgaagaagctgcccatgatcctggccctgcacctgaagagattcaagtacatggagcagctgcacagatacaccaagctgagctacagagtggtgttccccctggagctgagactgttcaacaccagcagcgacgccgtgaacctggacagaatgtacgacctggtggccgtggtggtgcactgcggcagcggccccaacagaggccactacatcaccatcgtgaagagccacggcttctggctgctgttcgacgacgacatcgtggagaagatcgacgcccaggccatcgaggagttctacggcctgaccagcgacatcagcaagaacagcgagagcggctacatcctgttctaccagagcagagagtag

SEQ ID NO: 104416 - DNA, 4221 bp, Artificial Sequence
  Description of Artificial Sequence: Synthetic coding sequence
atggacatggtggagaacgccgacagcctgcaggcccaggagagaaaggacatcctgatgaagtacgacaagggccacagagccggcctgcccgaggacaagggccccgagcccgtgggcatcaacagcagcatcgacagattcggcatcctgcacgagaccgagctgccccccgtgaccgccagagaggccaagaagatcagaagagagatgaccagaaccagcaagtggatggagatgctgggcgagtgggagacctacaagcacagcagcaagctgatcgacagagtgtacaagggcatccccatgaacatcagaggccccgtgtggagcgtgctgctgaacatccaggagatcaagctgaagaaccccggcagataccagatcatgaaggagagaggcaagagaagcagcgagcacatccaccacatcgacctggacgtgagaaccaccctgagaaaccacgtgttcttcagagacagatacggcgccaagcagagagagctgttctacatcctgctggcctacagcgagtacaaccccgaggtgggctactgcagagacctgagccacatcaccgccctgttcctgctgtacctgcccgaggaggacgccttctgggccctggtgcagctgctggccagcgagagacacagcctgcccggcttccacagccccaacggcggcaccgtgcagggcctgcaggaccagcaggagcacgtggtgcccaagagccagcccaagaccatgtggcaccaggacaaggagggcctgtgcggccagtgcgccagcctgggctgcctgctgagaaacctgatcgacggcatcagcctgggcctgaccctgagactgtgggacgtgtacctggtggagggcgagcaggtgctgatgcccatcaccagcatcgccctgaaggtgcagcagaagagactgatgaagaccagcagatgcggcctgtgggccagactgagaaaccagttcttcgacacctgggccatgaacgacgacaccgtgctgaagcacctgagagccagcaccaagaagctgaccagaaagcagggcgacctgcccccccccgccaagagagagcagggcagcctggcccccagacccgtgcccgccagcagaggcggcaagaccctgtgcaagggctacagacaggccccccccggcccccccgcccagttccagagacccatctgcagcgccagccccccctgggccagcagattcagcaccccctgccccggcggcgccgtgagagaggacacctaccccgtgggcacccagggcgtgcccagcctggccctggcccagggcggcccccagggcagctggagattcctggagtggaagagcatgcccagactgcccaccgacctggacatcggcggcccctggttcccccactacgacttcgagtggagctgctgggtgagagccatcagccaggaggaccagctggccacctgctggcaggccgagcactgcggcgaggtgcacaacaaggacatgagctggcccgaggagatgagcttcaccgccaacagcagcaagatcgacagacagaaggtgcccaccgagaagggcgccaccggcctgagcaacctgggcaacacctgcttcatgaacagcagcatccagtgcgtgagcaacacccagcccctgacccagtacttcatcagcggcagacacctgtacgagctgaacagaaccaaccccatcggcatgaagggccacatggccaagtgctacggcgacctggtgcaggagctgtggagcggcacccagaagagcgtggcccccctgaagctgagaagaaccatcgccaagtacgcccccaagttcgacggcttccagcagcaggacagccaggagctgctggccttcctgctggacggcctgcacgaggacctgaacagagtgcacgagaagccctacgtggagctgaaggacagcgacggcagacccgactgggaggtggccgccgaggcctgggacaaccacctgagaagaaacagaagcatcatcgtggacctgttccacggccagctgagaagccaggtgaagtgcaagacctgcggccacatcagcgtgagattcgaccccttcaacttcctgagcctgcccctgcccatggacagctacatggacctggagatcaccgtgatcaagctggacggcaccacccccgtgagatacggcctgagactgaacatggacgagaagtacaccggcctgaagaagcagctgagagacctgtgcggcctgaacagcgagcagatcctgctggccgaggtgcacgacagcaacatcaagaacttcccccaggacaaccagaaggtgcagctgagcgtgagcggcttcctgtgcgccttcgagatccccgtgcccagcagccccatcagcgccagcagccccacccagatcgacttcagcagcagccccagcaccaacggcatgttcaccctgaccaccaacggcgacctgcccaagcccatcttcatccccaacggcatgcccaacaccgtggtgccctgcggcaccgagaagaacttcaccaacggcatggtgaacggccacatgcccagcctgcccgacagccccttcaccggctacatcatcgccgtgcacagaaagatgatgagaaccgagctgtacttcctgagcccccaggagaacagacccagcctgttcggcatgcccctgatcgtgccctgcaccgtgcacaccagaaagaaggacctgtacgacgccgtgtggatccaggtgagctggctggccagacccctgcccccccaggaggccagcatccacgcccaggacagagacaactgcatgggctaccagtaccccttcaccctgagagtggtgcagaaggacggcaacagctgcgcctggtgcccccagtacagattctgcagaggctgcaagatcgactgcggcgaggacagagccttcatcggcaacgcctacatcgccgtggactggcaccccaccgccctgcacctgagataccagaccagccaggagagagtggtggacaagcacgagagcgtggagcagagcagaagagcccaggccgagcccatcaacctggacagctgcctgagagccttcaccagcgaggaggagctgggcgagagcgagatgtactactgcagcaagtgcaagacccactgcctggccaccaagaagctggacctgtggagactgccccccttcctgatcatccacctgaagagattccagttcgtgaacgaccagtggatcaagagccagaagatcgtgagattcctgagagagagcttcgaccccagcgccttcctggtgcccagagaccccgccctgtgccagcacaagcccctgaccccccagggcgacgagctgagcaagcccagaatcctggccagagaggtgaagaaggtggacgcccagagcagcgccggcaaggaggacatgctgctgagcaagagccccagcagcctgagcgccaacatcagcagcagccccaagggcagccccagcagcagcagaaagagcggcaccagctgccccagcagcaagaacagcagccccaacagcagccccagaaccctgggcagaagcaagggcagactgagactgccccagatcggcagcaagaacaagcccagcagcagcaagaagaacctggacgccagcaaggagaacggcgccggccagatctgcgagctggccgacgccctgagcagaggccacatgagaggcggcagccagcccgagctggtgaccccccaggaccacgaggtggccctggccaacggcttcctgtacgagcacgaggcctgcggcaacggctgcggcgacggctacagcaacggccagctgggcaaccacagcgaggaggacagcaccgacgaccagagagaggacacccacatcaagcccatctacaacctgtacgccatcagctgccacagcggcatcctgagcggcggccactacatcacctacgccaagaaccccaactgcaagtggtactgctacaacgacagcagctgcgaggagctgcaccccgacgagatcgacaccgacagcgcctacatcctgttctacgagcagcagggcatcgactacgcccagttcctgcccaagatcgacggcaagaagatggccgacaccagcagcaccgacgaggacagcgagagcgactacgagaagtacagcatgctgcagtag

SEQ ID NO: 104417 - DNA, 3270 bp, Artificial Sequence
  Description of Artificial Sequence: Synthetic coding sequence
atgccccagagactgccccacgccagacagcacacccccctgcccctgggcagcgccgactacagaagagtggtgagcgtgagaccccagggcccccacagagaccccaaggacagcagagacgccgccaagagagagcagggcagcctggcccccagacccgtgcccgccagcagaggcggcaagaccctgtgcaagggctacagacaggccccccccggcccccccgcccagttccagagacccatctgcagcgccagccccccctgggccagcagattcagcaccccctgccccggcggcgccgtgagagaggacacctaccccgtgggcacccagggcgtgcccagcctggccctggcccagggcggcccccagggcagctggagattcctggagtggaagagcatgcccagactgcccaccgacctggacatcggcggcccctggttcccccactacgacttcgagtggagctgctgggtgagagccatcagccaggaggaccagctggccacctgctggcaggccgagcactgcggcgaggtgcacaacaaggacatgagctggcccgaggagatgagcttcaccgccaacagcagcaagatcgacagacagaaggtgcccaccgagaagggcgccaccggcctgagcaacctgggcaacacctgcttcatgaacagcagcatccagtgcgtgagcaacacccagcccctgacccagtacttcatcagcggcagacacctgtacgagctgaacagaaccaaccccatcggcatgaagggccacatggccaagtgctacggcgacctggtgcaggagctgtggagcggcacccagaagagcgtggcccccctgaagctgagaagaaccatcgccaagtacgcccccaagttcgacggcttccagcagcaggacagccaggagctgctggccttcctgctggacggcctgcacgaggacctgaacagagtgcacgagaagccctacgtggagctgaaggacagcgacggcagacccgactgggaggtggccgccgaggcctgggacaaccacctgagaagaaacagaagcatcatcgtggacctgttccacggccagctgagaagccaggtgaagtgcaagacctgcggccacatcagcgtgagattcgaccccttcaacttcctgagcctgcccctgcccatggacagctacatggacctggagatcaccgtgatcaagctggacggcaccacccccgtgagatacggcctgagactgaacatggacgagaagtacaccggcctgaagaagcagctgagagacctgtgcggcctgaacagcgagcagatcctgctggccgaggtgcacgacagcaacatcaagaacttcccccaggacaaccagaaggtgcagctgagcgtgagcggcttcctgtgcgccttcgagatccccgtgcccagcagccccatcagcgccagcagccccacccagatcgacttcagcagcagccccagcaccaacggcatgttcaccctgaccaccaacggcgacctgcccaagcccatcttcatccccaacggcatgcccaacaccgtggtgccctgcggcaccgagaagaacttcaccaacggcatggtgaacggccacatgcccagcctgcccgacagccccttcaccggctacatcatcgccgtgcacagaaagatgatgagaaccgagctgtacttcctgagcccccaggagaacagacccagcctgttcggcatgcccctgatcgtgccctgcaccgtgcacaccagaaagaaggacctgtacgacgccgtgtggatccaggtgagctggctggccagacccctgcccccccaggaggccagcatccacgcccaggacagagacaactgcatgggctaccagtaccccttcaccctgagagtggtgcagaaggacggcaacagctgcgcctggtgcccccagtacagattctgcagaggctgcaagatcgactgcggcgaggacagagccttcatcggcaacgcctacatcgccgtggactggcaccccaccgccctgcacctgagataccagaccagccaggagagagtggtggacaagcacgagagcgtggagcagagcagaagagcccaggccgagcccatcaacctggacagctgcctgagagccttcaccagcgaggaggagctgggcgagagcgagatgtactactgcagcaagtgcaagacccactgcctggccaccaagaagctggacctgtggagactgccccccttcctgatcatccacctgaagagattccagttcgtgaacgaccagtggatcaagagccagaagatcgtgagattcctgagagagagcttcgaccccagcgccttcctggtgcccagagaccccgccctgtgccagcacaagcccctgaccccccagggcgacgagctgagcaagcccagaatcctggccagagaggtgaagaaggtggacgcccagagcagcgccggcaaggaggacatgctgctgagcaagagccccagcagcctgagcgccaacatcagcagcagccccaagggcagccccagcagcagcagaaagagcggcaccagctgccccagcagcaagaacagcagccccaacagcagccccagaaccctgggcagaagcaagggcagactgagactgccccagatcggcagcaagaacaagcccagcagcagcaagaagaacctggacgccagcaaggagaacggcgccggccagatctgcgagctggccgacgccctgagcagaggccacatgagaggcggcagccagcccgagctggtgaccccccaggaccacgaggtggccctggccaacggcttcctgtacgagcacgaggcctgcggcaacggctgcggcgacggctacagcaacggccagctgggcaaccacagcgaggaggacagcaccgacgaccagagagaggacacccacatcaagcccatctacaacctgtacgccatcagctgccacagcggcatcctgagcggcggccactacatcacctacgccaagaaccccaactgcaagtggtactgctacaacgacagcagctgcgaggagctgcaccccgacgagatcgacaccgacagcgcctacatcctgttctacgagcagcagggcatcgactacgcccagttcctgcccaagatcgacggcaagaagatggccgacaccagcagcaccgacgaggacagcgagagcgactacgagaagtacagcatgctgcagtag

SEQ ID NO: 104418 - DNA, 2361 bp, Artificial Sequence
  Description of Artificial Sequence: Synthetic coding sequence
atggacatggtggagaacgccgacagcctgcaggcccaggagagaaaggacatcctgatgaagtacgacaagggccacagagccggcctgcccgaggacaagggccccgagcccgtgggcatcaacagcagcatcgacagattcggcatcctgcacgagaccgagctgccccccgtgaccgccagagaggccaagaagatcagaagagagatgaccagaaccagcaagtggatggagatgctgggcgagtgggagacctacaagcacagcagcaagctgatcgacagagtgtacaagggcatccccatgaacatcagaggccccgtgtggagcgtgctgctgaacatccaggagatcaagctgaagaaccccggcagataccagatcatgaaggagagaggcaagagaagcagcgagcacatccaccacatcgacctggacgtgagaaccaccctgagaaaccacgtgttcttcagagacagatacggcgccaagcagagagagctgttctacatcctgctggcctacagcgagtacaaccccgaggtgggctactgcagagacctgagccacatcaccgccctgttcctgctgtacctgcccgaggaggacgccttctgggccctggtgcagctgctggccagcgagagacacagcctgcccggcttccacagccccaacggcggcaccgtgcagggcctgcaggaccagcaggagcacgtggtgcccaagagccagcccaagaccatgtggcaccaggacaaggagggcctgtgcggccagtgcgccagcctgggctgcctgctgagaaacctgatcgacggcatcagcctgggcctgaccctgagactgtgggacgtgtacctggtggagggcgagcaggtgctgatgcccatcaccagcatcgccctgaaggtgcagcagaagagactgatgaagaccagcagatgcggcctgtgggccagactgagaaaccagttcttcgacacctgggccatgaacgacgacaccgtgctgaagcacctgagagccagcaccaagaagctgaccagaaagcagggcgacctgcccccccccgccaagagagagcagggcagcctggcccccagacccgtgcccgccagcagaggcggcaagaccctgtgcaagggctacagacaggccccccccggcccccccgcccagttccagagacccatctgcagcgccagccccccctgggccagcagattcagcaccccctgccccggcggcgccgtgagagaggacacctaccccgtgggcacccagggcgtgcccagcctggccctggcccagggcggcccccagggcagctggagattcctggagtggaagagcatgcccagactgcccaccgacctggacatcggcggcccctggttcccccactacgacttcgagtggagctgctgggtgagagccatcagccaggaggaccagctggccacctgctggcaggccgagcactgcggcgaggtgcacaacaaggacatgagctggcccgaggagatgagcttcaccgccaacagcagcaagatcgacagacagaaggtgcccaccgagaagggcgccaccggcctgagcaacctgggcaacacctgcttcatgaacagcagcatccagtgcgtgagcaacacccagcccctgacccagtacttcatcagcggcagacacctgtacgagctgaacagaaccaaccccatcggcatgaagggccacatggccaagtgctacggcgacctggtgcaggagctgtggagcggcacccagaagagcgtggcccccctgaagctgagaagaaccatcgccaagtacgcccccaagttcgacggcttccagcagcaggacagccaggagctgctggccttcctgctggacggcctgcacgaggacctgaacagagtgcacgagaagccctacgtggagctgaaggacagcgacggcagacccgactgggaggtggccgccgaggcctgggacaaccacctgagaagaaacagaagcatcatcgtggacctgttccacggccagctgagaagccaggtgaagtgcaagacctgcggccacatcagcgtgagattcgaccccttcaacttcctgagcctgcccctgcccatggacagctacatggacctggagatcaccgtgatcaagctggacggcaccacccccgtgagatacggcctgagactgaacatggacgagaagtacaccggcctgaagaagcagctgagagacctgtgcggcctgaacagcgagcagatcctgctggccgaggtgcacgacagcaacatcaagatcagccccctgcaccacctgcagatggagtgcagcccctag

SEQ ID NO: 104419 - DNA, 84 bp, Artificial Sequence
  Description of Artificial Sequence: Synthetic coding sequence
atggacatggtggagaacgccgacagcctgcaggcccaggagagaaaggacatcctgatgaagtacgacaagggccacagatag

SEQ ID NO: 104420 - DNA, 174 bp, Artificial Sequence
  Description of Artificial Sequence: Synthetic coding sequence
atggacatggtggagaacgccgacagcctgcaggcccaggagagaaaggacatcctgatgaagtacgacaagggccacagagccggcctgcccgaggacaagggcagccccctggagagcaccgccgccctgatcgtgctggccttctgcatgagaagaagctgcctgctgtag

SEQ ID NO: 104421 - DNA, 3309 bp, Artificial Sequence
  Description of Artificial Sequence: Synthetic coding sequence
atgaaccaccagcagcagcagcagcagcagaaggccggcgagcagcagctgagcgagcccgaggacatggagatggaggccggcgacaccgacgacccccccagaatcacccagaaccccgtgatcaacggcaacgtggccctgagcgacggccacaacaccgccgaggaggacatggaggacgacaccagctggagaagcgaggccaccttccagttcaccgtggagagattcagcagactgagcgagagcgtgctgagccccccctgcttcgtgagaaacctgccctggaagatcatggtgatgcccagattctaccccgacagaccccaccagaagagcgtgggcttcttcctgcagtgcaacgccgagagcgacagcaccagctggagctgccacgcccaggccgtgctgaagatcatcaactacagagacgacgagaagagcttcagcagaagaatcagccacctgttcttccacaaggagaacgactggggcttcagcaacttcatggcctggagcgaggtgaccgaccccgagaagggcttcatcgacgacgacaaggtgaccttcgaggtgttcgtgcaggccgacgccccccacggcgtggcctgggacagcaagaagcacaccggctacgtgggcctgaagaaccagggcgccacctgctacatgaacagcctgctgcagaccctgttcttcaccaaccagctgagaaaggccgtgtacatgatgcccaccgagggcgacgacagcagcaagagcgtgcccctggccctgcagagagtgttctacgagctgcagcacagcgacaagcccgtgggcaccaagaagctgaccaagagcttcggctgggagaccctggacagcttcatgcagcacgacgtgcaggagctgtgcagagtgctgctggacaacgtggagaacaagatgaagggcacctgcgtggagggcaccatccccaagctgttcagaggcaagatggtgagctacatccagtgcaaggaggtggactacagaagcgacagaagagaggactactacgacatccagctgagcatcaagggcaagaagaacatcttcgagagcttcgtggactacgtggccgtggagcagctggacggcgacaacaagtacgacgccggcgagcacggcctgcaggaggccgagaagggcgtgaagttcctgaccctgccccccgtgctgcacctgcagctgatgagattcatgtacgacccccagaccgaccagaacatcaagatcaacgacagattcgagttccccgagcagctgcccctggacgagttcctgcagaagaccgaccccaaggaccccgccaactacatcctgcacgccgtgctggtgcacagcggcgacaaccacggcggccactacgtggtgtacctgaaccccaagggcgacggcaagtggtgcaagttcgacgacgacgtggtgagcagatgcaccaaggaggaggccatcgagcacaactacggcggccacgacgacgacctgagcgtgagacactgcaccaacgcctacatgctggtgtacatcagagagagcaagctgagcgaggtgctgcaggccgtgaccgaccacgacatcccccagcagctggtggagagactgcaggaggagaagagaatcgaggcccagaagagaaaggagagacaggaggcccacctgtacatgcaggtgcagatcgtggccgaggaccagttctgcggccaccagggcaacgacatgtacgacgaggagaaggtgaagtacaccgtgttcaaggtgctgaagaacagcagcctggccgagttcgtgcagagcctgagccagaccatgggcttcccccaggaccagatcagactgtggcccatgcaggccagaagcaacggcaccaagagacccgccatgctggacaacgaggccgacggcaacaagaccatgatcgagctgagcgacaacgagaacccctggaccatcttcctggagaccgtggaccccgagctggccgccagcggcgccaccctgcccaagttcgacaaggaccacgacgtgatgctgttcctgaagatgtacgaccccaagaccagaagcctgaactactgcggccacatctacacccccatcagctgcaagatcagagacctgctgcccgtgatgtgcgacagagccggcttcatccaggacaccagcctgatcctgtacgaggaggtgaagcccaacctgaccgagagaatccaggactacgacgtgagcctggacaaggccctggacgagctgatggacggcgacatcatcgtgttccagaaggacgaccccgagaacgacaacagcgagctgcccaccgccaaggagtacttcagagacctgtaccacagagtggacgtgatcttctgcgacaagaccatccccaacgaccccggcttcgtggtgaccctgagcaacagaatgaactacttccaggtggccaagaccgtggcccagagactgaacaccgaccccatgctgctgcagttcttcaagagccagggctacagagacggccccggcaaccccctgagacacaactacgagggcaccctgagagacctgctgcagttcttcaagcccagacagcccaagaagctgtactaccagcagctgaagatgaagatcaccgacttcgagaacagaagaagcttcaagtgcatctggctgaacagccagttcagagaggaggagatcaccctgtaccccgacaagcacggctgcgtgagagacctgctggaggagtgcaagaaggccgtggagctgggcgagaaggccagcggcaagctgagactgctggagatcgtgagctacaagatcatcggcgtgcaccaggaggacgagctgctggagtgcctgagccccgccaccagcagaaccttcagaatcgaggagatccccctggaccaggtggacatcgacaaggagaacgagatgctggtgaccgtggcccacttccacaaggaggtgttcggcaccttcggcatccccttcctgctgagaatccaccagggcgagcacttcagagaggtgatgaagagaatccagagcctgctggacatccaggagaaggagttcgagaagttcaagttcgccatcgtgatgatgggcagacaccagtacatcaacgaggacgagtacgaggtgaacctgaaggacttcgagccccagcccggcaacatgagccaccccagaccctggctgggcctggaccacttcaacaaggcccccaagagaagcagatacacctacctggagaaggccatcaagatccacaactag

SEQ ID NO: 104422 - DNA, 3333 bp, Artificial Sequence
  Description of Artificial Sequence: Synthetic coding sequence
tgcagccacagcgacgtgggcgagagaaccagccccatcccccagcagagacccctgcagagccacgccgagatggccggcaaccacagactgggcctggaggccggcgacaccgacgacccccccagaatcacccagaaccccgtgatcaacggcaacgtggccctgagcgacggccacaacaccgccgaggaggacatggaggacgacaccagctggagaagcgaggccaccttccagttcaccgtggagagattcagcagactgagcgagagcgtgctgagccccccctgcttcgtgagaaacctgccctggaagatcatggtgatgcccagattctaccccgacagaccccaccagaagagcgtgggcttcttcctgcagtgcaacgccgagagcgacagcaccagctggagctgccacgcccaggccgtgctgaagatcatcaactacagagacgacgagaagagcttcagcagaagaatcagccacctgttcttccacaaggagaacgactggggcttcagcaacttcatggcctggagcgaggtgaccgaccccgagaagggcttcatcgacgacgacaaggtgaccttcgaggtgttcgtgcaggccgacgccccccacggcgtggcctgggacagcaagaagcacaccggctacgtgggcctgaagaaccagggcgccacctgctacatgaacagcctgctgcagaccctgttcttcaccaaccagctgagaaaggccgtgtacatgatgcccaccgagggcgacgacagcagcaagagcgtgcccctggccctgcagagagtgttctacgagctgcagcacagcgacaagcccgtgggcaccaagaagctgaccaagagcttcggctgggagaccctggacagcttcatgcagcacgacgtgcaggagctgtgcagagtgctgctggacaacgtggagaacaagatgaagggcacctgcgtggagggcaccatccccaagctgttcagaggcaagatggtgagctacatccagtgcaaggaggtggactacagaagcgacagaagagaggactactacgacatccagctgagcatcaagggcaagaagaacatcttcgagagcttcgtggactacgtggccgtggagcagctggacggcgacaacaagtacgacgccggcgagcacggcctgcaggaggccgagaagggcgtgaagttcctgaccctgccccccgtgctgcacctgcagctgatgagattcatgtacgacccccagaccgaccagaacatcaagatcaacgacagattcgagttccccgagcagctgcccctggacgagttcctgcagaagaccgaccccaaggaccccgccaactacatcctgcacgccgtgctggtgcacagcggcgacaaccacggcggccactacgtggtgtacctgaaccccaagggcgacggcaagtggtgcaagttcgacgacgacgtggtgagcagatgcaccaaggaggaggccatcgagcacaactacggcggccacgacgacgacctgagcgtgagacactgcaccaacgcctacatgctggtgtacatcagagagagcaagctgagcgaggtgctgcaggccgtgaccgaccacgacatcccccagcagctggtggagagactgcaggaggagaagagaatcgaggcccagaagagaaaggagagacaggaggcccacctgtacatgcaggtgcagatcgtggccgaggaccagttctgcggccaccagggcaacgacatgtacgacgaggagaaggtgaagtacaccgtgttcaaggtgctgaagaacagcagcctggccgagttcgtgcagagcctgagccagaccatgggcttcccccaggaccagatcagactgtggcccatgcaggccagaagcaacggcaccaagagacccgccatgctggacaacgaggccgacggcaacaagaccatgatcgagctgagcgacaacgagaacccctggaccatcttcctggagaccgtggaccccgagctggccgccagcggcgccaccctgcccaagttcgacaaggaccacgacgtgatgctgttcctgaagatgtacgaccccaagaccagaagcctgaactactgcggccacatctacacccccatcagctgcaagatcagagacctgctgcccgtgatgtgcgacagagccggcttcatccaggacaccagcctgatcctgtacgaggaggtgaagcccaacctgaccgagagaatccaggactacgacgtgagcctggacaaggccctggacgagctgatggacggcgacatcatcgtgttccagaaggacgaccccgagaacgacaacagcgagctgcccaccgccaaggagtacttcagagacctgtaccacagagtggacgtgatcttctgcgacaagaccatccccaacgaccccggcttcgtggtgaccctgagcaacagaatgaactacttccaggtggccaagaccgtggcccagagactgaacaccgaccccatgctgctgcagttcttcaagagccagggctacagagacggccccggcaaccccctgagacacaactacgagggcaccctgagagacctgctgcagttcttcaagcccagacagcccaagaagctgtactaccagcagctgaagatgaagatcaccgacttcgagaacagaagaagcttcaagtgcatctggctgaacagccagttcagagaggaggagatcaccctgtaccccgacaagcacggctgcgtgagagacctgctggaggagtgcaagaaggccgtggagctgggcgagaaggccagcggcaagctgagactgctggagatcgtgagctacaagatcatcggcgtgcaccaggaggacgagctgctggagtgcctgagccccgccaccagcagaaccttcagaatcgaggagatccccctggaccaggtggacatcgacaaggagaacgagatgctggtgaccgtggcccacttccacaaggaggtgttcggcaccttcggcatccccttcctgctgagaatccaccagggcgagcacttcagagaggtgatgaagagaatccagagcctgctggacatccaggagaaggagttcgagaagttcaagttcgccatcgtgatgatgggcagacaccagtacatcaacgaggacgagtacgaggtgaacctgaaggacttcgagccccagcccggcaacatgagccaccccagaccctggctgggcctggaccacttcaacaaggcccccaagagaagcagatacacctacctggagaaggccatcaagatccacaactag

SEQ ID NO: 104423 - DNA, 3012 bp, Artificial Sequence
  Description of Artificial Sequence: Synthetic coding sequence
atggtgatgcccagattctaccccgacagaccccaccagaagagcgtgggcttcttcctgcagtgcaacgccgagagcgacagcaccagctggagctgccacgcccaggccgtgctgaagatcatcaactacagagacgacgagaagagcttcagcagaagaatcagccacctgttcttccacaaggagaacgactggggcttcagcaacttcatggcctggagcgaggtgaccgaccccgagaagggcttcatcgacgacgacaaggtgaccttcgaggtgttcgtgcaggccgacgccccccacggcgtggcctgggacagcaagaagcacaccggctacgtgggcctgaagaaccagggcgccacctgctacatgaacagcctgctgcagaccctgttcttcaccaaccagctgagaaaggccgtgtacatgatgcccaccgagggcgacgacagcagcaagagcgtgcccctggccctgcagagagtgttctacgagctgcagcacagcgacaagcccgtgggcaccaagaagctgaccaagagcttcggctgggagaccctggacagcttcatgcagcacgacgtgcaggagctgtgcagagtgctgctggacaacgtggagaacaagatgaagggcacctgcgtggagggcaccatccccaagctgttcagaggcaagatggtgagctacatccagtgcaaggaggtggactacagaagcgacagaagagaggactactacgacatccagctgagcatcaagggcaagaagaacatcttcgagagcttcgtggactacgtggccgtggagcagctggacggcgacaacaagtacgacgccggcgagcacggcctgcaggaggccgagaagggcgtgaagttcctgaccctgccccccgtgctgcacctgcagctgatgagattcatgtacgacccccagaccgaccagaacatcaagatcaacgacagattcgagttccccgagcagctgcccctggacgagttcctgcagaagaccgaccccaaggaccccgccaactacatcctgcacgccgtgctggtgcacagcggcgacaaccacggcggccactacgtggtgtacctgaaccccaagggcgacggcaagtggtgcaagttcgacgacgacgtggtgagcagatgcaccaaggaggaggccatcgagcacaactacggcggccacgacgacgacctgagcgtgagacactgcaccaacgcctacatgctggtgtacatcagagagagcaagctgagcgaggtgctgcaggccgtgaccgaccacgacatcccccagcagctggtggagagactgcaggaggagaagagaatcgaggcccagaagagaaaggagagacaggaggcccacctgtacatgcaggtgcagatcgtggccgaggaccagttctgcggccaccagggcaacgacatgtacgacgaggagaaggtgaagtacaccgtgttcaaggtgctgaagaacagcagcctggccgagttcgtgcagagcctgagccagaccatgggcttcccccaggaccagatcagactgtggcccatgcaggccagaagcaacggcaccaagagacccgccatgctggacaacgaggccgacggcaacaagaccatgatcgagctgagcgacaacgagaacccctggaccatcttcctggagaccgtggaccccgagctggccgccagcggcgccaccctgcccaagttcgacaaggaccacgacgtgatgctgttcctgaagatgtacgaccccaagaccagaagcctgaactactgcggccacatctacacccccatcagctgcaagatcagagacctgctgcccgtgatgtgcgacagagccggcttcatccaggacaccagcctgatcctgtacgaggaggtgaagcccaacctgaccgagagaatccaggactacgacgtgagcctggacaaggccctggacgagctgatggacggcgacatcatcgtgttccagaaggacgaccccgagaacgacaacagcgagctgcccaccgccaaggagtacttcagagacctgtaccacagagtggacgtgatcttctgcgacaagaccatccccaacgaccccggcttcgtggtgaccctgagcaacagaatgaactacttccaggtggccaagaccgtggcccagagactgaacaccgaccccatgctgctgcagttcttcaagagccagggctacagagacggccccggcaaccccctgagacacaactacgagggcaccctgagagacctgctgcagttcttcaagcccagacagcccaagaagctgtactaccagcagctgaagatgaagatcaccgacttcgagaacagaagaagcttcaagtgcatctggctgaacagccagttcagagaggaggagatcaccctgtaccccgacaagcacggctgcgtgagagacctgctggaggagtgcaagaaggccgtggagctgggcgagaaggccagcggcaagctgagactgctggagatcgtgagctacaagatcatcggcgtgcaccaggaggacgagctgctggagtgcctgagccccgccaccagcagaaccttcagaatcgaggagatccccctggaccaggtggacatcgacaaggagaacgagatgctggtgaccgtggcccacttccacaaggaggtgttcggcaccttcggcatccccttcctgctgagaatccaccagggcgagcacttcagagaggtgatgaagagaatccagagcctgctggacatccaggagaaggagttcgagaagttcaagttcgccatcgtgatgatgggcagacaccagtacatcaacgaggacgagtacgaggtgaacctgaaggacttcgagccccagcccggcaacatgagccaccccagaccctggctgggcctggaccacttcaacaaggcccccaagagaagcagatacacctacctggagaaggccatcaagatccacaactag

SEQ ID NO: 104424 - DNA, 1530 bp, Artificial Sequence
  Description of Artificial Sequence: Synthetic coding sequence
atggaggacgacaccagctggagaagcgaggccaccttccagttcaccgtggagagattcagcagactgagcgagagcgtgctgagccccccctgcttcgtgagaaacctgccctggaagatcatggtgatgcccagattctaccccgacagaccccaccagaagagcgtgggcttcttcctgcagtgcaacgccgagagcgacagcaccagctggagctgccacgcccaggccgtgctgaagatcatcaactacagagacgacgagaagagcttcagcagaagaatcagccacctgttcttccacaaggagaacgactggggcttcagcaacttcatggcctggagcgaggtgaccgaccccgagaagggcttcatcgacgacgacaaggtgaccttcgaggtgttcgtgcaggccgacgccccccacggcgtggcctgggacagcaagaagcacaccggctacgtgggcctgaagaaccagggcgccacctgctacatgaacagcctgctgcagaccctgttcttcaccaaccagctgagaaaggccgtgtacatgatgcccaccgagggcgacgacagcagcaagagcgtgcccctggccctgcagagagtgttctacgagctgcagcacagcgacaagcccgtgggcaccaagaagctgaccaagagcttcggctgggagaccctggacagcttcatgcagcacgacgtgcaggagctgtgcagagtgctgctggacaacgtggagaacaagatgaagggcacctgcgtggagggcaccatccccaagctgttcagaggcaagatggtgagctacatccagtgcaaggaggtggactacagaagcgacagaagagaggactactacgacatccagctgagcatcaagggcaagaagaacatcttcgagagcttcgtggactacgtggccgtggagcagctggacggcgacaacaagtacgacgccggcgagcacggcctgcaggaggccgagaagggcgtgaagttcctgaccctgccccccgtgctgcacctgcagctgatgagattcatgtacgacccccagaccgaccagaacatcaagatcaacgacagattcgagttccccgagcagctgcccctggacgagttcctgcagaagaccgaccccaaggaccccgccaactacatcctgcacgccgtgctggtgcacagcggcgacaaccacggcggccactacgtggtgtacctgaaccccaagggcgacggcaagtggtgcaagttcgacgacgacgtggtgagcagatgcaccaaggaggaggccatcgagcacaactacggcggccacgacgacgacctgagcgtgagacactgcaccaacgcctacatgctggtgtacatcagagagagcaagctgaccgtgggcggcgccatcaccagaagagagaaggacagaggcagcgaggccgagggcgccgccggcagccccagcctgtacgccagcgccgacagcagaagaggccccgtgctgtggccccccagagagtag

SEQ ID NO: 104425 - DNA, 7713 bp, Artificial Sequence
  Description of Artificial Sequence: Synthetic coding sequence
atgaccgccaccaccagaggcagccccgtgggcggcaacgacaaccagggccaggcccccgacggccagagccagccccccctgcagcagaaccagaccagcagccccgacagcagcaacgagaacagccccgccaccccccccgacgagcagggccagggcgacgcccccccccagctggaggacgaggagcccgccttcccccacaccgacctggccaagctggacgacatgatcaacagacccagatgggtggtgcccgtgctgcccaagggcgagctggaggtgctgctggaggccgccatcgacctgagcaagaagggcctggacgtgaagagcgaggcctgccagagattcttcagagacggcctgaccatcagcttcaccaagatcctgaccgacgaggccgtgagcggctggaagttcgagatccacagatgcatcatcaacaacacccacagactggtggagctgtgcgtggccaagctgagccaggactggttccccctgctggagctgctggccatggccctgaacccccactgcaagttccacatctacaacggcaccagaccctgcgagagcgtgagcagcagcgtgcagctgcccgaggacgagctgttcgccagaagccccgaccccagaagccccaagggctggctggtggacctgctgaacaagttcggcaccctgaacggcttccagatcctgcacgacagattcatcaacggcagcgccctgaacgtgcagatcatcgccgccctgatcaagcccttcggccagtgctacgagttcctgaccctgcacaccgtgaagaagtacttcctgcccatcatcgagatggtgccccagttcctggagaacctgaccgacgaggagctgaagaaggaggccaagaacgaggccaagaacgacgccctgagcatgatcatcaagagcctgaagaacctggccagcagagtgcccggccaggaggagaccgtgaagaacctggagatcttcagactgaagatgatcctgagactgctgcagatcagcagcttcaacggcaagatgaacgccctgaacgaggtgaacaaggtgatcagcagcgtgagctactacacccacagacacggcaaccccgaggaggaggagtggctgaccgccgagagaatggccgagtggatccagcagaacaacatcctgagcatcgtgctgagagacagcctgcaccagccccagtacgtggagaagctggagaagatcctgagattcgtgatcaaggagaaggccctgaccctgcaggacctggacaacatctgggccgcccaggccggcaagcacgaggccatcgtgaagaacgtgcacgacctgctggccaagctggcctgggacttcagccccgagcagctggaccacctgttcgactgcttcaaggccagctggaccaacgccagcaagaagcagagagagaagctgctggagctgatcagaagactggccgaggacgacaaggacggcgtgatggcccacaaggtgctgaacctgctgtggaacctggcccacagcgacgacgtgcccgtggacatcatggacctggccctgagcgcccacatcaagatcctggactacagctgcagccaggacagagacacccagaagatccagtggatcgacagattcatcgaggagctgagaaccaacgacaagtgggtgatccccgccctgaagcagatcagagagatctgcagcctgttcggcgaggccccccagaacctgagccagacccagagaagcccccacgtgttctacagacacgacctgatcaaccagctgcagcacaaccacgccctggtgaccctggtggccgagaacctggccacctacatggagagcatgagactgtacgccagagaccacgaggactacgacccccagaccgtgagactgggcagcagatacagccacgtgcaggaggtgcaggagagactgaacttcctgagattcctgctgaaggacggccagctgtggctgtgcgccccccaggccaagcagatctggaagtgcctggccgagaacgccgtgtacctgtgcgacagagaggcctgcttcaagtggtacagcaagctgatgggcgacgagcccgacctggaccccgacatcaacaaggacttcttcgagagcaacgtgctgcagctggaccccagcctgctgaccgagaacggcatgaagtgcttcgagagattcttcaaggccgtgaactgcagagagggcaagctggtggccaagagaagagcctacatgatggacgacctggagctgatcggcctggactacctgtggagagtggtgatccagagcaacgacgacatcgccagcagagccatcgacctgctgaaggagatctacaccaacctgggccccagactgcaggtgaaccaggtggtgatccacgaggacttcatccagagctgcttcgacagactgaaggccagctacgacaccctgtgcgtgctggacggcgacaaggacagcgtgaactgcgccagacaggaggccgtgagaatggtgagagtgctgaccgtgctgagagagtacatcaacgagtgcgacagcgactaccacgaggagagaaccatcctgcccatgagcagagccttcagaggcaagcacctgagcttcgtggtgagattccccaaccagggcagacaggtggacgacctggaggtgtggagccacaccaacgacaccatcggcagcgtgagaagatgcatcctgaacagaatcaaggccaacgtggcccacaccaagatcgagctgttcgtgggcggcgagctgatcgaccccgccgacgacagaaagctgatcggccagctgaacctgaaggacaagagcctgatcaccgccaagctgacccagatcagcagcaacatgcccagcagccccgacagcagcagcgacagcagcaccggcagccccggcaaccacggcaaccactacagcgacggccccaaccccgaggtggagagctgcctgcccggcgtgatcatgagcctgcaccccagatacatcagcttcctgtggcaggtggccgacctgggcagcagcctgaacatgccccccctgagagacggcgccagagtgctgatgaagctgatgccccccgacagcaccaccatcgagaagctgagagccatctgcctggaccacgccaagctgggcgagagcagcctgagccccagcctggacagcctgttcttcggccccagcgccagccaggtgctgtacctgaccgaggtggtgtacgccctgctgatgcccgccggcgcccccctggccgacgacagcagcgacttccagttccacttcctgaagagcggcggcctgcccctggtgctgagcatgctgaccagaaacaacttcctgcccaacgccgacatggagaccagaagaggcgcctacctgaacgccctgaagatcgccaagctgctgctgaccgccatcggctacggccacgtgagagccgtggccgaggcctgccagcccggcgtggagggcgtgaaccccatgacccagatcaaccaggtgacccacgaccaggccgtggtgctgcagagcgccctgcagagcatccccaaccccagcagcgagtgcatgctgagaaacgtgagcgtgagactggcccagcagatcagcgacgaggccagcagatacatgcccgacatctgcgtgatcagagccatccagaagatcatctgggccagcggctgcggcagcctgcagctggtgttcagccccaacgaggagatcaccaagatctacgagaagaccaacgccggcaacgagcccgacctggaggacgagcaggtgtgctgcgaggccctggaggtgatgaccctgtgcttcgccctgatccccaccgccctggacgccctgagcaaggagaaggcctggcagaccttcatcatcgacctgctgctgcactgccacagcaagaccgtgagacaggtggcccaggagcagttcttcctgatgtgcaccagatgctgcatgggccacagacccctgctgttcttcatcaccctgctgttcaccgtgctgggcagcaccgccagagagagagccaagcacagcggcgactacttcaccctgctgagacacctgctgaactacgcctacaacagcaacatcaacgtgcccaacgccgaggtgctgctgaacaacgagatcgactggctgaagagaatcagagacgacgtgaagagaaccggcgagaccggcatcgaggagaccatcctggagggccacctgggcgtgaccaaggagctgctggccttccagaccagcgagaagaagttccacatcggctgcgagaagggcggcgccaacctgatcaaggagctgatcgacgacttcatcttccccgccagcaacgtgtacctgcagtacatgagaaacggcgagctgcccgccgagcaggccatccccgtgtgcggcagcccccccaccatcaacgccggcttcgagctgctggtggccctggccgtgggctgcgtgagaaacctgaagcagatcgtggacagcctgaccgagatgtactacatcggcaccgccatcaccacctgcgaggccctgaccgagtgggagtacctgccccccgtgggccccagaccccccaagggcttcgtgggcctgaagaacgccggcgccacctgctacatgaacagcgtgatccagcagctgtacatgatccccagcatcagaaacggcatcctggccatcgagggcaccggcagcgacgtggacgacgacatgagcggcgacgagaagcaggacaacgagagcaacgtggaccccagagacgacgtgttcggctacccccagcagttcgaggacaagcccgccctgagcaagaccgaggacagaaaggagtacaacatcggcgtgctgagacacctgcaggtgatcttcggccacctggccgccagcagactgcagtactacgtgcccagaggcttctggaagcagttcagactgtggggcgagcccgtgaacctgagagagcagcacgacgccctggagttcttcaacagcctggtggacagcctggacgaggccctgaaggccctgggccaccccgccatgctgagcaaggtgctgggcggcagcttcgccgaccagaagatctgccagggctgcccccacagatacgagtgcgaggagagcttcaccaccctgaacgtggacatcagaaaccaccagaacctgctggacagcctggagcagtacgtgaagggcgacctgctggagggcgccaacgcctaccactgcgagaagtgcaacaagaaggtggacaccgtgaagagactgctgatcaagaagctgccccccgtgctggccatccagctgaagagattcgactacgactgggagagagagtgcgccatcaagttcaacgactacttcgagttccccagagagctggacatggagccctacaccgtggccggcgtggccaagctggagggcgacaacgtgaaccccgagagccagctgatccagcagagcgagcagagcgagagcgagaccgccggcagcaccaagtacagactggtgggcgtgctggtgcacagcggccaggccagcggcggccactactacagctacatcatccagagaaacggcggcgacggcgagagaaacagatggtacaagttcgacgacggcgacgtgaccgagtgcaagatggacgacgacgaggagatgaagaaccagtgcttcggcggcgagtacatgggcgaggtgttcgaccacatgatgaagagaatgagctacagaagacagaagagatggtggaacgcctacatcctgttctacgagagaatggacaccatcgaccaggacgacgagctgatcagatacatcagcgagctggccatcaccaccagaccccaccagatcatcatgcccagcgccatcgagagaagcgtgagaaagcagaacgtgcagttcatgcacaacagaatgcagtacagcatggagtacttccagttcatgaagaagctgctgacctgcaacggcgtgtacctgaaccccccccccggccaggaccacctgctgcccgaggccgaggagatcaccatgatcagcatccagctggccgccagattcctgttcaccaccggcttccacaccaagaaggtggtgagaggcagcgccagcgactggtacgacgccctgtgcatcctgctgagacacagcaagaacgtgagattctggttcgcccacaacgtgctgttcaacgtgagcaacagattcagcgagtacctgctggagtgccccagcgccgaggtgagaggcgccttcgccaagctgatcgtgttcatcgcccacttcagcctgcaggacggcccctgccccagccccttcgccagccccggccccagcagccaggcctacgacaacctgagcctgagcgaccacctgctgagagccgtgctgaacctgctgagaagagaggtgagcgagcacggcagacacctgcagcagtacttcaacctgttcgtgatgtacgccaacctgggcgtggccgagaagacccagctgctgaagctgagcgtgcccgccaccttcatgctggtgagcctggacgagggccccggcccccccatcaagtaccagtacgccgagctgggcaagctgtacagcgtggtgagccagctgatcagatgctgcaacgtgagcagcagaatgcagagcagcatcaacggcaacccccccctgcccaaccccttcggcgaccccaacctgagccagcccatcatgcccatccagcagaacgtggccgacatcctgttcgtgagaaccagctacgtgaagaagatcatcgaggactgcagcaacagcgaggagaccgtgaagctgctgagattctgctgctgggagaacccccagttcagcagcaccgtgctgagcgagctgctgtggcaggtggcctacagctacacctacgagctgagaccctacctggacctgctgctgcagatcctgctgatcgaggacagctggcagacccacagaatccacaacgccctgaagggcatccccgacgacagagacggcctgttcgacaccatccagagaagcaagaaccactaccagaagagagcctaccagtgcatcaagtgcatggtggccctgttcagcaactgccccgtggcctaccagatcctgcagggcaacggcgacctgaagagaaagtggacctgggccgtggagtggctgggcgacgagctggagagaagaccctacaccggcaacccccagtacacctacaacaactggagcccccccgtgcagagcaacgagaccagcaacggctacttcctggagagaagccacagcgccagaatgaccctggccaaggcctgcgagctgtgccccgaggaggtgaagaaggccaccagcgtgcagcagatcgagatggaggagagcaaggagcccgacgaccaggacgcccccgacgagcacgagagccccccccccgaggacgcccccctgtacccccacagccccggcagccagtaccagcagaacaaccacgtgcacggccagccctacaccggccccgccgcccaccacatgaacaacccccagagaaccggccagagagcccaggagaactacgagggcagcgaggaggtgagccccccccagaccaaggaccagtag

SEQ ID NO: 104426 - DNA, 7665 bp, Artificial Sequence
  Description of Artificial Sequence: Synthetic coding sequence
atgaccgccaccaccagaggcagccccgtgggcggcaacgacaaccagggccaggcccccgacggccagagccagccccccctgcagcagaaccagaccagcagccccgacagcagcaacgagaacagccccgccaccccccccgacgagcagggccagggcgacgcccccccccagctggaggacgaggagcccgccttcccccacaccgacctggccaagctggacgacatgatcaacagacccagatgggtggtgcccgtgctgcccaagggcgagctggaggtgctgctggaggccgccatcgacctgagcaagaagggcctggacgtgaagagcgaggcctgccagagattcttcagagacggcctgaccatcagcttcaccaagatcctgaccgacgaggccgtgagcggctggaagttcgagatccacagatgcatcatcaacaacacccacagactggtggagctgtgcgtggccaagctgagccaggactggttccccctgctggagctgctggccatggccctgaacccccactgcaagttccacatctacaacggcaccagaccctgcgagagcgtgagcagcagcgtgcagctgcccgaggacgagctgttcgccagaagccccgaccccagaagccccaagggctggctggtggacctgctgaacaagttcggcaccctgaacggcttccagatcctgcacgacagattcatcaacggcagcgccctgaacgtgcagatcatcgccgccctgatcaagcccttcggccagtgctacgagttcctgaccctgcacaccgtgaagaagtacttcctgcccatcatcgagatggtgccccagttcctggagaacctgaccgacgaggagctgaagaaggaggccaagaacgaggccaagaacgacgccctgagcatgatcatcaagagcctgaagaacctggccagcagagtgcccggccaggaggagaccgtgaagaacctggagatcttcagactgaagatgatcctgagactgctgcagatcagcagcttcaacggcaagatgaacgccctgaacgaggtgaacaaggtgatcagcagcgtgagctactacacccacagacacggcaaccccgaggaggaggagtggctgaccgccgagagaatggccgagtggatccagcagaacaacatcctgagcatcgtgctgagagacagcctgcaccagccccagtacgtggagaagctggagaagatcctgagattcgtgatcaaggagaaggccctgaccctgcaggacctggacaacatctgggccgcccaggccggcaagcacgaggccatcgtgaagaacgtgcacgacctgctggccaagctggcctgggacttcagccccgagcagctggaccacctgttcgactgcttcaaggccagctggaccaacgccagcaagaagcagagagagaagctgctggagctgatcagaagactggccgaggacgacaaggacggcgtgatggcccacaaggtgctgaacctgctgtggaacctggcccacagcgacgacgtgcccgtggacatcatggacctggccctgagcgcccacatcaagatcctggactacagctgcagccaggacagagacacccagaagatccagtggatcgacagattcatcgaggagctgagaaccaacgacaagtgggtgatccccgccctgaagcagatcagagagatctgcagcctgttcggcgaggccccccagaacctgagccagacccagagaagcccccacgtgttctacagacacgacctgatcaaccagctgcagcacaaccacgccctggtgaccctggtggccgagaacctggccacctacatggagagcatgagactgtacgccagagaccacgaggactacgacccccagaccgtgagactgggcagcagatacagccacgtgcaggaggtgcaggagagactgaacttcctgagattcctgctgaaggacggccagctgtggctgtgcgccccccaggccaagcagatctggaagtgcctggccgagaacgccgtgtacctgtgcgacagagaggcctgcttcaagtggtacagcaagctgatgggcgacgagcccgacctggaccccgacatcaacaaggacttcttcgagagcaacgtgctgcagctggaccccagcctgctgaccgagaacggcatgaagtgcttcgagagattcttcaaggccgtgaactgcagagagggcaagctggtggccaagagaagagcctacatgatggacgacctggagctgatcggcctggactacctgtggagagtggtgatccagagcaacgacgacatcgccagcagagccatcgacctgctgaaggagatctacaccaacctgggccccagactgcaggtgaaccaggtggtgatccacgaggacttcatccagagctgcttcgacagactgaaggccagctacgacaccctgtgcgtgctggacggcgacaaggacagcgtgaactgcgccagacaggaggccgtgagaatggtgagagtgctgaccgtgctgagagagtacatcaacgagtgcgacagcgactaccacgaggagagaaccatcctgcccatgagcagagccttcagaggcaagcacctgagcttcgtggtgagattccccaaccagggcagacaggtggacgacctggaggtgtggagccacaccaacgacaccatcggcagcgtgagaagatgcatcctgaacagaatcaaggccaacgtggcccacaccaagatcgagctgttcgtgggcggcgagctgatcgaccccgccgacgacagaaagctgatcggccagctgaacctgaaggacaagagcctgatcaccgccaagctgacccagatcagcagcaacatgcccagcagccccgacagcagcagcgacagcagcaccggcagccccggcaaccacggcaaccactacagcgacggccccaaccccgaggtggagagctgcctgcccggcgtgatcatgagcctgcaccccagatacatcagcttcctgtggcaggtggccgacctgggcagcagcctgaacatgccccccctgagagacggcgccagagtgctgatgaagctgatgccccccgacagcaccaccatcgagaagctgagagccatctgcctggaccacgccaagctgggcgagagcagcctgagccccagcctggacagcctgttcttcggccccagcgccagccaggtgctgtacctgaccgaggtggtgtacgccctgctgatgcccgccggcgcccccctggccgacgacagcagcgacttccagttccacttcctgaagagcggcggcctgcccctggtgctgagcatgctgaccagaaacaacttcctgcccaacgccgacatggagaccagaagaggcgcctacctgaacgccctgaagatcgccaagctgctgctgaccgccatcggctacggccacgtgagagccgtggccgaggcctgccagcccggcgtggagggcgtgaaccccatgacccagatcaaccaggtgacccacgaccaggccgtggtgctgcagagcgccctgcagagcatccccaaccccagcagcgagtgcatgctgagaaacgtgagcgtgagactggcccagcagatcagcgacgaggccagcagatacatgcccgacatctgcgtgatcagagccatccagaagatcatctgggccagcggctgcggcagcctgcagctggtgttcagccccaacgaggagatcaccaagatctacgagaagaccaacgccggcaacgagcccgacctggaggacgagcaggtgtgctgcgaggccctggaggtgatgaccctgtgcttcgccctgatccccaccgccctggacgccctgagcaaggagaaggcctggcagaccttcatcatcgacctgctgctgcactgccacagcaagaccgtgagacaggtggcccaggagcagttcttcctgatgtgcaccagatgctgcatgggccacagacccctgctgttcttcatcaccctgctgttcaccgtgctgggcagcaccgccagagagagagccaagcacagcggcgactacttcaccctgctgagacacctgctgaactacgcctacaacagcaacatcaacgtgcccaacgccgaggtgctgctgaacaacgagatcgactggctgaagagaatcagagacgacgtgaagagaaccggcgagaccggcatcgaggagaccatcctggagggccacctgggcgtgaccaaggagctgctggccttccagaccagcgagaagaagttccacatcggctgcgagaagggcggcgccaacctgatcaaggagctgatcgacgacttcatcttccccgccagcaacgtgtacctgcagtacatgagaaacggcgagctgcccgccgagcaggccatccccgtgtgcggcagcccccccaccatcaacgccggcttcgagctgctggtggccctggccgtgggctgcgtgagaaacctgaagcagatcgtggacagcctgaccgagatgtactacatcggcaccgccatcaccacctgcgaggccctgaccgagtgggagtacctgccccccgtgggccccagaccccccaagggcttcgtgggcctgaagaacgccggcgccacctgctacatgaacagcgtgatccagcagctgtacatgatccccagcatcagaaacggcatcctggccatcgagggcaccggcagcgacgtggacgacgacatgagcggcgacgagaagcaggacaacgagagcaacgtggaccccagagacgacgtgttcggctacccccagcagttcgaggacaagcccgccctgagcaagaccgaggacagaaaggagtacaacatcggcgtgctgagacacctgcaggtgatcttcggccacctggccgccagcagactgcagtactacgtgcccagaggcttctggaagcagttcagactgtggggcgagcccgtgaacctgagagagcagcacgacgccctggagttcttcaacagcctggtggacagcctggacgaggccctgaaggccctgggccaccccgccatgctgagcaaggtgctgggcggcagcttcgccgaccagaagatctgccagggctgcccccacagatacgagtgcgaggagagcttcaccaccctgaacgtggacatcagaaaccaccagaacctgctggacagcctggagcagtacgtgaagggcgacctgctggagggcgccaacgcctaccactgcgagaagtgcaacaagaaggtggacaccgtgaagagactgctgatcaagaagctgccccccgtgctggccatccagctgaagagattcgactacgactgggagagagagtgcgccatcaagttcaacgactacttcgagttccccagagagctggacatggagccctacaccgtggccggcgtggccaagctggagggcgacaacgtgaaccccgagagccagctgatccagcagagcgagcagagcgagagcgagaccgccggcagcaccaagtacagactggtgggcgtgctggtgcacagcggccaggccagcggcggccactactacagctacatcatccagagaaacggcggcgacggcgagagaaacagatggtacaagttcgacgacggcgacgtgaccgagtgcaagatggacgacgacgaggagatgaagaaccagtgcttcggcggcgagtacatgggcgaggtgttcgaccacatgatgaagagaatgagctacagaagacagaagagatggtggaacgcctacatcctgttctacgagagaatggacaccatcgaccaggacgacgagctgatcagatacatcagcgagctggccatcaccaccagaccccaccagatcatcatgcccagcgccatcgagagaagcgtgagaaagcagaacgtgcagttcatgcacaacagaatgcagtacagcatggagtacttccagttcatgaagaagctgctgacctgcaacggcgtgtacctgaaccccccccccggccaggaccacctgctgcccgaggccgaggagatcaccatgatcagcatccagctggccgccagattcctgttcaccaccggcttccacaccaagaaggtggtgagaggcagcgccagcgactggtacgacgccctgtgcatcctgctgagacacagcaagaacgtgagattctggttcgcccacaacgtgctgttcaacgtgagcaacagattcagcgagtacctgctggagtgccccagcgccgaggtgagaggcgccttcgccaagctgatcgtgttcatcgcccacttcagcctgcaggacggcccctgccccagccccttcgccagccccggccccagcagccaggcctacgacaacctgagcctgagcgaccacctgctgagagccgtgctgaacctgctgagaagagaggtgagcgagcacggcagacacctgcagcagtacttcaacctgttcgtgatgtacgccaacctgggcgtggccgagaagacccagctgctgaagctgagcgtgcccgccaccttcatgctggtgagcctggacgagggccccggcccccccatcaagtaccagtacgccgagctgggcaagctgtacagcgtggtgagccagctgatcagatgctgcaacgtgagcagcagaatgcagagcagcatcaacggcaacccccccctgcccaaccccttcggcgaccccaacctgagccagcccatcatgcccatccagcagaacgtggccgacatcctgttcgtgagaaccagctacgtgaagaagatcatcgaggactgcagcaacagcgaggagaccgtgaagctgctgagattctgctgctgggagaacccccagttcagcagcaccgtgctgagcgagctgctgtggcaggtggcctacagctacacctacgagctgagaccctacctggacctgctgctgcagatcctgctgatcgaggacagctggcagacccacagaatccacaacgccctgaagggcatccccgacgacagagacggcctgttcgacaccatccagagaagcaagaaccactaccagaagagagcctaccagtgcatcaagtgcatggtggccctgttcagcaactgccccgtggcctaccagatcctgcagggcaacggcgacctgaagagaaagtggacctgggccgtggagtggctgggcgacgagctggagagaagaccctacaccggcaacccccagtacacctacaacaactggagcccccccgtgcagagcaacgagaccagcaacggctacttcctggagagaagccacagcgccagaatgaccctggccaaggcctgcgagctgtgccccgaggaggagcccgacgaccaggacgcccccgacgagcacgagagccccccccccgaggacgcccccctgtacccccacagccccggcagccagtaccagcagaacaaccacgtgcacggccagccctacaccggccccgccgcccaccacatgaacaacccccagagaaccggccagagagcccaggagaactacgagggcagcgaggaggtgagccccccccagaccaaggaccagtag

SEQ ID NO: 104427 - DNA, 7668 bp, Artificial Sequence
  Description of Artificial Sequence: Synthetic coding sequence
atgaccgccatcacccacggcagccccgtgggcggcaacgacagccagggccaggtgctggacggccagagccagcacctgttccagcagaaccagaccagcagccccgacagcagcaacgagaacagcgtggccacccccccccccgaggagcagggccagggcgacgcccccccccagcacgaggacgaggagcccgccttcccccacaccgagctggccaacctggacgacatgatcaacagacccagatgggtggtgcccgtgctgcccaagggcgagctggaggtgctgctggaggccgccatcgacctgagcgtgaagggcctggacgtgaagagcgaggcctgccagagattcttcagagacggcctgaccatcagcttcaccaagatcctgatggacgaggccgtgagcggctggaagttcgagatccacagatgcatcatcaacaacacccacagactggtggagctgtgcgtggccaagctgagccaggactggttccccctgctggagctgctggccatggccctgaacccccactgcaagttccacatctacaacggcaccagaccctgcgagctgatcagcagcaacgcccagctgcccgaggacgagctgttcgccagaagcagcgaccccagaagccccaagggctggctggtggacctgatcaacaagttcggcaccctgaacggcttccagatcctgcacgacagattcttcaacggcagcgccctgaacatccagatcatcgccgccctgatcaagcccttcggccagtgctacgagttcctgagccagcacaccctgaagaagtacttcatccccgtgatcgagatcgtgccccacctgctggagaacctgaccgacgaggagctgaagaaggaggccaagaacgaggccaagaacgacgccctgagcatgatcatcaagagcctgaagaacctggccagcagaatcagcggccaggacgagaccatcaagaacctggagatcttcagactgaagatgatcctgagactgctgcagatcagcagcttcaacggcaagatgaacgccctgaacgagatcaacaaggtgatcagcagcgtgagctactacacccacagacacagcaaccccgaggaggaggagtggctgaccgccgagagaatggccgagtggatccagcagaacaacatcctgagcatcgtgctgcaggacagcctgcaccagccccagtacgtggagaagctggagaagatcctgagattcgtgatcaaggagaaggccctgaccctgcaggacctggacaacatctgggccgcccaggccggcaagcacgaggccatcgtgaagaacgtgcacgacctgctggccaagctggcctgggacttcagccccggccagctggaccacctgttcgactgcttcaaggccagctggaccaacgccagcaagaagcagagagagaagctgctggagctgatcagaagactggccgaggacgacaaggacggcgtgatggcccacaaggtgctgaacctgctgtggaacctggcccagagcgacgacgtgcccgtggacatcatggacctggccctgagcgcccacatcaagatcctggactacagctgcagccaggacagagacgcccagaagatccagtggatcgaccacttcatcgaggagctgagaaccaacgacaagtgggtgatccccgccctgaagcagatcagagagatctgcagcctgttcggcgaggccagccagaacctgagccagacccagagaagcccccacatcttctacagacacgacctgatcaaccagctgcagcagaaccacgccctggtgaccctggtggccgagaacctggccacctacatgaacagcatcagactgtacgccggcgaccacgaggactacgacccccagaccgtgagactgggcagcagatacagccacgtgcaggaggtgcaggagagactgaacttcctgagattcctgctgaaggacggccagctgtggctgtgcgccccccaggccaagcagatctggaagtgcctggccgagaacgccgtgtacctgtgcgacagagaggcctgcttcaagtggtacagcaagctgatgggcgacgagcccgacctggaccccgacatcaacaaggacttcttcgagagcaacgtgctgcagctggaccccagcctgctgaccgagaacggcatgaagtgcttcgagagattcttcaaggccgtgaactgcagagagagaaagctgatcgccaagagaagaagctacatgatggacgacctggagctgatcggcctggactacctgtggagagtggtgatccagagcagcgacgagatcgccaacagagccatcgacctgctgaaggagatctacaccaacctgggccccagactgaaggccaaccaggtggtgatccacgaggacttcatccagagctgcttcgacagactgaaggccagctacgacaccctgtgcgtgttcgacggcgacaagaacagcatcaactgcgccagacaggaggccatcagaatggtgagagtgctgaccgtgatcaaggagtacatcaacgagtgcgacagcgactaccacaaggagagaatgatcctgcccatgagcagagccttcagaggcaagcacctgagcctgatcgtgagattccccaaccagggcagacaggtggacgagctggacatctggagccacaccaacgacaccatcggcagcgtgagaagatgcatcgtgaacagaatcaaggccaacgtggcccacaagaagatcgagctgttcgtgggcggcgagctgatcgacagcgaggacgacagaaagctgatcggccagctgaacctgaaggacaagagcctgatcaccgccaagctgacccagatcaacttcaacatgcccagcagccccgacagcagcagcgacagcagcaccgccagccccggcaaccacagaaaccactacaacgacggccccaacctggaggtggagagctgcctgcccggcgtgatcatgagcgtgcaccccagatacatcagcttcctgtggcaggtggccgacctgggcagcaacctgaacatgccccccctgagagacggcgccagagtgctgatgaagctgatgccccccgacagaaccgccgtggagaagctgagagccgtgtgcctggaccacgccaagctgggcgagggcaagctgagcccccccctggacagcctgttcttcggccccagcgccagccaggtgctgtacctgaccgaggtggtgtacgccctgctgatgcccgccggcgtgcccctgaccgacggcagcagcgacttccaggtgcacttcctgaagagcggcggcctgcccctggtgctgagcatgctgatcagaaacaacttcctgcccaacaccgacatggagaccagaagaggcgcctacctgaacgccctgaagatcgccaagctgctgctgaccgccatcggctacggccacgtgagagccgtggccgaggcctgccagcccgtggtggacggcaccgaccccatcacccagatcaaccaggtgacccacgaccaggccgtggtgctgcagagcgccctgcagagcatccccaaccccagcagcgagtgcgtgctgagaaacgagagcatcctgctggcccaggagatcagcaacgaggccagcagatacatgcccgacatctgcgtgatcagagccatccagaagatcatctgggccagcgcctgcggcgccctgggcctggtgttcagccccaacgaggagatcaccaagatctaccagatgaccaccaacggcagcaacaagctggaggtggaggacgagcaggtgtgctgcgaggccctggaggtgatgaccctgtgcttcgccctgctgcccaccgccctggacgccctgagcaaggagaaggcctggcagaccttcatcatcgacctgctgctgcactgccccagcaagaccgtgagacagctggcccaggagcagttcttcctgatgtgcaccagatgctgcatgggccacagacccctgctgttcttcatcaccctgctgttcaccatcctgggcagcaccgccagagagaagggcaagtacagcggcgactacttcaccctgctgagacacctgctgaactacgcctacaacggcaacatcaacatccccaacgccgaggtgctgctggtgagcgagatcgactggctgaagagaatcagagacaacgtgaagaacaccggcgagaccggcgtggaggagcccatcctggagggccacctgggcgtgaccaaggagctgctggccttccagaccagcgagaagaagtaccacttcggctgcgagaagggcggcgccaacctgatcaaggagctgatcgacgacttcatcttccccgccagcaaggtgtacctgcagtacctgagaagcggcgagctgcccgccgagcaggccatccccgtgtgcagcagccccgtgaccatcaacgccggcttcgagctgctggtggccctggccatcggctgcgtgagaaacctgaagcagatcgtggactgcctgaccgagatgtactacatgggcaccgccatcaccacctgcgaggccctgaccgagtgggagtacctgccccccgtgggccccagaccccccaagggcttcgtgggcctgaagaacgccggcgccacctgctacatgaacagcgtgatccagcagctgtacatgatccccagcatcagaaacagcatcctggccatcgagggcaccggcagcgacctgcacgacgacatgttcggcgacgagaagcaggacagcgagagcaacgtggaccccagagacgacgtgttcggctacccccaccagttcgaggacaagcccgccctgagcaagaccgaggacagaaaggagtacaacatcggcgtgctgagacacctgcaggtgatcttcggccacctggccgccagccagctgcagtactacgtgcccagaggcttctggaagcagttcagactgtggggcgagcccgtgaacctgagagagcagcacgacgccctggagttcttcaacagcctggtggacagcctggacgaggccctgaaggccctgggccaccccgccatcctgagcaaggtgctgggcggcagcttcgccgaccagaagatctgccagggctgcccccacagatacgagtgcgaggagagcttcaccaccctgaacgtggacatcagaaaccaccagaacctgctggacagcctggagcagtacatcaagggcgacctgctggagggcgccaacgcctaccactgcgagaagtgcgacaagaaggtggacaccgtgaagagactgctgatcaagaagctgcccagagtgctggccatccagctgaagagattcgactacgactgggagagagagtgcgccatcaagttcaacgactacttcgagttccccagagagctggacatgggcccctacaccgtggccggcgtggccaacctggagagagacaacgtgaacagcgagaacgagctgatcgagcagaaggagcagagcgacaacgagaccgccggcggcaccaagtacagactggtgggcgtgctggtgcacagcggccaggccagcggcggccactactacagctacatcatccagagaaacggcaaggacgaccagaccgaccactggtacaagttcgacgacggcgacgtgaccgagtgcaagatggacgacgacgaggagatgaagaaccagtgcttcggcggcgagtacatgggcgaggtgttcgaccacatgatgaagagaatgagctacagaagacagaagagatggtggaacgcctacatcctgttctacgagcagatggacatgatcgacgaggacgacgagatgatcagatacatcagcgagctgaccatcgccagaccccaccagatcatcatgagccccgccatcgagagaagcgtgagaaagcagaacgtgaagttcatgcacaacagactgcagtacagcctggagtacttccagttcgtgaagaagctgctgacctgcaacggcgtgtacctgaaccccgcccccggccaggactacctgctgcccgaggccgaggagatcaccatgatcagcatccagctggccgccagattcctgttcaccaccggcttccacaccaagaagatcgtgagaggccccgccagcgactggtacgacgccctgtgcgtgctgctgagacacagcaagaacgtgagattctggttcacccacaacgtgctgttcaacgtgagcaacagattcagcgagtacctgctggagtgccccagcgccgaggtgagaggcgccttcgccaagctgatcgtgttcatcgcccacttcagcctgcaggacggcagctgccccagccccttcgccagccccggccccagcagccaggcctgcgacaacctgagcctgagcgaccacctgctgagagccaccctgaacctgctgagaagagaggtgagcgagcacggccaccacctgcagcagtacttcaacctgttcgtgatgtacgccaacctgggcgtggccgagaagacccagctgctgaagctgaacgtgcccgccaccttcatgctggtgagcctggacgagggccccggcccccccatcaagtaccagtacgccgagctgggcaagctgtacagcgtggtgagccagctgatcagatgctgcaacgtgagcagcaccatgcagagcagcatcaacggcaacccccccctgcccaaccccttcggcgacctgaacctgagccagcccatcatgcccatccagcagaacgtgctggacatcctgttcgtgagaaccagctacgtgaagaagatcatcgaggactgcagcaacagcgaggacaccatcaagctgctgagattctgcagctgggagaacccccagttcagcagcaccgtgctgagcgagctgctgtggcaggtggcctacagctacacctacgagctgagaccctacctggacctgctgttccagatcctgctgatcgaggacagctggcagacccacagaatccacaacgccctgaagggcatccccgacgacagagacggcctgttcgacaccatccagagaagcaagaaccactaccagaagagagcctaccagtgcatcaagtgcatggtggccctgttcagcagctgccccgtggcctaccagatcctgcagggcaacggcgacctgaagagaaagtggacctgggccgtggagtggctgggcgacgagctggagagaagaccctacaccggcaacccccagtacagctacaacaactggagcccccccgtgcagagcaacgagaccgccaacggctacttcctggagagaagccacagcgccagaatgaccctggccaaggcctgcgagctgtgccccgaggaggagcccgacgaccaggacgcccccgacgagcacgagcccagccccagcgaggacgcccccctgtacccccacagccccgccagccagtaccagcagaacaaccacgtgcacggccagccctacaccggccccgccgcccaccacctgaacaacccccagaagaccggccagagaacccaggagaactacgagggcaacgaggaggtgagcagcccccagatgaaggaccagtag

SEQ ID NO: 104428 - DNA, 714 bp, Artificial Sequence
  Description of Artificial Sequence: Synthetic coding sequence
tgactgctgaagaccgccgtgacccagagaatccccagcaactacttcgccttcgccctgggcagaatcctgagcagccacctgctgagcagcgccaacttcagcggcagaatccacaacgccctgaagggcatccccgacgacagagacggcctgttcgacaccatccagagaagcaagaaccactaccagaagagagcctaccagtgcatcaagtgcatggtggccctgttcagcagctgccccgtggcctaccagatcctgcagggcaacggcgacctgaagagaaagtggacctgggccgtggagtggctgggcgacgagctggagagaagaccctacaccggcaacccccagtacagctacaacaactggagcccccccgtgcagagcaacgagaccgccaacggctacttcctggagagaagccacagcgccagaatgaccctggccaaggcctgcgagctgtgccccgaggaggagcccgacgaccaggacgcccccgacgagcacgagcccagccccagcgaggacgcccccctgtacccccacagccccgccagccagtaccagcagaacaaccacgtgcacggccagccctacaccggccccgccgcccaccacctgaacaacccccagaagaccggccagagaacccaggagaactacgagggcaacgaggaggtgagcagcccccagatgaaggaccagtag

SEQ ID NO: 104429 - DNA, 3201 bp, Artificial Sequence
  Description of Artificial Sequence: Synthetic coding sequence
atgaccgaccaggagaacaacaacaacatcagcagcaaccccttcgccgccctgttcggcagcctggccgacgccaagcagttcgccgccatccagaaggagcagctgaagcagcagagcgacgagctgcccgccagccccgacgacagcgacaacagcgtgagcgagagcctggacgagttcgactacagcgtggccgagatcagcagaagcttcagaagccagcaggagatctgcgagcagctgaacatcaaccacatgatccagagaatcttcctgatcaccctggacaacagcgaccccagcctgaagagcggcaacggcatccccagcagatgcgtgtacctggaggagatggccgtggagctggaggaccaggactggctggacatgagcaacgtggagcaggccctgttcgccagactgctgctgcaggaccccggcaaccacctgatcaacatgaccagcagcaccaccctgaacctgagcgccgacagagacgccggcgagagacacatcttctgctacctgtacagctgcttccagagagccaaggaggagatcaccaaggtgcccgagaacctgctgcccttcgccgtgcagtgcagaaacctgaccgtgagcaacaccagaaccgtgctgctgacccccgagatctacgtggaccagaacatccacgagcagctggtggacctgatgctggaggccatccagggcgcccacttcgaggacgtgaccgagttcctggaggaggtgatcgaggccctgatcctggacgaggaggtgagaaccttccccgaggtgatgatccccgtgttcgacatcctgctgggcagaatcaaggacctggagctgtgccagatcctgctgtacgcctacctggacatcctgctgtacttcaccagacagaaggacatggccaaggtgttcgtggagtacatccagcccaaggaccccaccaacggccagatgtaccagaagaccctgctgggcgtgatcctgagcatcagctgcctgctgaagacccccggcgtggtggagaaccacggctacttcctgaaccccagcagaagcagcccccaggagatcaaggtgcaggaggccaacatccaccagttcatggcccagttccacgagaagatctaccagatgctgaagaacctgctgcagctgagccccgagaccaagcactgcatcctgagctggctgggcaactgcctgcacgccaacgccggcagaaccaagatctgggccaaccagatgcccgagatcttcttccagatgtacgccagcgacgccttcttcctgaacctgggcgccgccctgctgaagctgtgccagcccttctgcaagcccagaagcagcagactgctgaccttcaaccccacctactgcgccctgaaggagctgaacgacgaggagagaaagatcaagaacgtgcacatgagaggcctggacaaggagacctgcctgatccccgccgtgcaggagcccaagttcccccagaactacaacctggtgaccgagaacctggccctgaccgagtacaccctgtacctgggcttccacagactgcacgaccagatggtgaagatcaaccagaacctgcacagactgcaggtggcctggagagacgcccagcagagcagcagccccgccgccgacaacctgagagagcagttcgagagactgatgaccatctacctgagcaccaagaccgccatgaccgagccccagatgctgcagaactgcctgaacctgcaggtgagcatggccgtgctgctggtgcagctggccatcggcaacgagggcagccagcccatcgagctgaccttccccctgcccgacggctacagcagcctggcctacgtgcccgagttcttcgccgacaacctgggcgacttcctgatcttcctgagaagattcgccgacgacatcctggagaccagcgccgacagcctggagcacgtgctgcacttcatcaccatcttcaccggcagcatcgagagaatgaagaacccccacctgagagccaagctggccgaggtgctggaggccgtgatgccccacctggaccagacccccaaccccctggtgagcagcgtgttccacagaaagagagtgttctgcaacttccagtacgccccccagctggccgaggccctgatcaaggtgttcgtggacatcgagttcaccggcgacccccaccagttcgagcagaagttcaactacagaagacccatgtaccccatcctgagatacatgtggggcaccgacacctacagagagagcatcaaggacctggccgactacgccagcaagaacctggaggccatgaacccccccctgttcctgagattcctgaacctgctgatgaacgacgccatcttcctgctggacgaggccatccagtacctgagcaagatcaagatccagcagatcgagaaggacagaggcgagtgggacagcctgacccccgaggccagaagagagaaggaggccggcctgcagatgttcggccagctggccagattccacaacatcatgagcaacgagaccatcggcaccctggccttcctgaccagcgagatcaagagcctgttcgtgcaccccttcctggccgagagaatcatcagcatgctgaactacttcctgcagcacctggtgggccccaagatgggcgccctgaaggtgaaggacttcagcgagttcgacttcaagccccagcagctggtgagcgacatctgcaccatctacctgaacctgggcgacgaggagaacttctgcgccaccgtgcccaaggacggcagaagctacagccccaccctgttcgcccagaccgtgagagtgctgaagaagatcaacaagcccggcaacatgatcatggccttcagcaacctggccgagagaatcaagagcctggccgacctgcagcagcaggaggaggagacctacgccgacgcctgcgacgagttcctggaccccatcatgagcaccctgatgtgcgaccccgtggtgctgcccagcagcagagtgaccgtggacagaagcaccatcgccagacacctgctgagcgaccagaccgaccccttcaacagaagccccctgaccatggaccagatcagacccaacaccgagctgaaggagaagatccagagatggctggccgagagaaagcagcagaaggagcagctggagtag

SEQ ID NO: 104430 - DNA, 3222 bp, Artificial Sequence
  Description of Artificial Sequence: Synthetic coding sequence
atgaccgaccaggagaacaacaacaacatcagcagcaaccccttcgccgccctgttcggcagcctggccgacgccaagcagttcgccgccatccagaaggagcagctgaagcagcagagcgacgagctgcccgccagccccgacgacagcgacaacagcgtgagcgagagcctggacgagttcgactacagcgtggccgagatcagcagaagcttcagaagccagcaggagatctgcgagcagctgaacatcaaccacatgatccagagaatcttcctgatcaccctggacaacagcgaccccagcctgaagagcggcaacggcatccccagcagatgcgtgtacctggaggagatggccgtggagctggaggaccaggactggctggacatgagcaacgtggagcaggccctgttcgccagactgctgctgcaggaccccggcaaccacctgatcaacatgaccagcagcaccaccctgaacctgagcgccgacagagacgccggcgagagacacatcttctgctacctgtacagctgcttccagagagccaaggaggagatcaccaaggtgcccgagaacctgctgcccttcgccgtgcagtgcagaaacctgaccgtgagcaacaccagaaccgtgctgctgacccccgagatctacgtggaccagaacatccacgagcagctggtggacctgatgctggaggccatccagggcgccagagagtacatgaacaagatctacttcgaggacgtgaccgagttcctggaggaggtgatcgaggccctgatcctggacgaggaggtgagaaccttccccgaggtgatgatccccgtgttcgacatcctgctgggcagaatcaaggacctggagctgtgccagatcctgctgtacgcctacctggacatcctgctgtacttcaccagacagaaggacatggccaaggtgttcgtggagtacatccagcccaaggaccccaccaacggccagatgtaccagaagaccctgctgggcgtgatcctgagcatcagctgcctgctgaagacccccggcgtggtggagaaccacggctacttcctgaaccccagcagaagcagcccccaggagatcaaggtgcaggaggccaacatccaccagttcatggcccagttccacgagaagatctaccagatgctgaagaacctgctgcagctgagccccgagaccaagcactgcatcctgagctggctgggcaactgcctgcacgccaacgccggcagaaccaagatctgggccaaccagatgcccgagatcttcttccagatgtacgccagcgacgccttcttcctgaacctgggcgccgccctgctgaagctgtgccagcccttctgcaagcccagaagcagcagactgctgaccttcaaccccacctactgcgccctgaaggagctgaacgacgaggagagaaagatcaagaacgtgcacatgagaggcctggacaaggagacctgcctgatccccgccgtgcaggagcccaagttcccccagaactacaacctggtgaccgagaacctggccctgaccgagtacaccctgtacctgggcttccacagactgcacgaccagatggtgaagatcaaccagaacctgcacagactgcaggtggcctggagagacgcccagcagagcagcagccccgccgccgacaacctgagagagcagttcgagagactgatgaccatctacctgagcaccaagaccgccatgaccgagccccagatgctgcagaactgcctgaacctgcaggtgagcatggccgtgctgctggtgcagctggccatcggcaacgagggcagccagcccatcgagctgaccttccccctgcccgacggctacagcagcctggcctacgtgcccgagttcttcgccgacaacctgggcgacttcctgatcttcctgagaagattcgccgacgacatcctggagaccagcgccgacagcctggagcacgtgctgcacttcatcaccatcttcaccggcagcatcgagagaatgaagaacccccacctgagagccaagctggccgaggtgctggaggccgtgatgccccacctggaccagacccccaaccccctggtgagcagcgtgttccacagaaagagagtgttctgcaacttccagtacgccccccagctggccgaggccctgatcaaggtgttcgtggacatcgagttcaccggcgacccccaccagttcgagcagaagttcaactacagaagacccatgtaccccatcctgagatacatgtggggcaccgacacctacagagagagcatcaaggacctggccgactacgccagcaagaacctggaggccatgaacccccccctgttcctgagattcctgaacctgctgatgaacgacgccatcttcctgctggacgaggccatccagtacctgagcaagatcaagatccagcagatcgagaaggacagaggcgagtgggacagcctgacccccgaggccagaagagagaaggaggccggcctgcagatgttcggccagctggccagattccacaacatcatgagcaacgagaccatcggcaccctggccttcctgaccagcgagatcaagagcctgttcgtgcaccccttcctggccgagagaatcatcagcatgctgaactacttcctgcagcacctggtgggccccaagatgggcgccctgaaggtgaaggacttcagcgagttcgacttcaagccccagcagctggtgagcgacatctgcaccatctacctgaacctgggcgacgaggagaacttctgcgccaccgtgcccaaggacggcagaagctacagccccaccctgttcgcccagaccgtgagagtgctgaagaagatcaacaagcccggcaacatgatcatggccttcagcaacctggccgagagaatcaagagcctggccgacctgcagcagcaggaggaggagacctacgccgacgcctgcgacgagttcctggaccccatcatgagcaccctgatgtgcgaccccgtggtgctgcccagcagcagagtgaccgtggacagaagcaccatcgccagacacctgctgagcgaccagaccgaccccttcaacagaagccccctgaccatggaccagatcagacccaacaccgagctgaaggagaagatccagagatggctggccgagagaaagcagcagaaggagcagctggagtag

SEQ ID NO: 104431 - DNA, 1617 bp, Artificial Sequence
  Description of Artificial Sequence: Synthetic coding sequence
atggtgaagatcaaccagaacctgcacagactgcaggtggcctggagagacgcccagcagagcagcagccccgccgccgacaacctgagagagcagttcgagagactgatgaccatctacctgagcaccaagaccgccatgaccgagccccagatgctgcagaactgcctgaacctgcaggtgagcatggccgtgctgctggtgcagctggccatcggcaacgagggcagccagcccatcgagctgaccttccccctgcccgacggctacagcagcctggcctacgtgcccgagttcttcgccgacaacctgggcgacttcctgatcttcctgagaagattcgccgacgacatcctggagaccagcgccgacagcctggagcacgtgctgcacttcatcaccatcttcaccggcagcatcgagagaatgaagaacccccacctgagagccaagctggccgaggtgctggaggccgtgatgccccacctggaccagacccccaaccccctggtgagcagcgtgttccacagaaagagagtgttctgcaacttccagtacgccccccagctggccgaggccctgatcaaggtgttcgtggacatcgagttcaccggcgacccccaccagttcgagcagaagttcaactacagaagacccatgtaccccatcctgagatacatgtggggcaccgacacctacagagagagcatcaaggacctggccgactacgccagcaagaacctggaggccatgaacccccccctgttcctgagattcctgaacctgctgatgaacgacgccatcttcctgctggacgaggccatccagtacctgagcaagatcaagatccagcagatcgagaaggacagaggcgagtgggacagcctgacccccgaggccagaagagagaaggaggccggcctgcagatgttcggccagctggccagattccacaacatcatgagcaacgagaccatcggcaccctggccttcctgaccagcgagatcaagagcctgttcgtgcaccccttcctggccgagagaatcatcagcatgctgaactacttcctgcagcacctggtgggccccaagatgggcgccctgaaggtgaaggacttcagcgagttcgacttcaagccccagcagctggtgagcgacatctgcaccatctacctgaacctgggcgacgaggagaacttctgcgccaccgtgcccaaggacggcagaagctacagccccaccctgttcgcccagaccgtgagagtgctgaagaagatcaacaagcccggcaacatgatcatggccttcagcaacctggccgagagaatcaagagcctggccgacctgcagcagcaggaggaggagacctacgccgacgcctgcgacgagttcctggaccccatcatgagcaccctgatgtgcgaccccgtggtgctgcccagcagcagagtgaccgtggacagaagcaccatcgccagacacctgctgagcgaccagaccgaccccttcaacagaagccccctgaccatggaccagatcagacccaacaccgagctgaaggagaagatccagagatggctggccgagagaaagcagcagaaggagcagctggagtag

SEQ ID NO: 104432 - DNA, 3522 bp, Artificial Sequence
  Description of Artificial Sequence: Synthetic coding sequence
atggaggagctgagcgccgacgagatcagaagaagaagactggccagactggccggcggccagaccagccagcccaccacccccctgaccagcccccagagagagaacccccccggcccccccatcgccgccagcgcccccggccccagccagagcctgggcctgaacgtgcacaacatgacccccgccaccagccccatcggcgccagcggcgtggcccacagaagccagagcagcgagggcgtgagcagcctgagcagcagccccagcaacagcctggagacccagagccagagcctgagcagaagccagagcatggacatcgacggcgtgagctgcgagaagagcatgagccaggtggacgtggacagcggcatcgagaacatggaggtggacgagaacgacagaagagagaagagaagcctgagcgacaaggagcccagcagcggccccgaggtgagcgaggagcaggccctgcagctggtgtgcaagatcttcagagtgagctggaaggacagagacagagacgtgatcttcctgagcagcctgagcgcccagttcaagcagaaccccaaggaggtgttcagcgacttcaaggacctgatcggccagatcctgatggaggtgctgatgatgagcacccagaccagagacgagaaccccttcgccagcctgaccgccaccagccagcccatcgccgccgccgccagaagccccgacagaaacctgctgctgaacaccggcagcaaccccggcaccagccccatgttctgcagcgtggccagcttcggcgccagcagcctgagcagcctgggcgccagcggcggcgccagcaactgggacagctacagcgaccacttcaccatcgagacctgcaaggagaccgacatgctgaactacctgatcgagtgcttcgacagagtgggcatcgaggagaagaaggcccccaagatgtgcagccagcccgccgtgagccagctgctgagcaacatcagaagccagtgcatcagccacaccgccctggtgctgcagggcagcctgacccagcccagaagcctgcagcagcccagcttcctggtgccctacatgctgtgcagaaacctgccctacggcttcatccaggagctggtgagaaccacccaccaggacgaggaggtgttcaagcagatcttcatccccatcctgcagggcctggccctggccgccaaggagtgcagcctggacagcgactacttcaagtaccccctgatggccctgggcgagctgtgcgagaccaagttcggcaagacccaccccgtgtgcaacctggtggccagcctgagactgtggctgcccaagagcctgagccccggctgcggcagagagctgcagagactgagctacctgggcgccttcttcagcttcagcgtgttcgccgaggacgacgtgaaggtggtggagaagtacttcagcggccccgccatcaccctggagaacaccagagtggtgagccagagcctgcagcactacctggagctgggcagacaggagctgttcaagatcctgcacagcatcctgctgaacggcgagaccagagaggccgccctgagctacatggccgccgtggtgaacgccaacatgaagaaggcccagatgcagaccgacgacagactggtgagcaccgacggcttcatgctgaacttcctgtgggtgctgcagcagctgagcaccaagatcaagctggagaccgtggaccccacctacatcttccaccccagatgcagaatcaccctgcccaacgacgagaccagagtgaacgccaccatggaggacgtgaacgactggctgaccgagctgtacggcgaccagccccccttcagcgagcccaagttccccaccgagtgcttcttcctgaccctgcacgcccaccacctgagcatcctgcccagctgcagaagatacatcagaagactgagagccatcagagagctgaacagaaccgtggaggacctgaagaacaacgagagccagtggaaggacagccccctggccaccagacacagagagatgctgaagagatgcaagacccagctgaagaagctggtgagatgcaaggcctgcgccgacgccggcctgctggacgagagcttcctgagaagatgcctgaacttctacggcctgctgatccagctgctgctgagaatcctggaccccgcctaccccgacatcaccctgcccctgaacagcgacgtgcccaaggtgttcgccgccctgcccgagttctacgtggaggacgtggccgagttcctgttcttcatcgtgcagtacagcccccaggccctgtacgagccctgcacccaggacatcgtgatgttcctggtggtgatgctgtgcaaccagaactacatcagaaacccctacctggtggccaagctggtggaggtgatgttcatgaccaaccccgccgtgcagcccagaacccagaagttcttcgagatgatcgagaaccaccccctgagcaccaagctgctggtgcccagcctgatgaagttctacaccgacgtggagcacaccggcgccaccagcgagttctacgacaagttcaccatcagataccacatcagcaccatcttcaagagcctgtggcagaacatcgcccaccacggcaccttcatggaggagttcaacagcggcaagcagttcgtgagatacatcaacatgctgatcaacgacaccaccttcctgctggacgagagcctggagagcctgaagagaatccacgaggtgcaggaggagatgaagaacaaggagcagtgggaccagctgcccagagaccagcagcaggccagacagagccagctggcccaggacgagagagtgagcagaagctacctggccctggccaccgagaccgtggacatgttccacatcctgaccaagcaggtgcagaagcccttcctgagacccgagctgggccccagactggccgccatgctgaacttcaacctgcagcagctgtgcggccccaagtgcagagacctgaaggtggagaaccccgagaagtacggcttcgagcccaagaagctgctggaccagctgaccgacatctacctgcagctggactgcgccagattcgccaaggccatcgccgacgaccagagaagctacagcaaggagctgttcgaggaggtgatcagcaagatgagaaaggccggcatcaagagcaccatcgccatcgagaagttcaagctgctggccgagaaggtggaggagatcgtggccaagaacgccagagccgagatcgactacagcgacgcccccgacgagttcagagaccccctgatggacaccctgatgaccgaccccgtgagactgcccagcggcaccatcatggacagaagcatcatcctgagacacctgctgaacagccccaccgaccccttcaacagacagaccctgaccgagagcatgctggagcccgtgcccgagctgaaggagcagatccaggcctggatgagagagaagcagaacagcgaccactag

SEQ ID NO: 104433 - DNA, 3909 bp, Artificial Sequence
  Description of Artificial Sequence: Synthetic coding sequence
atggaggagctgagcgccgacgagatcagaagaagaagactggccagactggccggcggccagaccagccagcccaccacccccctgaccagcccccagagagagaacccccccggcccccccatcgccgccagcgcccccggccccagccagagcctgggcctgaacgtgcacaacatgacccccgccaccagccccatcggcgccagcggcgtggcccacagaagccagagcagcgagggcgtgagcagcctgagcagcagccccagcaacagcctggagacccagagccagagcctgagcagaagccagagcatggacatcgacggcgtgagctgcgagaagagcatgagccaggtggacgtggacagcggcatcgagaacatggaggtggacgagaacgacagaagagagaagagaagcctgagcgacaaggagcccagcagcggccccgaggtgagcgaggagcaggccctgcagctggtgtgcaagatcttcagagtgagctggaaggacagagacagagacgtgatcttcctgagcagcctgagcgcccagttcaagcagaaccccaaggaggtgttcagcgacttcaaggacctgatcggccagatcctgatggaggtgctgatgatgagcacccagaccagagacgagaaccccttcgccagcctgaccgccaccagccagcccatcgccgccgccgccagaagccccgacagaaacctgctgctgaacaccggcagcaaccccggcaccagccccatgttctgcagcgtggccagcttcggcgccagcagcctgagcagcctgtacgagagcagccccgcccccacccccagcttctggagcagcgtgcccgtgatgggccccagcctggccagccccagcagagccgccagccagctggccgtgcccagcacccccctgagcccccacagcgccgccagcggcaccgccgccggcagccagcccagcagccccagatacagaccctacaccgtgacccacccctgggccagcagcggcgtgagcatcctgagcagcagccccagcccccccgccctggccagcagcccccaggccgtgcccgccagcagcagcagacagagacccagcagcaccggcccccccctgccccccgccagccccagcgccaccagcagaagacccagcagcctgagaatcagccccagcctgggcgccagcggcggcgccagcaactgggacagctacagcgaccacttcaccatcgagacctgcaaggagaccgacatgctgaactacctgatcgagtgcttcgacagagtgggcatcgaggagaagaaggcccccaagatgtgcagccagcccgccgtgagccagctgctgagcaacatcagaagccagtgcatcagccacaccgccctggtgctgcagggcagcctgacccagcccagaagcctgcagcagcccagcttcctggtgccctacatgctgtgcagaaacctgccctacggcttcatccaggagctggtgagaaccacccaccaggacgaggaggtgttcaagcagatcttcatccccatcctgcagggcctggccctggccgccaaggagtgcagcctggacagcgactacttcaagtaccccctgatggccctgggcgagctgtgcgagaccaagttcggcaagacccaccccgtgtgcaacctggtggccagcctgagactgtggctgcccaagagcctgagccccggctgcggcagagagctgcagagactgagctacctgggcgccttcttcagcttcagcgtgttcgccgaggacgacgtgaaggtggtggagaagtacttcagcggccccgccatcaccctggagaacaccagagtggtgagccagagcctgcagcactacctggagctgggcagacaggagctgttcaagatcctgcacagcatcctgctgaacggcgagaccagagaggccgccctgagctacatggccgccgtggtgaacgccaacatgaagaaggcccagatgcagaccgacgacagactggtgagcaccgacggcttcatgctgaacttcctgtgggtgctgcagcagctgagcaccaagatcaagctggagaccgtggaccccacctacatcttccaccccagatgcagaatcaccctgcccaacgacgagaccagagtgaacgccaccatggaggacgtgaacgactggctgaccgagctgtacggcgaccagccccccttcagcgagcccaagttccccaccgagtgcttcttcctgaccctgcacgcccaccacctgagcatcctgcccagctgcagaagatacatcagaagactgagagccatcagagagctgaacagaaccgtggaggacctgaagaacaacgagagccagtggaaggacagccccctggccaccagacacagagagatgctgaagagatgcaagacccagctgaagaagctggtgagatgcaaggcctgcgccgacgccggcctgctggacgagagcttcctgagaagatgcctgaacttctacggcctgctgatccagctgctgctgagaatcctggaccccgcctaccccgacatcaccctgcccctgaacagcgacgtgcccaaggtgttcgccgccctgcccgagttctacgtggaggacgtggccgagttcctgttcttcatcgtgcagtacagcccccaggccctgtacgagccctgcacccaggacatcgtgatgttcctggtggtgatgctgtgcaaccagaactacatcagaaacccctacctggtggccaagctggtggaggtgatgttcatgaccaaccccgccgtgcagcccagaacccagaagttcttcgagatgatcgagaaccaccccctgagcaccaagctgctggtgcccagcctgatgaagttctacaccgacgtggagcacaccggcgccaccagcgagttctacgacaagttcaccatcagataccacatcagcaccatcttcaagagcctgtggcagaacatcgcccaccacggcaccttcatggaggagttcaacagcggcaagcagttcgtgagatacatcaacatgctgatcaacgacaccaccttcctgctggacgagagcctggagagcctgaagagaatccacgaggtgcaggaggagatgaagaacaaggagcagtgggaccagctgcccagagaccagcagcaggccagacagagccagctggcccaggacgagagagtgagcagaagctacctggccctggccaccgagaccgtggacatgttccacatcctgaccaagcaggtgcagaagcccttcctgagacccgagctgggccccagactggccgccatgctgaacttcaacctgcagcagctgtgcggccccaagtgcagagacctgaaggtggagaaccccgagaagtacggcttcgagcccaagaagctgctggaccagctgaccgacatctacctgcagctggactgcgccagattcgccaaggccatcgccgacgaccagagaagctacagcaaggagctgttcgaggaggtgatcagcaagatgagaaaggccggcatcaagagcaccatcgccatcgagaagttcaagctgctggccgagaaggtggaggagatcgtggccaagaacgccagagccgagatcgactacagcgacgcccccgacgagttcagagaccccctgatggacaccctgatgaccgaccccgtgagactgcccagcggcaccatcatggacagaagcatcatcctgagacacctgctgaacagccccaccgaccccttcaacagacagaccctgaccgagagcatgctggagcccgtgcccgagctgaaggagcagatccaggcctggatgagagagaagcagaacagcgaccactag

SEQ ID NO: 104434 - DNA, 303 bp, Artificial Sequence
  Description of Artificial Sequence: Synthetic coding sequence
atggaggagctgagcgccgacgagatcagaagaagaagactggccagactggccggcggccagaccagccagcccaccacccccctgaccagcccccagagagagaacccccccggcccccccatcgccgccagcgcccccggccccagccagagcctgggcctgaacgtgcacaacatgacccccgccaccagccccatcggcgccagcggcctgggcatcatcagcgacgacaagatgatcaagaccgagttcggcagcgccgacttcatgaacctggtggacggcttcaagatcaagtag

SEQ ID NO: 104435 - DNA, 3186 bp, Artificial Sequence
  Description of Artificial Sequence: Synthetic coding sequence
atgagccaggtggacgtggacagcggcatcgagaacatggaggtggacgagaacgacagaagagagaagagaagcctgagcgacaaggagcccagcagcggccccgaggtgagcgaggagcaggccctgcagctggtgtgcaagatcttcagagtgagctggaaggacagagacagagacgtgatcttcctgagcagcctgagcgcccagttcaagcagaaccccaaggaggtgttcagcgacttcaaggacctgatcggccagatcctgatggaggtgctgatgatgagcacccagaccagagacgagaaccccttcgccagcctgaccgccaccagccagcccatcgccgccgccgccagaagccccgacagaaacctgctgctgaacaccggcagcaaccccggcaccagccccatgttctgcagcgtggccagcttcggcgccagcagcctgagcagcctgggcgccagcggcggcgccagcaactgggacagctacagcgaccacttcaccatcgagacctgcaaggagaccgacatgctgaactacctgatcgagtgcttcgacagagtgggcatcgaggagaagaaggcccccaagatgtgcagccagcccgccgtgagccagctgctgagcaacatcagaagccagtgcatcagccacaccgccctggtgctgcagggcagcctgacccagcccagaagcctgcagcagcccagcttcctggtgccctacatgctgtgcagaaacctgccctacggcttcatccaggagctggtgagaaccacccaccaggacgaggaggtgttcaagcagatcttcatccccatcctgcagggcctggccctggccgccaaggagtgcagcctggacagcgactacttcaagtaccccctgatggccctgggcgagctgtgcgagaccaagttcggcaagacccaccccgtgtgcaacctggtggccagcctgagactgtggctgcccaagagcctgagccccggctgcggcagagagctgcagagactgagctacctgggcgccttcttcagcttcagcgtgttcgccgaggacgacgtgaaggtggtggagaagtacttcagcggccccgccatcaccctggagaacaccagagtggtgagccagagcctgcagcactacctggagctgggcagacaggagctgttcaagatcctgcacagcatcctgctgaacggcgagaccagagaggccgccctgagctacatggccgccgtggtgaacgccaacatgaagaaggcccagatgcagaccgacgacagactggtgagcaccgacggcttcatgctgaacttcctgtgggtgctgcagcagctgagcaccaagatcaagctggagaccgtggaccccacctacatcttccaccccagatgcagaatcaccctgcccaacgacgagaccagagtgaacgccaccatggaggacgtgaacgactggctgaccgagctgtacggcgaccagccccccttcagcgagcccaagttccccaccgagtgcttcttcctgaccctgcacgcccaccacctgagcatcctgcccagctgcagaagatacatcagaagactgagagccatcagagagctgaacagaaccgtggaggacctgaagaacaacgagagccagtggaaggacagccccctggccaccagacacagagagatgctgaagagatgcaagacccagctgaagaagctggtgagatgcaaggcctgcgccgacgccggcctgctggacgagagcttcctgagaagatgcctgaacttctacggcctgctgatccagctgctgctgagaatcctggaccccgcctaccccgacatcaccctgcccctgaacagcgacgtgcccaaggtgttcgccgccctgcccgagttctacgtggaggacgtggccgagttcctgttcttcatcgtgcagtacagcccccaggccctgtacgagccctgcacccaggacatcgtgatgttcctggtggtgatgctgtgcaaccagaactacatcagaaacccctacctggtggccaagctggtggaggtgatgttcatgaccaaccccgccgtgcagcccagaacccagaagttcttcgagatgatcgagaaccaccccctgagcaccaagctgctggtgcccagcctgatgaagttctacaccgacgtggagcacaccggcgccaccagcgagttctacgacaagttcaccatcagataccacatcagcaccatcttcaagagcctgtggcagaacatcgcccaccacggcaccttcatggaggagttcaacagcggcaagcagttcgtgagatacatcaacatgctgatcaacgacaccaccttcctgctggacgagagcctggagagcctgaagagaatccacgaggtgcaggaggagatgaagaacaaggagcagtgggaccagctgcccagagaccagcagcaggccagacagagccagctggcccaggacgagagagtgagcagaagctacctggccctggccaccgagaccgtggacatgttccacatcctgaccaagcaggtgcagaagcccttcctgagacccgagctgggccccagactggccgccatgctgaacttcaacctgcagcagctgtgcggccccaagtgcagagacctgaaggtggagaaccccgagaagtacggcttcgagcccaagaagctgctggaccagctgaccgacatctacctgcagctggactgcgccagattcgccaaggccatcgccgacgaccagagaagctacagcaaggagctgttcgaggaggtgatcagcaagatgagaaaggccggcatcaagagcaccatcgccatcgagaagttcaagctgctggccgagaaggtggaggagatcgtggccaagaacgccagagccgagatcgactacagcgacgcccccgacgagttcagaggcaagtggacccaccccctgatggacaccctgatgaccgaccccgtgagactgcccagcggcaccatcatggacagaagcatcatcctgagacacctgctgaacagccccaccgaccccttcaacagacagaccctgaccgagagcatgctggagcccgtgcccgagctgaaggagcagatccaggcctggatgagagagaagcagaacagcgaccactag

SEQ ID NO: 104436 - DNA, 513 bp, Artificial Sequence
  Description of Artificial Sequence: Synthetic coding sequence
atgcccggcgaggtgcaggccagctacctgaagagccagagcaagctgagcgacgagggcagactggagcccagaaagttccactgcaagggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagaaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 104437 - DNA, 312 bp, Artificial Sequence
  Description of Artificial Sequence: Synthetic coding sequence
atggagaagggcctgaacaccaagaacttcaccgagcagaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 104438 - DNA, 444 bp, Artificial Sequence
  Description of Artificial Sequence: Synthetic coding sequence
atggccgccaccaccggcagcggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagaaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 104439 - DNA, 513 bp, Artificial Sequence; identical to SEQ ID NO: 104436
  Description of Artificial Sequence: Synthetic coding sequence

SEQ ID NO: 104440 - DNA, 312 bp, Artificial Sequence
  Description of Artificial Sequence: Synthetic coding sequence
atgaaggaggacctgaacctggagaacttcaccgccaagaccatctacgagaacagaatctacagcctgaagatcgagtgcggccccaagtaccccgaggccccccccttcgtgagattcgtgaccaagatcaacatgaacggcgtgaacagcagcaacggcgtggtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 104441 - DNA, 312 bp, Artificial Sequence; identical to SEQ ID NO: 104440
  Description of Artificial Sequence: Synthetic coding sequence

SEQ ID NO: 104442 - DNA, 318 bp, Artificial Sequence
  Description of Artificial Sequence: Synthetic coding sequence
atggccgccaccaccggcagcggcgtgaaggtgcccagaaacttcagactgctggaggagctggaggagggccagaagggcgtgggcgacggcaccgtgagctggggcctggaggacgacgaggacatgaccctgaccagatggaccggcatgatcatcggcccccccagagtggaccccagagccatcagcgtgctggccaagtggcagaacagctacagcatcaaggtggtgctgcaggagctgagaagactgatgatgagcaaggagaacatgaagctgccccagccccccgagggccagtgctacagcaactag

SEQ ID NO: 104443 - DNA, 369 bp, Artificial Sequence
  Description of Artificial Sequence: Synthetic coding sequence
atgagcacccccgccagaagaagactgatgagagacttcaagagactgcaggaggacccccccgccggcgtgagcggcgcccccagcgagaacaacatcatggtgtggaacgccgtgatcttcggccccgagggcacccccttcgaggacgtgtacgccgacggcagcatctgcctggacatcctgcagaacagatggagccccacctacgacgtgagcagcatcctgaccagcatccagagcctgctggacgagcccaaccccaacagccccgccaacagccaggccgcccagctgtaccaggagaacaagagagagtacgagaagagagtgagcgccatcgtggagcagagctggagagactgctag

SEQ ID NO: 104444 - DNA, 459 bp, Artificial Sequence
  Description of Artificial Sequence: Synthetic coding sequence
atgagcacccccgccagaagaagactgatgagagacttcaagagactgcaggaggacccccccgccggcgtgagcggcgcccccagcgagaacaacatcatggtgtggaacgccgtgatcttcggccccgagggcacccccttcgaggacggcaccttcaagctgaccatcgagttcaccgaggagtaccccaacaagccccccaccgtgagattcgtgagcaagatgttccaccccaacgtgtacgccgacggcagcatctgcctggacatcctgcagaacagatggagccccacctacgacgtgagcagcatcctgaccagcatccagagcctgctggacgagcccaaccccaacagccccgccaacagccaggccgcccagctgtaccaggagaacaagagagagtacgagaagagagtgagcgccatcgtggagcagagctggagagactgctag

SEQ ID NO: 104445 - DNA, 234 bp, Artificial Sequence
  Description of Artificial Sequence: Synthetic coding sequence
atgttccaccccaacgtgtacgccgacggcagcatctgcctggacatcctgcagaacagatggagccccacctacgacgtgagcagcatcctgaccagcatccagagcctgctggacgagcccaaccccaacagccccgccaacagccaggccgcccagctgtaccaggagaacaagagagagtacgagaagagagtgagcgccatcgtggagcagagctggagagactgctag

SEQ ID NO: 104446 - DNA, 459 bp, Artificial Sequence
  Description of Artificial Sequence: Synthetic coding sequence
atgagcacccccgccagaagaagactgatgagagacttcaagagactgcaggaggacccccccgtgggcgtgagcggcgcccccagcgagaacaacatcatgcagtggaacgccgtgatcttcggccccgagggcacccccttcgaggacggcaccttcaagctggtgatcgagttcagcgaggagtaccccaacaagccccccaccgtgagattcctgagcaagatgttccaccccaacgtgtacgccgacggcagcatctgcctggacatcctgcagaacagatggagccccacctacgacgtgagcagcatcctgaccagcatccagagcctgctggacgagcccaaccccaacagccccgccaacagccaggccgcccagctgtaccaggagaacaagagagagtacgagaagagagtgagcgccatcgtggagcagagctggaacgacagctag

SEQ ID NO: 104447 - DNA, 153 bp, Artificial Sequence
  Description of Artificial Sequence: Synthetic coding sequence
atggccagccagaacagagaccccgccgccaccagcgtggccgccgccagaaagggcgccgagcccagcggcggcgccgccagaggccccgtgggcaagagactgcagcaggagctgatgaccctgatgaaccccaccctgatcgtgccctag

SEQ ID NO: 104448 - DNA, 486 bp, Artificial Sequence
  Description of Artificial Sequence: Synthetic coding sequence
atggccagccagaacagagaccccgccgccaccagcgtggccgccgccagaaagggcgccgagcccagcggcggcgccgccagaggccccgtgggcaagagactgcagcaggagctgatgaccctgatgatgagcggcgacaagggcatcagcgccttccccgagagcgacaacctgttcaagtgggtgggcaccatccacggcgccgccggcaccgccgtgggcagcatcagaaccagcagcaccgtgtgcctgctgagcggccccagagagacccaggacagcagcaagcccctggtgtggggcctgggctgggacatgagactgctgctggagctgaccctgcagctgttcctgcagatgcccgagcccaacatcgacagccccctgaacacccacgccgccgagctgtggaagaaccccaccgccttcaagaagtacctgcaggagacctacagcaagcaggtgaccagccaggagccctag

SEQ ID NO: 104449 - DNA, 453 bp, Artificial Sequence
  Description of Artificial Sequence: Synthetic coding sequence
atggccagccagaacagagaccccgccgccaccagcgtggccgccgccagaaagggcgccgagcccagcggcggcgccgccagaggccccgtgggcaagagactgcagcaggagctgatgaccctgatggtgtacgaggacctgagatacaagctgagcctggagttccccagcggctacccctacaacgcccccaccgtgaagttcctgaccccctgctaccaccccaacgtggacacccagggcaacatctgcctggacatcctgaaggagaagtggagcgccctgtacgacgtgagaaccatcctgctgagcatccagagcctgctgggcgagcccaacatcgacagccccctgaacacccacgccgccgagctgtggaagaaccccaccgccttcaagaagtacctgcaggagacctacagcaagcaggtgaccagccaggagccctag

SEQ ID NO: 104450 - DNA, 540 bp, Artificial Sequence
  Description of Artificial Sequence: Synthetic coding sequence
atggccagccagaacagagaccccgccgccaccagcgtggccgccgccagaaagggcgccgagcccagcggcggcgccgccagaggccccgtgggcaagagactgcagcaggagctgatgaccctgatgatgagcggcgacaagggcatcagcgccttccccgagagcgacaacctgttcaagtgggtgggcaccatccacggcgccgccggcaccgtgtacgaggacctgagatacaagctgagcctggagttccccagcggctacccctacaacgcccccaccgtgaagttcctgaccccctgctaccaccccaacgtggacacccagggcaacatctgcctggacatcctgaaggagaagtggagcgccctgtacgacgtgagaaccatcctgctgagcatccagagcctgctgggcgagcccaacatcgacagccccctgaacacccacgccgccgagctgtggaagaaccccaccgccttcaagaagtacctgcaggagacctacagcaagcaggtgaccagccaggagccctag

SEQ ID NO: 104451 - DNA, 423 bp, Artificial Sequence
  Description of Artificial Sequence: Synthetic coding sequence
atgaccctgatgatgagcggcgacaagggcatcagcgccttccccgagagcgacaacctgttcaagtgggtgggcaccatccacggcgccgccggcaccgtgtacgaggacctgagatacaagctgagcctggagttccccagcggctacccctacaacgcccccaccgtgaagttcctgaccccctgctaccaccccaacgtggacacccagggcaacatctgcctggacatcctgaaggagaagtggagcgccctgtacgacgtgagaaccatcctgctgagcatccagagcctgctgggcgagcccaacatcgacagccccctgaacacccacgccgccgagctgtggaagaaccccaccgccttcaagaagtacctgcaggagacctacagcaagcaggtgaccagccaggagccctag

SEQ ID NO: 104452 - DNA, 423 bp, Artificial Sequence; identical to SEQ ID NO: 104451
  Description of Artificial Sequence: Synthetic coding sequence

SEQ ID NO: 104453 - DNA, 114 bp, Artificial Sequence
  Description of Artificial Sequence: Synthetic coding sequence
atggccgccagcgccgccgagaccagagtgttcctggaggtgagaggccagctgcagagcgccctgctgatcctgggcgacagagtgagcccctactgcccctgctggagctag

SEQ ID NO: 104454 - DNA, 1170 bp, Artificial Sequence
  Description of Artificial Sequence: Synthetic coding sequence
atggccgccagcgccgccgagaccagagtgttcctggaggtgagaggccagctgcagagcgccctgctgatcctgggcgagcccaaggagggcggcatgcccatgaacatcagcatcatgcccagcagcctgcagatgaagacccccgagggctgcaccgagatccagctgcccgccgaggtgagactggtgcccagcagctgcagaggcctgcagttcgtggtgggcgacggcctgcacctgagactgcagacccaggccaagctgggcaccaagctgatcagcatgttcaaccagagcagccagacccaggagtgctgcaccttctactgccagagctgcggcgaggtgatcatcaaggacagaaagctgctgagagtgctgcccctgcccagcgagaactggggcgccctggtgggcgagtggtgctgccaccccgaccccttcgccaacaagagcctgcacccccaggagaacgactgcttcatcggcgacagcttcttcctggtgaacctgagaaccagcctgtggcagcagagacccgagctgagccccgtggagatgtgctgcgtgagcagcgacaaccactgcaagctggagcccaaggccaacaccaaggtgatctgcaagagatgcaaggtgatgctgggcgagaccgtgagcagcgagaccaccaagttctacatgaccgagatcatcatccagagcagcgagagaagcttccccatcatccccagaagctggttcgtgcagagcgtgatcgcccagtgcctggtgcagctgagcagcgccagaagcaccttcagattcaccatccagggccaggacgacaaggtgtacatcctgctgtggctgctgaacagcgacagcctggtgatcgagagcctgagaaacagcaagtacatcaagaagttccccctgctggagaacaccttcaaggccgacagcagcagcgcctggagcgccgtgaaggtgctgtaccagccctgcatcaagagcagaaacgagaagctggtgagcctgtgggagagcgacatcagcgtgcaccccctgaccctgcccagcgccacctgcctggagctgctgctgatcctgagcaagagcaacgccaacctgcccagcagcctgagaagagtgaacagcttccaggtggccttcctgaagatgtag

SEQ ID NO: 104455 - DNA, 444 bp, Artificial Sequence
  Description of Artificial Sequence: Synthetic coding sequence
atggccctgaagagaatccagaaggagctgagcgacctgcagagagacccccccgcccactgcagcgccggccccgtgggcgacgacctgttccactggcaggccaccatcatgggcccccccgacagcgcctaccagggcggcgtgttcttcctgaccgtgcacttccccaccgactaccccttcaagccccccaagatcgccttcaccaccaagatctaccaccccaacatcaacagcaacggcagcatctgcctggacatcctgagaagccagtggagccccgccctgaccgtgagcaaggtgctgctgagcatctgcagcctgctgtgcgaccccaaccccgacgaccccctggtgcccgacatcgcccagatctacaagagcgacaaggagaagtacaacagacacgccagagagtggacccagaagtacgccatgtag

SEQ ID NO: 104456 - DNA, 606 bp, Artificial Sequence
  Description of Artificial Sequence: Synthetic coding sequence
atgagcaccgaggcccagagagtggacgacagccccagcaccagcggcggcagcagcgacggcgaccagagagagagcgtgcagcaggagcccgagagagagcaggtgcagcccaagaagaaggagggcaagatcagcagcaagaccgccgccaagctgagcaccagcgccaagagaatccagaaggagctggccgagatcaccctggaccccccccccaactgcagcgccggccccaagggcgacaacatctacgagtggagaagcaccatcctgggcccccccggcagcgtgtacgagggcggcgtgttcttcctggacatcaccttcagccccgactaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaaccccgccgaccccctggtgggcagcatcgccacccagtacatgaccaacagagccgagcacgacagaatggccagacagtggaccaagagatacgccacctag

SEQ ID NO: 104457 - DNA, 606 bp, Artificial Sequence; identical to SEQ ID NO: 104456
  Description of Artificial Sequence: Synthetic coding sequence

SEQ ID NO: 104458 - DNA, 624 bp, Artificial Sequence
  Description of Artificial Sequence: Synthetic coding sequence
atgagcagcgacagacagagaagcgacgacgagagccccagcaccagcagcggcagcagcgacgccgaccagagagaccccgccgcccccgagcccgaggagcaggaggagagaaagcccagcgccacccagcagaagaagaacaccaagctgagcagcaagaccaccgccaagctgagcaccagcgccaagagaatccagaaggagctggccgagatcaccctggaccccccccccaactgcagcgccggccccaagggcgacaacatctacgagtggagaagcaccatcctgggcccccccggcagcgtgtacgagggcggcgtgttcttcctggacatcaccttcagcagcgactaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaaccccgccgaccccctggtgggcagcatcgccacccagtacctgaccaacagagccgagcacgacagaatcgccagacagtggaccaagagatacgccacctag

SEQ ID NO: 104459 - DNA, 624 bp, Artificial Sequence; identical to SEQ ID NO: 104458
  Description of Artificial Sequence: Synthetic coding sequence

SEQ ID NO: 104460 - DNA, 624 bp, Artificial Sequence; identical to SEQ ID NO: 104458
  Description of Artificial Sequence: Synthetic coding sequence

SEQ ID NO: 104461 - DNA, 624 bp, Artificial Sequence; identical to SEQ ID NO: 104458
  Description of Artificial Sequence: Synthetic coding sequence

SEQ ID NO: 104462 - DNA, 528 bp, Artificial Sequence
  Description of Artificial Sequence: Synthetic coding sequence
atgagcagcgacagacagagaagcgacgacgagagccccagcaccagcagcggcagcagcgacgccgaccagagagaccccgccgcccccgagcccgaggagcaggaggagagaaagcccagcgccacccagcagaagaagaacaccaagctgagcagcaagaccaccgccaagctgagcaccagcgccaagagaatccagaaggagctggccgagatcaccctggaccccccccccaactgcagcgccggccccaagggcgacaacatctacgagtggagaagcaccatcctgggcccccccggcagcgtgtacgagggcggcgtgttcttcctggacatcaccttcagcagcgactaccccttcaagccccccaaggtgaccttcagaaccagaatctaccactgcaacatcaacagccagggcgtgatctgcctggacatcctgaaggacaactggagccccgccctgaccatcagcaaggtgctgctgagcatctgcagcctgctgaccgactgcaacccctag

SEQ ID NO: 104463 - DNA, 528 bp, Artificial Sequence; identical to SEQ ID NO: 104462
  Description of Artificial Sequence: Synthetic coding sequence

SEQ ID NO: 104464 - DNA, 528 bp, Artificial Sequence; identical to SEQ ID NO: 104462
  Description of Artificial Sequence: Synthetic coding sequence

SEQ ID NO: 104465 - DNA, 414 bp, Artificial Sequence
  Description of Artificial Sequence: Synthetic coding sequence
atgaacgaggagaacttcttcgagtgggaggccctgatcatgggccccgaggacacctgcttcgagttcggcgtgttccccgccatcctgagcttccccctggactaccccctgagcccccccaagatgagattcacctgcgagatgttccaccccaacatctaccccgacggcagagtgtgcatcagcatcctgcacgcccccggcgacgaccccatgggctacgagagcagcgccgagagatggagccccgtgcagagcgtggagaagatcctgctgagcgtggtgagcatgctggccgagcccaacgacgagagcggcgccaacgtggacgccagcaagatgtggagagacgacagagagcagttctacaagatcgccaagcagatcgtgcagaagagcctgggcctgtag

SEQ ID NO: 104466 - DNA, 498 bp, Artificial Sequence
  Description of Artificial Sequence: Synthetic coding sequence
atggccggcaccgccctgaagagactgatggccgagtacaagcagctgaccctgaacccccccgagggcatcgtggccggccccatgaacgaggagaacttcttcgagtgggaggccctgatcatgggccccgaggacacctgcttcgagttcggcgtgttccccgccatcctgagcttccccctggactaccccctgagcccccccaagatgagattcacctgcgagatgttccaccccaacatctaccccgacggcagagtgtgcatcagcatcctgcacgcccccggcgacgaccccatgggctacgagagcagcgccgagagatggagccccgtgcagagcgtggagaagatcctgctgagcgtggtgagcatgctggccgagcccaacgacgagagcggcgccaacgtggacgccagcaagatgtggagagacgacagagagcagttctacaagatcgccaagcagatcgtgcagaagagcctgggcctgtag

SEQ ID NO: 104467 - DNA, 552 bp, Artificial Sequence
  Description of Artificial Sequence: Synthetic coding sequence
atgagcagccccagccccggcaagagaagaatggacaccgacgtggtgaagctgatcgagagcaagcacgaggtgaccatcctgggcggcctgaacgagttcgtggtgaagttctacggcccccagggcaccccctacgagggcggcgtgtggaaggtgagagtggacctgcccgacaagtaccccttcaagagccccagcatcggcttcatgaacaagatcttccaccccaacatcgacgaggccagcggcaccgtgtgcctggacgtgatcaaccagacctggaccgccctgtacgacctgaccaacatcttcgagagcttcctgccccagctgctggcctaccccaaccccatcgaccccctgaacggcgacgccgccgccatgtacctgcacagacccgaggagtacaagcagaagatcaaggagtacatccagaagtacgccaccgaggaggccctgaaggagcaggaggagggcaccggcgacagcagcagcgagagcagcatgagcgacttcagcgaggacgaggcccaggacatggagctgtag

SEQ ID NO: 104468 - DNA, 459 bp, Artificial Sequence
  Description of Artificial Sequence: Synthetic coding sequence
atgagcagccccagccccggcaagagaagaatggacaccgacgtggtgaagctgatcgagagcaagcacgaggtgaccatcctgggcggcctgaacgagttcgtggtgaagttctacggcccccagggcaccccctacgagggcggcgtgtggaaggtgagagtggacctgcccgacaagtaccccttcaagagccccagcatcgacctgaccaacatcttcgagagcttcctgccccagctgctggcctaccccaaccccatcgaccccctgaacggcgacgccgccgccatgtacctgcacagacccgaggagtacaagcagaagatcaaggagtacatccagaagtacgccaccgaggaggccctgaaggagcaggaggagggcaccggcgacagcagcagcgagagcagcatgagcgacttcagcgaggacgaggcccaggacatggagctgtag

SEQ ID NO: 104469 - DNA, 477 bp, Artificial Sequence
  Description of Artificial Sequence: Synthetic coding sequence
atgagcggcatcgccctgagcagactggcccaggagagaaaggcctggagaaaggaccaccccttcggcttcgtggccgtgcccaccaagaaccccgacggcaccatgaacctgatgaactgggagtgcgccatccccggcaagaagggcaccccctgggagggcggcctgttcaagctgagaatgctgttcaaggacgactaccccagcagcccccccaagtgcaagttcgagccccccctgttccaccccaacgtgtaccccagcggcaccgtgtgcctgagcatcctggaggaggacaaggactggagacccgccatcaccatcaagcagatcctgctgggcatccaggagctgctgaacgagcccaacatccaggaccccgcccaggccgaggcctacaccatctactgccagaacagagtggagtacgagaagagagtgagagcccaggccaagaagttcgcccccagctag

SEQ ID NO: 104470 - DNA, 477 bp, Artificial Sequence; identical to SEQ ID NO: 104469
  Description of Artificial Sequence: Synthetic coding sequence

SEQ ID NO: 104471 - DNA, 477 bp, Artificial Sequence; identical to SEQ ID NO: 104469
  Description of Artificial Sequence: Synthetic coding sequence

SEQ ID NO: 104472 - DNA, 477 bp, Artificial Sequence; identical to SEQ ID NO: 104469
  Description of Artificial Sequence: Synthetic coding sequence

SEQ ID NO: 104473 - DNA, 477 bp, Artificial Sequence; identical to SEQ ID NO: 104469
  Description of Artificial Sequence: Synthetic coding sequence

SEQ ID NO: 104474 - DNA, 477 bp, Artificial Sequence; identical to SEQ ID NO: 104469
  Description of Artificial Sequence: Synthetic coding sequence

SEQ ID NO: 104475 - DNA, 465 bp, Artificial Sequence
  Description of Artificial Sequence: Synthetic coding sequence
atggccgccagcagaagactgatgaaggagctggaggagatcagaaagtgcggcatgaagaacttcagaaacatccaggtggacgaggccaacctgctgacctggcagggcctgatcgtgcccgacaaccccccctacgacaagggcgccttcagaatcgagatcaacttccccgccgagtaccccttcaagccccccaagatcaccttcaagaccaagatctaccaccccaacatcgacgagaagggccaggtgtgcctgcccgtgatcagcgccgagaactggaagcccgccaccaagaccgaccaggtgatccagagcctgatcgccctggtgaacgacccccagcccgagcaccccctgagagccgacctggccgaggagtacagcaaggacagaaagaagttctgcaagaacgccgaggagttcaccaagaagtacggcgagaagagacccgtggactag

SEQ ID NO: 104476 - DNA, 639 bp, Artificial Sequence
  Description of Artificial Sequence: Synthetic coding sequence
atgcaggtggccgccggcaccagaggcgacaccagactgcaggaggtggccctgctgccccagctgttcgacctgctggtgctgggccagagaagagccagactgctgagacaggtgcccagcgccctggccggcaaggacctggcccagctgcaggccggcgccaccctggccggctacagaagagcccacggccccgaggagctggaggagatcagaaagtgcggcatgaagaacttcagaaacatccaggtggacgaggccaacctgctgacctggcagggcctgatcgtgcccgacaaccccccctacgacaagggcgccttcagaatcgagatcaacttccccgccgagtaccccttcaagccccccaagatcaccttcaagaccaagatctaccaccccaacatcgacgagaagggccaggtgtgcctgcccgtgatcagcgccgagaactggaagcccgccaccaagaccgaccaggtgatccagagcctgatcgccctggtgaacgacccccagcccgagcaccccctgagagccgacctggccgaggagtacagcaaggacagaaagaagttctgcaagaacgccgaggagttcaccaagaagtacggcgagaagagacccgtggactag

SEQ ID NO: 104477 - DNA, 369 bp, Artificial Sequence
  Description of Artificial Sequence: Synthetic coding sequence
atggccgccagcagaagactgatgaaggacaaccccccctacgacaagggcgccttcagaatcgagatcaacttccccgccgagtaccccttcaagccccccaagatcaccttcaagaccaagatctaccaccccaacatcgacgagaagggccaggtgtgcctgcccgtgatcagcgccgagaactggaagcccgccaccaagaccgaccaggtgatccagagcctgatcgccctggtgaacgacccccagcccgagcaccccctgagagccgacctggccgaggagtacagcaaggacagaaagaagttctgcaagaacgccgaggagttcaccaagaagtacggcgagaagagacccgtggactag

SEQ ID NO: 104478 - DNA, 462 bp, Artificial Sequence
  Description of Artificial Sequence: Synthetic coding sequence
atgatggccagcatgagagtggtgaaggagctggaggacctgcagaagaagccccccccctacctgagaaacctgagcagcgacgacgccaacgtgctggtgtggcacgccctgctgctgcccgaccagcccccctaccacctgaaggccttcaacctgagaatcagcttcccccccgagtaccccttcaagccccccatgatcaagttcaccaccaagatctaccaccccaacgtggacgagaacggccagatctgcctgcccatcatcagcagcgagaactggaagccctgcaccaagacctgccaggtgctggaggccctgaacgtgctggtgaacagacccaacatcagagagcccctgagaatggacctggccgacctgctgacccagaaccccgagctgttcagaaagaacgccgaggagttcaccctgagattcggcgtggacagacccagctag

SEQ ID NO: 104479 - DNA, 264 bp, Artificial Sequence
  Description of Artificial Sequence: Synthetic coding sequence
atgatcaagttcaccaccaagatctaccaccccaacgtggacgagaacggccagatctgcctgcccatcatcagcagcgagaactggaagccctgcaccaagacctgccaggtgctggaggccctgaacgtgctggtgaacagacccaacatcagagagcccctgagaatggacctggccgacctgctgacccagaaccccgagctgttcagaaagaacgccgaggagttcaccctgagattcggcgtggacagacccagctag

SEQ ID NO: 104480 - DNA, 198 bp, Artificial Sequence
  Description of Artificial Sequence: Synthetic coding sequence
atgatcaagttcaccaccaagatctaccaccccaacgtggacgagaacggccagatctgcctgcccatcatcagcagcgagaactggaagccctgcaccaagacctgccaggtgctggaggccctgaacgtgctggtgaacagacccaacatcagagagcccctgagaatggacctggccgacctgctgacccagtag

SEQ ID NO: 104481 - DNA, 1128 bp, Artificial Sequence
  Description of Artificial Sequence: Synthetic coding sequence
atgagcgtgagcggcctgaaggccgagctgaagttcctggccagcatcttcgacaagaaccacgagagattcagaatcgtgagctggaagctggacgagctgcactgccagttcctggtgccccagcagggcagcccccacagcctgcccccccccctgaccctgcactgcaacatcaccgagagctaccccagcagcagccccatctggttcgtggacagcgaggaccccaacctgaccagcgtgctggagagactggaggacaccaagaacaacaacctgctgagacagcagctgaagtggctgatctgcgagctgtgcagcctgtacaacctgcccaagcacctggacgtggagatgctggaccagcccctgcccaccggccagaacggcaccaccgaggaggtgaccagcgaggaggaggaggaggaggaggagatggccgaggacatcgaggacctggaccactacgagatgaaggaggaggagcccatcagcggcaagaagagcgaggacgagggcatcgagaaggagaacctggccatcctggagaagatcagaaagacccagagacaggaccacctgaacggcgccgtgagcggcagcgtgcaggccagcgacagactgatgaaggagctgagagacatctacagaagccagagctacaagaccggcatctacagcgtggagctgatcaacgacagcctgtacgactggcacgtgaagctgcagaaggtggaccccgacagccccctgcacagcgacctgcagatcctgaaggagaaggagggcatcgagtacatcctgctgaacttcagcttcaaggacaacttccccttcgacccccccttcgtgagagtggtgctgcccgtgctgagcggcggctacgtgctgggcggcggcgccctgtgcatggagctgctgaccaagcagggctggagcagcgcctacagcatcgagagcgtgatcatgcagatcaacgccaccctggtgaagggcaaggccagagtgcagttcggcgccaacaagaaccagtacaacctggccagagcccagcagagctacaacagcatcgtgcagatccacgagaagaacggctggtacaccccccccaaggaggacggctag

SEQ ID NO: 104482 - DNA, 945 bp, Artificial Sequence
  Description of Artificial Sequence: Synthetic coding sequence
atgagcgtgagcggcctgaaggccgagctgaagttcctggccagcatcttcgacaagaaccacgagagattcagaatcgtgagctggaagctggacgagctgcactgccagttcctggtgccccagcagggcagcccccacagcctgcccccccccctgaccctgcactgcaacatcaccgagagctaccccagcagcagccccatctggttcgtggacagcgaggaccccaacctgaccagcgtgctggagagactggaggacaccaagaacaacaacctgctgagacagcagctgaagtggctgatctgcgagctgtgcagcctgtacaacctgcccaagcacctggacgtggagatgctggaccagcccctgcccaccggccagaacggcaccaccgaggaggtgaccagcgaggaggaggaggaggaggaggagatggccgaggacatcgaggacctggaccactacgagatgaaggaggaggagcccatcagcggcaagaagagcgaggacgagggcatcgagaaggagaacctggccatcctggagaagatcagaaagacccagagacaggaccacctgaacggcgccgtgagcggcagcgtgcaggccagcgacagactgatgaaggagctgagagacatctacagaagccagagctacaagaccggcatctacagcgtggagctgatcaacgacagcctgtacgactggcacgtgaagctgcagaaggtggaccccgacagccccctgcacagcgacctgcagatcctgaaggagaaggagggcatcgagtacatcctgctgaacttcagcttcaaggacaacttccccttcgacccccccttcgtgagagtggtgctgcccgtgctgagcggcggcctggtgcaccccagcaagggcagatggctgaacgtgctgaccgtggtgtgcctggactag

SEQ ID NO: 104483 - DNA, 1080 bp, Artificial Sequence
  Description of Artificial Sequence: Synthetic coding sequence
atgagaatggacagcctgaccgaggagaagctggagtgcagactgtggtgctgcctgagcgaccccagcccccccggcctggccgccagatgctgcgtgctggagagaagcatcgtgcccagcctgagacaggagagctaccccagcagcagccccatctggttcgtggacagcgaggaccccaacctgaccagcgtgctggagagactggaggacaccaagaacaacaacctgctgagacagcagctgaagtggctgatctgcgagctgtgcagcctgtacaacctgcccaagcacctggacgtggagatgctggaccagcccctgcccaccggccagaacggcaccaccgaggaggtgaccagcgaggaggaggaggaggaggaggagatggccgaggacatcgaggacctggaccactacgagatgaaggaggaggagcccatcagcggcaagaagagcgaggacgagggcatcgagaaggagaacctggccatcctggagaagatcagaaagacccagagacaggaccacctgaacggcgccgtgagcggcagcgtgcaggccagcgacagactgatgaaggagctgagagacatctacagaagccagagctacaagaccggcatctacagcgtggagctgatcaacgacagcctgtacgactggcacgtgaagctgcagaaggtggaccccgacagccccctgcacagcgacctgcagatcctgaaggagaaggagggcatcgagtacatcctgctgaacttcagcttcaaggacaacttccccttcgacccccccttcgtgagagtggtgctgcccgtgctgagcggcggctacgtgctgggcggcggcgccctgtgcatggagctgctgaccaagcagggctggagcagcgcctacagcatcgagagcgtgatcatgcagatcaacgccaccctggtgaagggcaaggccagagtgcagttcggcgccaacaagaaccagtacaacctggccagagcccagcagagctacaacagcatcgtgcagatccacgagaagaacggctggtacaccccccccaaggaggacggctag

SEQ ID NO: 104484 - DNA, 1080 bp, Artificial Sequence; identical to SEQ ID NO: 104483
  Description of Artificial Sequence: Synthetic coding sequence

SEQ ID NO: 104485 - DNA, 717 bp, Artificial Sequence
  Description of Artificial Sequence: Synthetic coding sequence
atggcccagcagcagatgaccagcagccagaaggccctgatgctggagctgaagagcctgcaggaggagcccgtggagggcttcagaatcaccctggtggacgagagcgacctgtacaactgggaggtggccatcttcggcccccccaacaccctgtacgagggcggctacttcaaggcccacatcaagttccccatcgactacccctacagcccccccaccttcagattcctgaccaagatgtggcaccccaacatctacgagaacggcgacgtgtgcatcagcatcctgcacccccccgtggacgacccccagagcggcgagctgcccagcgagagatggaaccccacccagaacgtgagaaccatcctgctgagcgtgatcagcctgctgaacgagcccaacaccttcagccccgccaacgtggacgccagcgtgatgttcagaaagtggagagacagcaagggcaaggacaaggagtacgccgagatcatcagaaagcaggtgagcgccaccaaggccgaggccgagaaggacggcgtgaaggtgcccaccaccctggccgagtactgcatcaagaccaaggtgcccagcaacgacaacagcagcgacctgctgtacgacgacctgtacgacgacgacatcgacgacgaggacgaggaggaggaggacgccgactgctacgacgacgacgacagcggcaacgaggagagctag

SEQ ID NO: 104486 - DNA, 669 bp, Artificial Sequence
  Description of Artificial Sequence: Synthetic coding sequence
atgaacagcaacgtggagaacctgcccccccacatcatcagactggtgtacaaggaggtgaccaccctgaccgccgacccccccgacggcatcaaggtgttccccaacgaggaggacctgaccgacctgcaggtgaccatcgagggccccgagggcaccccctacgccggcggcctgttcagaatgaagctgctgctgggcaaggacttccccgccagcccccccaagggctacttcctgaccaagatcttccaccccaacgtgggcgccaacggcgagatctgcgtgaacgtgctgaagagagactggaccgccgagctgggcatcagacacgtgctgctgaccatcaagtgcctgctgatccaccccaaccccgagagcgccctgaacgaggaggccggcagactgctgctggagaactacgaggagtacgccgccagagccagactgctgaccgagatccacggcggcgccggcggccccagcggcagagccgaggccggcagagccctggccagcggcaccgaggccagcagcaccgaccccggcgcccccggcggccccggcggcgccgagggccccatggccaagaagcacgccggcgagagagacaagaagctggccgccaagaagaagaccgacaagaagagagccctgagaagactgtag

SEQ ID NO: 104487 - DNA, 594 bp, Artificial Sequence
  Description of Artificial Sequence: Synthetic coding sequence
atgcagagagccagcagactgaagagagagctgcacatgctggccaccgagcccccccccggcatcacctgctggcaggacaaggaccagatggacgacctgagagcccagatcctgggcggcgccaacaccccctacgagaagggcgtgttcaagctggaggtgatcatccccgagagataccccttcgagcccccccagatcagattcctgacccccatctaccaccccaacatcgacagcgccggcagaatctgcctggacgtgctgaagctgccccccaagggcgcctggagacccagcctgaacatcgccaccgtgctgaccagcatccagctgctgatgagcgagcccaaccccgacgaccccctgatggccgacatcagcagcgagttcaagtacaacaagcccgccttcctgaagaacgccagacagtggaccgagaagcacgccagacagaagcagaaggccgacgaggaggagatgctggacaacctgcccgaggccggcgacagcagagtgcacaacagcacccagaagagaaaggccagccagctggtgggcatcgagaagaagttccaccccgacgtgtag

SEQ ID NO: 104488 - DNA, 489 bp, Artificial Sequence
  Description of Artificial Sequence: Synthetic coding sequence
atggccagcatgcagaccaccggcagaagagtggaggtgtggttccccaagagactgcagaaggagctgctggccctgcagaacgaccccccccccggcatgaccctgaacgagaagagcgtgcagaacagcatcacccagtggatcgtggacatggagggcgcccccggcaccctgtacgagggcgagaagttccagctgctgttcaagttcagcagcagataccccttcgacagcccccaggtgatgttcaccggcgagaacatccccgtgcacccccacgtgtacagcaacggccacatctgcctgagcatcctgaccgaggactggagccccgccctgagcgtgcagagcgtgtgcctgagcatcatcagcatgctgagcagctgcaaggagaagagaagaccccccgacaacagcttctacgtgagaacctgcaacaagaaccccaagaagaccaagtggtggtaccacgacgacacctgctag

SEQ ID NO: 104489 - DNA, 480 bp, Artificial Sequence
  Description of Artificial Sequence: Synthetic coding sequence
atggccagcatgcagaagagactgcagaaggagctgctggccctgcagaacgaccccccccccggcatgaccctgaacgagaagagcgtgcagaacagcatcacccagtggatcgtggacatggagggcgcccccggcaccctgtacgagggcgagaagttccagctgctgttcaagttcagcagcagataccccttcgacagcccccaggtgatgttcaccggcgagaacatccccgtgcacccccacgtgtacagcaacggccacatctgcctgagcatcctgaccgaggactggagccccgccctgagcgtgcagagcgtgtgcctgagcatcatcagcatgctgagcagctgcaaggagaagagaagaccccccgacaacagcttctacgtgagaacctgcaacaagaaccccaagaagaccaagtggtggtaccacgagctgaagagcgccttcatcctgagcatcaccgactag

SEQ ID NO: 104490 - DNA, 456 bp, Artificial Sequence
  Description of Artificial Sequence: Synthetic coding sequence
atggccagcatgcagaagagactgcagaaggagctgctggccctgcagaacgaccccccccccggcatgaccctgaacgagaagagcgtgcagaacagcatcacccagtggatcgtggacatggagggcgcccccggcaccctgtacgagggcgagaagttccagctgctgttcaagttcagcagcagataccccttcgacagcccccaggtgatgttcaccggcgagaacatccccgtgcacccccacgtgtacagcaacggccacatctgcctgagcatcctgaccgaggactggagccccgccctgagcgtgcagagcgtgtgcctgagcatcatcagcatgctgagcagctgcaaggagaagagaagaccccccgacaacagcttctacgtgagaacctgcaacaagaaccccaagaagaccaagtggtggtaccacgacgacacctgctag

SEQ ID NO: 104491 - DNA, 354 bp, Artificial Sequence
  Description of Artificial Sequence: Synthetic coding sequence
atgagcagcaacgtgcccgccgacatgatcaacctgagactgatcctggtgagcggcaagaccaaggagttcctgttcagccccaacgacagcgccagcgacatcgccaagcacgtgtacgacaactggcccatggactgggaggaggagcaggtgagcagccccaacatcctgagactgatctaccagggcagattcctgcacggcaacgtgaccctgggcgccctgaagctgcccttcggcaagaccaccgtgatgcacctggtggccagagagaccctgcccgagcccaacagccagggccagagaaacagagagaagaccggcgagagcaactgctgcgtgatcctgtag

SEQ ID NO: 104492 - DNA, 474 bp, Artificial Sequence
  Description of Artificial Sequence: Synthetic coding sequence
atgcagctgaccgtgaaggccctgcagggcagagagtgcagcctgcaggtgcccgaggacgagctggtgagcaccctgaagcagctggtgagcgagaagctgaacgtgcccgtgagacagcagagactgctgttcaagggcaaggccctggccgacggcaagagactgagcgactacagcatcggccccaacagcaagctgaacctggtggtgaagcccctggagaaggtgctgctggaggagggcgaggcccagagactggccgacagcccccccccccaggtgtggcagctgatcagcaaggtgctggccagacacttcagcgccgccgacgccagcagagtgctggagcagctgcagagagactacgagagaagcctgagcagactgaccctggacgacatcgagagactggccagcagattcctgcaccccgaggtgaccgagaccatggagaagggcttcagcaagtag

SEQ ID NO: 104493 - DNA, 525 bp, Artificial Sequence
  Description of Artificial Sequence: Synthetic coding sequence
atgttcctgaccgtgaagctgctgctgggccagagatgcagcctgaaggtgagcggccaggagagcgtggccaccctgaagagactggtgagcagaagactgaaggtgcccgaggagcagcagcacctgctgttcagaggccagctgctggaggacgacaagcacctgagcgactactgcatcggccccaacgccagcatcaacgtgatcatgcagcccctggagaagatggccctgaaggaggcccaccagccccagacccagcccctgtggcaccagctgggcctggtgctggccaagcacttcgagccccaggacgccaaggccgtgctgcagctgctgagacaggagcacgaggagagactgcagaagatcagcctggagcacctggagcagctggcccagtacctgctggccgaggagccccacgtggagcccgccggcgagagagagctggaggccaaggccagaccccagagcagctgcgacatggaggagaaggaggaggccgccgccgaccagtag

SEQ ID NO: 104494 - DNA, 222 bp, Artificial Sequence
  Description of Artificial Sequence: Synthetic coding sequence
atgatcgaggtggtgtgcaacgacagactgggcaagaaggtgagagtgaagtgcaacaccgacgacaccatcggcgacctgaagaagctgatcgccgcccagaccggcaccagatggaacaagatcgtgctgaagaagtggtacaccatcttcaaggaccacgtgagcctgggcgactacgagatccacgacggcatgaacctggagctgtactaccagtag

SEQ ID NO: 104495 - DNA, 222 bp, Artificial Sequence; identical to SEQ ID NO: 104494
  Description of Artificial Sequence: Synthetic coding sequence

SEQ ID NO: 104496 - DNA, 1143 bp, Artificial Sequence
  Description of Artificial Sequence: Synthetic coding sequence
atgagcctgagcgactggcacctggccgtgaagctggccgaccagcccctgacccccaagagcatcctgagactgcccgagaccgagctgggcgagtacagcctgggcggctacagcatcagcttcctgaagcagctgatcgccggcaagctgcaggagagcgtgcccgaccccgagctgatcgacctgatctactgcggcagaaagctgaaggacgaccagaccctggacttctacggcatccagcccggcagcaccgtgcacgtgctgagaaagagctggcccgagcccgaccagaagcccgagcccgtggacaaggtggccgccatgagagagttcagagtgctgcacaccgccctgcacagcagcagcagctacagagaggccgtgttcaagatgctgagcaacaaggagagcctggaccagatcatcgtggccacccccggcctgagcagcgaccccatcgccctgggcgtgctgcaggacaaggacctgttcagcgtgttcgccgaccccaacatgctggacaccctggtgcccgcccaccccgccctggtgaacgccatcgtgctggtgctgcacagcgtggccggcagcgcccccatgcccggcaccgacagcagcagcagaagcatgcccagcagcagctacagagacatgcccggcggcttcctgttcgagggcctgagcgacgacgaggacgacttccaccccaacaccagaagcacccccagcagcagcacccccagcagcagacccgccagcctgggctacagcggcgccgccggccccagacccatcacccagagcgagctggccaccgccctggccctggccagcacccccgagagcagcagccacacccccacccccggcacccagggccacagcagcggcaccagccccatgagcagcggcgtgcagagcggcacccccatcaccaacgacctgttcagccaggccctgcagcacgccctgcaggccagcggccagcccagcctgcagagccagtggcagccccagctgcagcagctgagagacatgggcatccaggacgacgagctgagcctgagagccctgcaggccaccggcggcgacatccaggccgccctggagctgatcttcgccggcggcgccccctag

SEQ ID NO: 104497 - DNA, 1143 bp, Artificial Sequence; identical to SEQ ID NO: 104496
  Description of Artificial Sequence: Synthetic coding sequence

SEQ ID NO: 104498 - DNA, 957 bp, Artificial Sequence
  Description of Artificial Sequence: Synthetic coding sequence
atggccctgcccatcatcgtgaagtggggcggccaggagtacagcgtgaccaccctgagcgaggacgacaccgtgctggacctgaagcagttcctgaagaccctgaccggcgtgctgcccgagagacagaagctgctgggcctgaaggtgaagggcaagcccgccgagaacgacgtgaagctgggcgccctgaagctgaagcccaacaccaagatcatgatgatgggcaccagagaggagagcctggaggacgtgctgggccccccccccgacaacgacgacgtggtgaacgacttcgacatcgaggacgaggtggtggaggtggagaacagagaggagaacctgctgaagatcagcagaagagtgaaggagtacaaggtggagatcctgaacccccccagagagggcaagaagctgctggtgctggacgtggactacaccctgttcgaccacagaagctgcgccgagaccggcgtggagctgatgagaccctacctgcacgagttcctgaccagcgcctacgaggactacgacatcgtgatctggagcgccaccaacatgaagtggatcgaggccaagatgaaggagctgggcgtgagcaccaacgccaactacaagatcaccttcatgctggacagcgccgccatgatcaccgtgcacacccccagaagaggcctgatcgacgtgaagcccctgggcgtgatctggggcaagttcagcgagttctacagcaagaagaacaccatcatgttcgacgacatcggcagaaacttcctgatgaacccccagaacggcctgaagatcagacccttcatgaaggcccacctgaacagagacaaggacaaggagctgctgaagctgacccagtacctgaaggagatcgccaagctggacgacttcctggacctgaaccacaagtactgggagagatacctgagcaagaagcagggccagtag

SEQ ID NO: 104499 - DNA, 1923 bp, Artificial Sequence
  Description of Artificial Sequence: Synthetic coding sequence
atggccctgagcagaggcctgcccagagagctggccgaggccgtggccggcggcagagtgctggtggtgggcgccggcggcatcggctgcgagctgctgaagaacctggtgctgaccggcttcagccacatcgacctgatcgacctggacaccatcgacgtgagcaacctgaacagacagttcctgttccagaagaagcacgtgggcagaagcaaggcccaggtggccaaggagagcgtgctgcagttctaccccaaggccaacatcgtggcctaccacgacagcatcatgaaccccgactacaacgtggagttcttcagacagttcatcctggtgatgaacgccctggacaacagagccgccagaaaccacgtgaacagaatgtgcctggccgccgacgtgcccctgatcgagagcggcaccgccggctacctgggccaggtgaccaccatcaagaagggcgtgaccgagtgctacgagtgccaccccaagcccacccagagaaccttccccggctgcaccatcagaaacacccccagcgagcccatccactgcatcgtgtgggccaagtacctgttcaaccagctgttcggcgaggaggacgccgaccaggaggtgagccccgacagagccgaccccgaggccgcctgggagcccaccgaggccgaggccagagccagagccagcaacgaggacggcgacatcaagagaatcagcaccaaggagtgggccaagagcaccggctacgaccccgtgaagctgttcaccaagctgttcaaggacgacatcagatacctgctgaccatggacaagctgtggagaaagagaaagccccccgtgcccctggactgggccgaggtgcagagccagggcgaggagaccaacgccagcgaccagcagaacgagccccagctgggcctgaaggaccagcaggtgctggacgtgaagagctacgccagactgttcagcaagagcatcgagaccctgagagtgcacctggccgagaagggcgacggcgccgagctgatctgggacaaggacgaccccagcgccatggacttcgtgaccagcgccgccaacctgagaatgcacatcttcagcatgaacatgaagagcagattcgacatcaagagcatggccggcaacatcatccccgccatcgccaccaccaacgccgtgatcgccggcctgatcgtgctggagggcctgaagatcctgagcggcaagatcgaccagtgcagaaccatcttcctgaacaagcagcccaaccccagaaagaagctgctggtgccctgcgccctggacccccccaaccccaactgctacgtgtgcgccagcaagcccgaggtgaccgtgagactgaacgtgcacaaggtgaccgtgctgaccctgcaggacaagatcgtgaaggagaagttcgccatggtggcccccgacgtgcagatcgaggacggcaagggcaccatcctgatcagcagcgaggagggcgagaccgaggccaacaaccacaagaagctgagcgagttcggcatcagaaacggcagcagactgcaggccgacgacttcctgcaggactacaccctgctgatcaacatcctgcacagcgaggacctgggcaaggacgtggagttcgaggtggtgggcgacgcccccgagaaggtgggccccaagcaggccgaggacgccgccaagagcatcaccaacggcagcgacgacggcgcccagcccagcaccagcaccgcccaggagcaggacgacgtgctgatcgtggacagcgacgaggaggacagcagcaacaacgccgacgtgagcgaggaggagagaagcagaaagagaaagctggacgagaaggagaacctgagcgccaagagaagcagaatcgagcagaaggaggagctggacgacgtgatcgccctggactag

SEQ ID NO: 104500 - DNA, 1635 bp, Artificial Sequence
  Description of Artificial Sequence: Synthetic coding sequence
atgaaccccgactacaacgtggagttcttcagacagttcatcctggtgatgaacgccctggacaacagagccgccagaaaccacgtgaacagaatgtgcctggccgccgacgtgcccctgatcgagagcggcaccgccggctacctgggccaggtgaccaccatcaagaagggcgtgaccgagtgctacgagtgccaccccaagcccacccagagaaccttccccggctgcaccatcagaaacacccccagcgagcccatccactgcatcgtgtgggccaagtacctgttcaaccagctgttcggcgaggaggacgccgaccaggaggtgagccccgacagagccgaccccgaggccgcctgggagcccaccgaggccgaggccagagccagagccagcaacgaggacggcgacatcaagagaatcagcaccaaggagtgggccaagagcaccggctacgaccccgtgaagctgttcaccaagctgttcaaggacgacatcagatacctgctgaccatggacaagctgtggagaaagagaaagccccccgtgcccctggactgggccgaggtgcagagccagggcgaggagaccaacgccagcgaccagcagaacgagccccagctgggcctgaaggaccagcaggtgctggacgtgaagagctacgccagactgttcagcaagagcatcgagaccctgagagtgcacctggccgagaagggcgacggcgccgagctgatctgggacaaggacgaccccagcgccatggacttcgtgaccagcgccgccaacctgagaatgcacatcttcagcatgaacatgaagagcagattcgacatcaagagcatggccggcaacatcatccccgccatcgccaccaccaacgccgtgatcgccggcctgatcgtgctggagggcctgaagatcctgagcggcaagatcgaccagtgcagaaccatcttcctgaacaagcagcccaaccccagaaagaagctgctggtgccctgcgccctggacccccccaaccccaactgctacgtgtgcgccagcaagcccgaggtgaccgtgagactgaacgtgcacaaggtgaccgtgctgaccctgcaggacaagatcgtgaaggagaagttcgccatggtggcccccgacgtgcagatcgaggacggcaagggcaccatcctgatcagcagcgaggagggcgagaccgaggccaacaaccacaagaagctgagcgagttcggcatcagaaacggcagcagactgcaggccgacgacttcctgcaggactacaccctgctgatcaacatcctgcacagcgaggacctgggcaaggacgtggagttcgaggtggtgggcgacgcccccgagaaggtgggccccaagcaggccgaggacgccgccaagagcatcaccaacggcagcgacgacggcgcccagcccagcaccagcaccgcccaggagcaggacgacgtgctgatcgtggacagcgacgaggaggacagcagcaacaacgccgacgtgagcgaggaggagagaagcagaaagagaaagctggacgagaaggagaacctgagcgccaagagaagcagaatcgagcagaaggaggagctggacgacgtgatcgccctggactag

SEQ ID NO: 104501 - DNA, 879 bp, Artificial Sequence
  Description of Artificial Sequence: Synthetic coding sequence
atgtgcctggccgccgacgtgcccctgatcgagagcggcaccgccggctacctgggccaggtgaccaccatcaagaagggcgtgaccgagtgctacgagtgccaccccaagcccacccagagaaccttccccggctgcaccatcagaaacacccccagcgagcccatccactgcatcgtgtgggccaagtacctgttcaaccagctgttcggcgaggaggacgccgaccaggaggtgagccccgacagagccgaccccgaggccgcctgggagcccaccgaggccgaggccagagccagagccagcaacgaggacggcgacatcaagagaatcagcaccaaggagtgggccaagagcaccggctacgaccccgtgaagctgttcaccaagctgttcaaggacgacatcagatacctgctgaccatggacaagctgtggagaaagagaaagccccccgtgcccctggactgggccgaggtgcagagccagggcgaggagaccaacgccagcgaccagcagaacgagccccagctgggcctgaaggaccagcaggtgctggacgtgaagagctacgccagactgttcagcaagagcatcgagaccctgagagtgcacctggccgagaagggcgacggcgccgagctgatctgggacaaggacgaccccagcgccatggacttcgtgaccagcgccgccaacctgagaatgcacatcttcagcatgaacatgaagagcagattcgacatcaagagcatggccggcaacatcatccccgccatcgccaccaccaacgccgtgatcgccggcctgatcgtgctggagggcctgaagatcctgagcggcaagatcgaccagtgcagaaccgacttcttcgagtag

SEQ ID NO: 104502 - DNA, 1047 bp, Artificial Sequence
  Description of Artificial Sequence: Synthetic coding sequence
atggccctgaagagaatgggcatcgtgagcgactacgagaagatcagaaccttcgccgtggccatcgtgggcgtgggcggcgtgggcagcgtgaccgccgagatgctgaccagatgcggcatcggcaagctgctgctgttcgactacgacaaggtggagctggccaacatgaacagactgttcttccagccccaccaggccggcctgagcaaggtgcaggccgccgagcacaccctgagaaacatcaaccccgacgtgctgttcgaggtgcacaactacaacatcaccaccgtggagaacttccagcacttcatggacagaatcagcaacggcggcctggaggagggcaagcccgtggacctggtgctgagctgcgtggacaacttcgaggccagaatgaccatcaacaccgcctgcaacgagctgggccagacctggatggagagcggcgtgagcgagaacgccgtgagcggccacatccagctgatcatccccggcgagagcgcctgcttcgcctgcgccccccccctggtggtggccgccaacatcgacgagaagaccctgaagagagagggcgtgtgcgccgccagcctgcccaccaccatgggcgtggtggccggcatcctggtgcagaacgtgctgaagttcctgctgaacttcggcaccgtgagcttctacctgggctacaacgccatgcaggacttcttccccaccatgagcatgaagcccaacccccagtgcgacgacagaaactgcagaaagcagcaggaggagtacaagaagaaggtggccgccctgcccaagcaggaggtgatccaggaggaggaggagatcatccacgaggacaacgagtggggcatcgagctggtgagcgaggtgagcgaggaggagctgaagaacttcagcggccccgtgcccgacctgcccgagggcatcaccgtggcctacaccatccccaagaagcaggaggacagcgtgaccgagctgaccgtggaggacagcggcgagagcctggaggacctgatggccaagatgaagaacatgtag

SEQ ID NO: 104503 - DNA, 1215 bp, Artificial Sequence
  Description of Artificial Sequence: Synthetic coding sequence
atggccgagagcgtggagagactgcagcagagagtgcaggagctggagagagagctggcccaggagagaagcctgcaggtgcccagaagcggcgacggcggcggcggcagagtgagaatcgagaagatgagcagcgaggtggtggacagcaacccctacagcagactgatggccctgaagagaatgggcatcgtgagcgactacgagaagatcagaaccttcgccgtggccatcgtgggcgtgggcggcgtgggcagcgtgaccgccgagatgctgaccagatgcggcatcggcaagctgctgctgttcgactacgacaaggtggagctggccaacatgaacagactgttcttccagccccaccaggccggcctgagcaaggtgcaggccgccgagcacaccctgagaaacatcaaccccgacgtgctgttcgaggtgcacaactacaacatcaccaccgtggagaacttccagcacttcatggacagaatcagcaacggcggcctggaggagggcaagcccgtggacctggtgctgagctgcgtggacaacttcgaggccagaatgaccatcaacaccgcctgcaacgagctgggccagacctggatggagagcggcgtgagcgagaacgccgtgagcggccacatccagctgatcatccccggcgagagcgcctgcttcgcctgcgccccccccctggtggtggccgccaacatcgacgagaagaccctgaagagagagggcgtgtgcgccgccagcctgcccaccaccatgggcgtggtggccggcatcctggtgcagaacgtgctgaagttcctgctgaacttcggcaccgtgagcttctacctgggctacaacgccatgcaggacttcttccccaccatgagcatgaagcccaacccccagtgcgacgacagaaactgcagaaagcagcaggaggagtacaagaagaaggtggccgccctgcccaagcaggaggtgatccaggaggaggaggagatcatccacgaggacaacgagtggggcatcgagctggtgagcgaggtgagcgaggaggagctgaagaacttcagcggccccgtgcccgacctgcccgagggcatcaccgtggcctacaccatccccaagaagcaggaggacagcgtgaccgagctgaccgtggaggacagcggcgagagcctggaggacctgatggccaagatgaagaacatgtag

SEQ ID NO: 104504 - DNA, 2379 bp, Artificial Sequence
  Description of Artificial Sequence: Synthetic coding sequence
atgtggatccaggtgagaaccatggacggcagacagacccacaccgtggacagcctgagcagactgaccaaggtggaggagctgagaagaaagatccaggagctgttccacgtggagcccggcctgcagagactgttctacagaggcaagcagatggaggacggccacaccctgttcgactacgaggtgagactgaacgacaccatccagctgctggtgagacagagcctggtgctgccccacagcaccaaggagagagacagcgagctgagcgacaccgacagcggctgctgcctgggccagagcgagagcgacaagagcagcacccacggcgaggccgccgccgagaccgacagcagacccgccgacgaggacatgtgggacgagaccgagctgggcctgtacaaggtgaacgagtacgtggacgccagagacaccaacatgggcgcctggttcgaggcccaggtggtgagagtgaccagaaaggcccccagcagagacgagccctgcagcagcaccagcagacccgccctggaggaggacgtgatctaccacgtgaagtacgacgactaccccgagaacggcgtggtgcagatgaacagcagagacgtgagagccagagccagaaccatcatcaagtggcaggacctggaggtgggccaggtggtgatgctgaactacaaccccgacaaccccaaggagagaggcttctggtacgacgccgagatcagcagaaagagagagaccagaaccgccagagagctgtacgccaacgtggtgctgggcgacgacagcctgaacgactgcagaatcatcttcgtggacgaggtgttcaagatcgagagacccggcgagggcagccccatggtggacaaccccatgagaagaaagagcggccccagctgcaagcactgcaaggacgacgtgaacagactgtgcagagtgtgcgcctgccacctgtgcggcggcagacaggaccccgacaagcagctgatgtgcgacgagtgcgacatggccttccacatctactgcctggacccccccctgagcagcgtgcccagcgaggacgagtggtactgccccgagtgcagaaacgacgccagcgaggtggtgctggccggcgagagactgagagagagcaagaagaaggccaagatggccagcgccaccagcagcagccagagagactggggcaagggcatggcctgcgtgggcagaaccaaggagtgcaccatcgtgcccagcaaccactacggccccatccccggcatccccgtgggcaccatgtggagattcagagtgcaggtgagcgagagcggcgtgcacagaccccacgtggccggcatccacggcagaagcaacgacggcgcctacagcctggtgctggccggcggctacgaggacgacgtggaccacggcaacttcttcacctacaccggcagcggcggcagagacctgagcggcaacaagagaaccgccgagcagagctgcgaccagaagctgaccaacaccaacagagccctggccctgaactgcttcgcccccatcaacgaccaggagggcgccgaggccaaggactggagaagcggcaagcccgtgagagtggtgagaaacgtgaagggcggcaagaacagcaagtacgcccccgccgagggcaacagatacgacggcatctacaaggtggtgaagtactggcccgagaagggcaagagcggcttcctggtgtggagatacctgctgagaagagacgacgacgagcccggcccctggaccaaggagggcaaggacagaatcaagaagctgggcctgaccatgcagtaccccgagggctacctggaggccctggccaacagagagagagagaaggagaacagcaagagagaggaggaggagcagcaggagggcggcttcgccagccccagaaccggcaagggcaagtggaagagaaagagcgccggcggcggccccagcagagccggccccagaagaaccagcaagaagaccaaggtggagccctacagcctgaccgcccagcagagcagcctgatcagagaggacaagagcaacgccaagctgtggaacgaggtgctggccagcctgaaggacagacccgccagcggcagccccttccagctgttcctgagcaaggtggaggagaccttccagtgcatctgctgccaggagctggtgttcagacccatcaccaccgtgtgccagcacaacgtgtgcaaggactgcctggacagaagcttcagagcccaggtgttcagctgccccgcctgcagatacgacctgggcagaagctacgccatgcaggtgaaccagcccctgcagaccgtgctgaaccagctgttccccggctacggcaacggcagatag

SEQ ID NO: 104505 - DNA, 1224 bp, Artificial Sequence
  Description of Artificial Sequence: Synthetic coding sequence
atggccagcgccaccagcagcagccagagagactggggcaagggcatggcctgcgtgggcagaaccaaggagtgcaccatcgtgcccagcaaccactacggccccatccccggcatccccgtgggcaccatgtggagattcagagtgcaggtgagcgagagcggcgtgcacagaccccacgtggccggcatccacggcagaagcaacgacggcgcctacagcctggtgctggccggcggctacgaggacgacgtggaccacggcaacttcttcacctacaccggcagcggcggcagagacctgagcggcaacaagagaaccgccgagcagagctgcgaccagaagctgaccaacaccaacagagccctggccctgaactgcttcgcccccatcaacgaccaggagggcgccgaggccaaggactggagaagcggcaagcccgtgagagtggtgagaaacgtgaagggcggcaagaacagcaagtacgcccccgccgagggcaacagatacgacggcatctacaaggtggtgaagtactggcccgagaagggcaagagcggcttcctggtgtggagatacctgctgagaagagacgacgacgagcccggcccctggaccaaggagggcaaggacagaatcaagaagctgggcctgaccatgcagtaccccgagggctacctggaggccctggccaacagagagagagagaaggagaacagcaagagagaggaggaggagcagcaggagggcggcttcgccagccccagaaccggcaagggcaagtggaagagaaagagcgccggcggcggccccagcagagccggccccagaagaaccagcaagaagaccaaggtggagccctacagcctgaccgcccagcagagcagcctgatcagagaggacaagagcaacgccaagctgtggaacgaggtgctggccagcctgaaggacagacccgccagcggcagccccttccagctgttcctgagcaaggtggaggagaccttccagtgcatctgctgccaggagctggtgttcagacccatcaccaccgtgtgccagcacaacgtgtgcaaggactgcctggacagaagcttcagagcccaggtgttcagctgccccgcctgcagatacgacctgggcagaagctacgccatgcaggtgaaccagcccctgcagaccgtgctgaaccagctgttccccggctacggcaacggcagatag

SEQ ID NO: 104506 - DNA, 2418 bp, Artificial Sequence
  Description of Artificial Sequence: Synthetic coding sequence
atgggcgtgttcgccgtgccccccctgagcgccgacaccatgtggatccaggtgagaaccatggacggcagacagacccacaccgtggacagcctgagcagactgaccaaggtggaggagctgagaagaaagatccaggagctgttccacgtggagcccggcctgcagagactgttctacagaggcaagcagatggaggacggccacaccctgttcgactacgaggtgagactgaacgacaccatccagctgctggtgagacagagcctggtgctgccccacagcaccaaggagagagacagcgagctgagcgacaccgacagcggctgctgcctgggccagagcgagagcgacaagagcagcacccacggcgaggccgccgccgagaccgacagcagacccgccgacgaggacatgtgggacgagaccgagctgggcctgtacaaggtgaacgagtacgtggacgccagagacaccaacatgggcgcctggttcgaggcccaggtggtgagagtgaccagaaaggcccccagcagagacgagccctgcagcagcaccagcagacccgccctggaggaggacgtgatctaccacgtgaagtacgacgactaccccgagaacggcgtggtgcagatgaacagcagagacgtgagagccagagccagaaccatcatcaagtggcaggacctggaggtgggccaggtggtgatgctgaactacaaccccgacaaccccaaggagagaggcttctggtacgacgccgagatcagcagaaagagagagaccagaaccgccagagagctgtacgccaacgtggtgctgggcgacgacagcctgaacgactgcagaatcatcttcgtggacgaggtgttcaagatcgagagacccggcgagggcagccccatggtggacaaccccatgagaagaaagagcggccccagctgcaagcactgcaaggacgacgtgaacagactgtgcagagtgtgcgcctgccacctgtgcggcggcagacaggaccccgacaagcagctgatgtgcgacgagtgcgacatggccttccacatctactgcctggacccccccctgagcagcgtgcccagcgaggacgagtggtactgccccgagtgcagaaacgacgccagcgaggtggtgctggccggcgagagactgagagagagcaagaagaaggccaagatggccagcgccaccagcagcagccagagagactggggcaagggcatggcctgcgtgggcagaaccaaggagtgcaccatcgtgcccagcaaccactacggccccatccccggcatccccgtgggcaccatgtggagattcagagtgcaggtgagcgagagcggcgtgcacagaccccacgtggccggcatccacggcagaagcaacgacggcgcctacagcctggtgctggccggcggctacgaggacgacgtggaccacggcaacttcttcacctacaccggcagcggcggcagagacctgagcggcaacaagagaaccgccgagcagagctgcgaccagaagctgaccaacaccaacagagccctggccctgaactgcttcgcccccatcaacgaccaggagggcgccgaggccaaggactggagaagcggcaagcccgtgagagtggtgagaaacgtgaagggcggcaagaacagcaagtacgcccccgccgagggcaacagatacgacggcatctacaaggtggtgaagtactggcccgagaagggcaagagcggcttcctggtgtggagatacctgctgagaagagacgacgacgagcccggcccctggaccaaggagggcaaggacagaatcaagaagctgggcctgaccatgcagtaccccgagggctacctggaggccctggccaacagagagagagagaaggagaacagcaagagagaggaggaggagcagcaggagggcggcttcgccagccccagaaccggcaagggcaagtggaagagaaagagcgccggcggcggccccagcagagccggccccagaagaaccagcaagaagaccaaggtggagccctacagcctgaccgcccagcagagcagcctgatcagagaggacaagagcaacgccaagctgtggaacgaggtgctggccagcctgaaggacagacccgccagcggcagccccttccagctgttcctgagcaaggtggaggagaccttccagtgcatctgctgccaggagctggtgttcagacccatcaccaccgtgtgccagcacaacgtgtgcaaggactgcctggacagaagcttcagagcccaggtgttcagctgccccgcctgcagatacgacctgggcagaagctacgccatgcaggtgaaccagcccctgcagaccgtgctgaaccagctgttccccggctacggcaacggcagatag

SEQ ID NO: 104507 - DNA, 2379 bp, Artificial Sequence; identical to SEQ ID NO: 104504
  Description of Artificial Sequence: Synthetic coding sequence

SEQ ID NO: 104508 - DNA, 2379 bp, Artificial Sequence; identical to SEQ ID NO: 104504
  Description of Artificial Sequence: Synthetic coding sequence

SEQ ID NO: 104509 - DNA, 3240 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagccggcatgcagtggtgcgacctgagcagcctgcagccccccccccccggcttcaagagattcagccacctgagcctgcccaacagctggaactacagacacctgcccagctgccccaccaacttctgcatcttcgtggagaccggcttccaccacgtgggccaggcctgcctggagctgctgaccagcggcggcctgctggccagcgccagccagagcgccggcatcaccggcgtgagccaccacgccagatag

SEQ ID NO: 104510 - DNA, 4044 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagaggagaacgagaagagaacccagcacaaggaccacagcgacaacgagagcaccagcagcgagaacagcggcagaagaagaaagggccccttcaagaccatcaagttcggcaccaacatcgacctgagcgacaacaagaagtggaagctgcagctgcacgagctgaccaagctgcccgccttcgccagagtggtgagcgccggcaacctgctgacccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgaggactactggggcgtgctgaacgacttctgcgagaagaacaacctgaacttcctgatgagcagctggtggcccaacctggaggacctgtacgaggccaacgtgcccgtgtacagattcatccagagacccggcgacctggtgtggatcaacgccggcaccgtgcactgggtgcaggccgtgggctggtgcaacaacatcgcctggaacgtgggccccctgaccgcctgccagtacaagctggccgtggagagatacgagtggaacaagctgaagagcgtgaagagccccgtgcccatggtgcacctgagctggaacatggccagaaacatcaaggtgagcgaccccaagctgttcgagatgatcaagtactgcctgctgaagatcctgaagcagtaccagaccctgagagaggccctggtggccgccggcaaggaggtgatctggcacggcagaaccaacgacgagcccgcccactactgcagcatctgcgaggtggaggtgttcaacctgctgttcgtgaccaacgagagcaacacccagaagacctacatcgtgcactgccacgactgcgccagaaagaccagcaagagcctggagaacttcgtggtgctggagcagtacaagatggaggacctgatccaggtgtacgaccagttcaccctggccctgagcctgagcagcagcagctag

SEQ ID NO: 104511 - DNA, 3723 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagaggagaacgagaagagaacccagcacaaggaccacagcgacaacgagagcaccagcagcgagaacagcggcagaagaagaaagggccccttcaagaccatcaagttcggcaccaacatcgacctgagcgacaacaagaagtggaagctgcagctgcacgagctgaccaagctgcccgccttcgccagagtggtgagcgccggcaacctgctgacccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgaggactactggggcgtgctgaacgacttctgcgagaagaacaacctgaacttcctgatgagcagctggtggcccaacctggaggacctgtacgaggccaacgtgcccgtgtacagattcatccagagacccggcgacctggtgtggatcaacgccggcaccgtgcactgggtgcaggccgtgggctggtgcaacaacatcgcctggaacgtgggccccctgaccgcctgccagtacaagctggccgtggagagatacgagtggaacaagctgaagagcgtgaagagccccgtgcccatggtgcacctgagctggaacatggccagaaacatcaaggtgagcgaccccaagctgttcgagatgatcaagtag

SEQ ID NO: 104512 - DNA, 624 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagagcaagtacttctag

SEQ ID NO: 104513 - DNA, 4179 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcaggcccagctgtgcaacctgccccagagcagcctgcagaacaagaccaagctgctgcccagcatcgaggaggcctggagcctgcccatccccgccgagctgaccagcagacagggcgccatgaacaccgcccagcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagaggagaacgagaagagaacccagcacaaggaccacagcgacaacgagagcaccagcagcgagaacagcggcagaagaagaaagggccccttcaagaccatcaagttcggcaccaacatcgacctgagcgacaacaagaagtggaagctgcagctgcacgagctgaccaagctgcccgccttcgccagagtggtgagcgccggcaacctgctgacccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgaggactactggggcgtgctgaacgacttctgcgagaagaacaacctgaacttcctgatgagcagctggtggcccaacctggaggacctgtacgaggccaacgtgcccgtgtacagattcatccagagacccggcgacctggtgtggatcaacgccggcaccgtgcactgggtgcaggccgtgggctggtgcaacaacatcgcctggaacgtgggccccctgaccgcctgccagtacaagctggccgtggagagatacgagtggaacaagctgaagagcgtgaagagccccgtgcccatggtgcacctgagctggaacatggccagaaacatcaaggtgagcgaccccaagctgttcgagatgatcaagtactgcctgctgaagatcctgaagcagtaccagaccctgagagaggccctggtggccgccggcaaggaggtgatctggcacggcagaaccaacgacgagcccgcccactactgcagcatctgcgaggtggaggtgttcaacctgctgttcgtgaccaacgagagcaacacccagaagacctacatcgtgcactgccacgactgcgccagaaagaccagcaagagcctggagaacttcgtggtgctggagcagtacaagatggaggacctgatccaggtgtacgaccagttcaccctggccctgagcctgagcagcagcagctag

SEQ ID NO: 104514 - DNA, 3636 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcaggcccagctgtgcaacctgccccagagcagcctgcagaacaagaccaagctgctgcccagcatcgaggaggcctggagcctgcccatccccgccgagctgaccagcagacagggcgccatgaacaccgcccagcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagaggagaacgagaagagaacccagcacaaggaccacagcgacaacgagagcaccagcagcgagaacagcggcagaagaagaaagggccccttcaagaccatcaagttcggcaccaacatcgacctgagcgacaacaagaagtggaagctgcagctgcacgagctgaccaagctgcccgccttcgccagagtggtgagcgccggcaacctgctgacccacgtgggccacaccatcctgggcatgaacaccgtgcagctgtacatgaaggtgcccggcagcagaacccccggccaccaggagaacaacaacttctgcagcgtgaacatcaacatcggccccggcgactgcgagtggttcgtggtgcccgaggactactggggcgtgctgaacgacttctgcgagaagaacaacctgaacttcctgatgagcagctggtggcccaacctggaggacctgtacgaggccaacgtgcccgtgtacagattcatccagagacccggcgacctggtgtggatcaacgccggcaccgtgcactgggtgcaggccgtgggctggtgcaacaacatcgcctggaacgtgggccccctgaccgcctgccagtacaagctggccgtggagagatacgagtggaacaagctgaagagcgtgaagagccccgtgcccatggtgcacctgagctggaacatggccagaaacatcaaggtgagcgaccccaagctgttcgagatgatcaagtactgcctgctgaagatcctgaagcagtaccagaccctgagagaggccctggtggccgccggcaaggaggtgatctggcacggcagaaccaacgacgagcccgcccactactgcagcatctgcgaggccctgagcctgagcagcagcagctag

SEQ ID NO: 104515 - DNA, 3141 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagagccggcatgcagtggtgcgacctgagcagcctgcagccccccccccccggcttcaagagattcagccacctgagcctgcccaacagctggaactacagacacctgcccagctgccccaccaacttctgcatcttcgtggagaccggcttccaccacgtgggccaggcctgcctggagctgctgaccagcggcggcctgctggccagcgccagccagagcgccggcatcaccggcgtgagccaccacgccagatag

SEQ ID NO: 104516 - DNA, 3018 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcagcagagcctgagcctgcacatgatcaccagcagccaggtggagggcctgagcagccccgccaagaagaagagaaccagcagccccaccaagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagaagcctgatcctgagccaccccggctggaacgccatggtgtag

SEQ ID NO: 104517 - DNA, 3213 bp, Artificial Sequence
  Description of Artificial Sequence: Synthetic coding sequence
atgaagagctgcgccgtgagcctgaccaccgccgccgtggccttcggcgacgaggccaagaagatggccgagggcaaggccagcagagagagcgaggaggagagcgtgagcctgaccgtggaggagagagaggccctgggcggcatggacagcagactgttcggcttcgtgagactgcacgaggacggcgccagaaccaagaccctgctgggcaaggccgtgagatgctacgagagcctgatcctgaaggccgagggcaaggtggagagcgacttcttctgccagctgggccacttcaacctgctgctggaggactacagcaaggccctgagcgcctaccagagatactacagcctgcaggccgactactggaagaacgccgccttcctgtacggcctgggcctggtgtacttctactacaacgccttccactgggccatcaaggccttccaggacgtgctgtacgtggaccccagcttctgcagagccaaggagatccacctgagactgggcctgatgttcaaggtgaacaccgactacaagagcagcctgaagcacttccagctggccctgatcgactgcaacccctgcaccctgagcaacgccgagatccagttccacatcgcccacctgtacgagacccagagaaagtaccacagcgccaaggaggcctacgagcagctgctgcagaccgagaacctgcccgcccaggtgaaggccaccgtgctgcagcagctgggctggatgcaccacaacatggacctggtgggcgacaaggccaccaaggagagctacgccatccagtacctgcagaagagcctggaggccgaccccaacagcggccagagctggtacttcctgggcagatgctacagcagcatcggcaaggtgcaggacgccttcatcagctacagacagagcatcgacaagagcgaggccagcgccgacacctggtgcagcatcggcgtgctgtaccagcagcagaaccagcccatggacgccctgcaggcctacatctgcgccgtgcagctggaccacggccacgccgccgcctggatggacctgggcaccctgtacgagagctgcaaccagccccaggacgccatcaagtgctacctgaacgccgccagaagcaagagatgcagcaacaccagcaccctggccgccagaatcaagttcctgcaggcccagctgtgcaacctgccccagagcagcctgcagaacaagaccaagctgctgcccagcatcgaggaggcctggagcctgcccatccccgccgagctgaccagcagacagggcgccatgaacaccgcccagcagcagagcctgagcctgcacatgatcaccagcagccaggtggagggcctgagcagccccgccaagaagaagagaaccagcagccccaccaagaacggcagcgacaactggaacggcggccagagcctgagccaccaccccgtgcagcaggtgtacagcctgtgcctgaccccccagaagctgcagcacctggagcagctgagagccaacagagacaacctgaaccccgcccagaagcaccagctggagcagctggagagccagttcgtgctgatgcagcagatgagacacaaggaggtggcccaggtgagaaccaccggcatccacaacggcgccatcaccgacagcagcctgcccaccaacagcgtgagcaacagacagccccacggcgccctgaccagagtgagcagcgtgagccagcccggcgtgagacccgcctgcgtggagaagctgctgagcagcggcgccttcagcgccggctgcatcccctgcggcaccagcaagatcctgggcagcaccgacaccatcctgctgggcagcaactgcatcgccggcagcgagagcaacggcaacgtgccctacctgcagcagaacacccacaccctgccccacaaccacaccgacctgaacagcagcaccgaggagccctggagaaagcagctgagcaacagcgcccagggcctgcacaagagccagagcagctgcctgagcggccccaacgaggagcagcccctgttcagcaccggcagcgcccagtaccaccaggccaccagcaccggcatcaagaaggccaacgagcacctgaccctgcccagcaacagcgtgccccagggcgacgccgacagccacctgagctgccacaccgccaccagcggcggccagcagggcatcatgttcaccaaggagagcaagcccagcaagaacagaagcctggtgcccgagaccagcagacacaccggcgacaccagcaacggctgcgccgacgtgaagggcctgagcaaccacgtgcaccagctgatcgccgacgccgtgagcagccccaaccacggcgacagccccaacctgctgatcgccgacaacccccagctgagcgccctgctgatcggcaaggccaacggcaacgtgggcaccggcacctgcgacaaggtgaacaacatccaccccgccgtgcacaccaagaccgaccacagcgtggccagcagccccagcagcgccatcagcaccgccacccccagccccaagagcaccgagcagagaagcatcaacagcgtgaccagcctgaacagcccccacagcggcctgcacaccgtgaacggcgagggcctgggcaagagccagagcagcaccaaggtggacctgcccctggccagccacagaagcaccagccagatcctgcccagcatgagcgtgagcatctgccccagcagcaccgaggtgctgaaggcctgcagaaaccccggcaagaacggcctgagcaacagctgcatcctgctggacaagtgccccccccccagaccccccaccagcccctacccccccctgcccaaggacaagctgaacccccccacccccagcatctacctggagaacaagagagacgccttcttcccccccctgcaccagttctgcaccaaccccaagaaccccgtgaccgtgatcagaggcctggccggcgccctgaagctggacctgggcctgttcagcaccaagaccctggtggaggccaacaacgagcacatggtggaggtgagaacccagctgctgcagcccgccgacgagaactgggaccccaccggcaccaagaagatctggagatgcgagagcaacagaagccacaccaccatcgccaagtacgcccagtaccaggccagcagcttccaggagagcctgagatag

SEQ ID NO: 104518 - DNA, 798 bp, Artificial Sequence
  Description of Artificial Sequence: Synthetic coding sequence
atgcccaacatggtgttcatcggcggcatcaactgcaagaagagaaaggacctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104519 - DNA, 1605 bp, Artificial Sequence
  Description of Artificial Sequence: Synthetic coding sequence
atggccaccggcctgcaggtgcccctgccccagctggccaccggcctgctgctgctgctgagcgtgcagccctgggccgagagcggcaaggtgctggtggtgcccaccgacggcagccactggctgagcatgagagaggccctgagagacctgcacgccagaggccaccaggtggtggtgctgaccctggaggtgaacatgtacatcaaggaggagaacttcttcaccctgaccacctacgccatcagctggacccaggacgagttcgacagactgctgctgggccacacccagagcttcttcgagaccgagcacctgctgatgaagttcagcagaagaatggccatcatgaacaacatgagcctgatcatccacagaagctgcgtggagctgctgcacaacgaggccctgatcagacacctgcacgccaccagcttcgacgtggtgctgaccgaccccttccacctgtgcgccgccgtgctggccaagtacctgagcatccccgccgtgttcttcctgagaaacatcccctgcgacctggacttcaagggcacccagtgccccaaccccagcagctacatccccagactgctgaccaccaacagcgaccacatgaccttcctgcagagagtgaagaacatgctgtaccccctggccctgagctacctgtgccacgccgtgagcgccccctacgccagcctggccagcgagctgttccagagagaggtgagcgtggtggacctggtgagccacgccagcgtgtggctgttcagaggcgacttcgtgatggactaccccagacccatcatgcccaacatggtgttcatcggcggcatcaactgcgccaacggcaagcccctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104520 - DNA, 1599 bp, Artificial Sequence
  Description of Artificial Sequence: Synthetic coding sequence
atggcctgcctgctgagaagcttccagagaatcagcgccggcgtgttcttcctggccctgtggggcatggtggtgggcgacaagctgctggtggtgccccaggacggcagccactggctgagcatgaaggacatcgtggaggtgctgagcgacagaggccacgagatcgtggtggtggtgcccgaggtgaacctgctgctgaaggagagcaagtactacaccagaaagatctaccccgtgccctacgaccaggaggagctgaagaacagataccagagcttcggcaacaaccacttcgccgagagaagcttcctgaccgccccccagaccgagtacagaaacaacatgatcgtgatcggcctgtacttcatcaactgccagagcctgctgcaggacagagacaccctgaacttcttcaaggagagcaagttcgacgccctgttcaccgaccccgccctgccctgcggcgtgatcctggccgagtacctgggcctgcccagcgtgtacctgttcagaggcttcccctgcagcctggagcacaccttcagcagaagccccgaccccgtgagctacatccccagatgctacaccaagttcagcgaccacatgaccttcagccagagagtggccaacttcctggtgaacctgctggagccctacctgttctactgcctgttcagcaagtacgaggagctggccagcgccgtgctgaagagagacgtggacatcatcaccctgtaccagaaggtgagcgtgtggctgctgagatacgacttcgtgctggagtaccccagacccgtgatgcccaacatggtgttcatcggcggcatcaactgcaagaagagaaaggacctgagccaggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104521 - DNA, 570 bp, Artificial Sequence
  Description of Artificial Sequence: Synthetic coding sequence
atggcctgcctgctgagaagcttccagagaatcagcgccggcgtgttcttcctggccctgtggggcatggtggtgggcgacaagctgctggtggtgccccaggacggcagccactggctgagcatgaaggacatcgtggaggtgctgagcgacagaggccacgagatcgtggtggtggtgcccgaggtgaacctgctgctgaaggagagcaagtactacaccagaaagatctaccccgtgccctacgaccaggaggagctgaagaacagataccagagcttcggcaacaaccacttcgccgagagaagcttcctgaccgccccccagaccgagtacagaaacaacatgatcgtgatcggcctgtacttcatcaactgccagagcctgctgcaggacagagacaccctgaacttcttcaaggagagcaagttcgacgccctgttcaccgaccccgccctgccctgcggcgtgatcctggccgagtacctgggcctgcccagcgtgtacctgttcagaggcttcccctgcagcctggagcacaccttcagcagaagccccgaccccgtgtag

SEQ ID NO: 104522 - DNA, 1593 bp, Artificial Sequence
  Description of Artificial Sequence: Synthetic coding sequence
atggccagagccggctggaccggcctgctgcccctgtacgtgtgcctgctgctgacctgcggcttcgccaaggccggcaagctgctggtggtgcccatggacggcagccactggttcaccatgcagagcgtggtggagaagctgatcctgagaggccacgaggtggtggtggtgatgcccgaggtgagctggcagctgggcagaagcctgaactgcaccgtgaagacctacagcaccagctacaccctggaggaccaggacagagagttcatggtgttcgccgacgccagatggaccgcccccctgagaagcgccttcagcctgctgaccagcagcagcaacggcatcttcgacctgttcttcagcaactgcagaagcctgttcaacgacagaaagctggtggagtacctgaaggagagctgcttcgacgccgtgttcctggaccccttcgacgcctgcggcctgatcgtggccaagtacttcagcctgcccagcgtggtgttcgccagaggcatcttctgccactacctggaggagggcgcccagtgccccgcccccctgagctacgtgcccagactgctgctgggcttcagcgacgccatgaccttcaaggagagagtgtggaaccacatcatgcacctggaggagcacctgttctgcccctacttcttcaagaacgtgctggagatcgccagcgagatcctgcagacccccgtgaccgcctacgacctgtacagccacaccagcatctggctgctgagaaccgacttcgtgctggagtaccccaagcccgtgatgcccaacatgatcttcatcggcggcatcaactgccaccagggcaagcccgtgcccatggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104523 - DNA, 1593 bp, Artificial Sequence
  Description of Artificial Sequence: Synthetic coding sequence
atggccagaaccggctggaccagccccatccccctgtgcgtgagcctgctgctgacctgcggcttcgccgaggccggcaagctgctggtggtgcccatggacggcagccactggttcaccatgcagagcgtggtggagaagctgatcctgagaggccacgaggtggtggtggtgatgcccgaggtgagctggcagctgggcaagagcctgaactgcaccgtgaagacctacagcaccagctacaccctggaggacctggacagagagttcatggacttcgccgacgcccagtggaaggcccaggtgagaagcctgttcagcctgttcctgagcagcagcaacggcttcttcaacctgttcttcagccactgcagaagcctgttcaacgacagaaagctggtggagtacctgaaggagagcagcttcgacgccgtgttcctggaccccttcgacgcctgcggcctgatcgtggccaagtacttcagcctgcccagcgtggtgttcgccagaggcatcgcctgccactacctggaggagggcgcccagtgccccgcccccctgagctacgtgcccagaatcctgctgggcttcagcgacgccatgaccttcaaggagagagtgagaaaccacatcatgcacctggaggagcacctgttctgccagtacttcagcaagaacgccctggagatcgccagcgagatcctgcagacccccgtgaccgcctacgacctgtacagccacaccagcatctggctgctgagaaccgacttcgtgctggactaccccaagcccgtgatgcccaacatgatcttcatcggcggcatcaactgccaccagggcaagcccctgcccatggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104524 - DNA, 1593 bp, Artificial Sequence
  Description of Artificial Sequence: Synthetic coding sequence
atggcctgcaccggctggaccagccccctgcccctgtgcgtgtgcctgctgctgacctgcggcttcgccgaggccggcaagctgctggtggtgcccatggacggcagccactggttcaccatgagaagcgtggtggagaagctgatcctgagaggccacgaggtggtggtggtgatgcccgaggtgagctggcagctgggcagaagcctgaactgcaccgtgaagacctacagcaccagctacaccctggaggacctggacagagagttcaaggccttcgcccacgcccagtggaaggcccaggtgagaagcatctacagcctgctgatgggcagctacaacgacatcttcgacctgttcttcagcaactgcagaagcctgttcaaggacaagaagctggtggagtacctgaaggagagcagcttcgacgccgtgttcctggaccccttcgacaactgcggcctgatcgtggccaagtacttcagcctgcccagcgtggtgttcgccagaggcatcctgtgccactacctggaggagggcgcccagtgccccgcccccctgagctacgtgcccagaatcctgctgggcttcagcgacgccatgaccttcaaggagagagtgagaaaccacatcatgcacctggaggagcacctgctgtgccacagattcttcaagaacgccctggagatcgccagcgagatcctgcagacccccgtgaccgagtacgacctgtacagccacaccagcatctggctgctgagaaccgacttcgtgctggactaccccaagcccgtgatgcccaacatgatcttcatcggcggcatcaactgccaccagggcaagcccctgcccatggagttcgaggcctacatcaacgccagcggcgagcacggcatcgtggtgttcagcctgggcagcatggtgagcgagatccccgagaagaaggccatggccatcgccgacgccctgggcaagatcccccagaccgtgctgtggagatacaccggcaccagacccagcaacctggccaacaacaccatcctggtgaagtggctgccccagaacgacctgctgggccaccccatgaccagagccttcatcacccacgccggcagccacggcgtgtacgagagcatctgcaacggcgtgcccatggtgatgatgcccctgttcggcgaccagatggacaacgccaagagaatggagaccaagggcgccggcgtgaccctgaacgtgctggagatgaccagcgaggacctggagaacgccctgaaggccgtgatcaacgacaagagctacaaggagaacatcatgagactgagcagcctgcacaaggacagacccgtggagcccctggacctggccgtgttctgggtggagttcgtgatgagacacaagggcgccccccacctgagacccgccgcccacgacctgacctggtaccagtaccacagcctggacgtgatcggcttcctgctggccgtggtgctgaccgtggccttcatcaccttcaagtgctgcgcctacggctacagaaagtgcctgggcaagaagggcagagtgaagaaggcccacaagagcaagacccactag

SEQ ID NO: 104525 - DNA, 1584 bp, Artificial Sequence
  Description of Artificial Sequence: Synthetic coding sequence
atgctgaacaacctgctgctgttcagcctgcagatcagcctgatcggcaccaccctgggcggcaacgtgctgatctggcccatggagggcagccactggctgaacgtgaagatcatcatcgacgagctgatcaagaaggagcacaacgtgaccgtgctggtggccagcggcgccctgttcatcacccccaccagcaaccccagcctgaccttcgagatctacagagtgcccttcggcaaggagagaatcgagggcgtgatcaaggacttcgtgctgacctggctggagaacagacccagccccagcaccatctggagattctaccaggagatggccaaggtgatcaaggacttccacatggtgagccaggagatctgcgacggcgtgctgaagaaccagcagctgatggccaagctgaagaagagcaagttcgaggtgctggtgagcgaccccgtgttcccctgcggcgacatcgtggccctgaagctgggcatccccttcatgtacagcctgagattcagccccgccagcaccgtggagaagcactgcggcaaggtgccctacccccccagctacgtgcccgccgtgctgagcgagctgaccgaccagatgagcttcaccgacagaatcagaaacttcatcagctaccacctgcaggactacatgttcgagaccctgtggaagagctgggacagctactacagcaaggccctgggcggcctgctgctgtgctgccccggctggagcgccgtggccgacctgggcagcctgcagcccctgctgcccggcttcaagagattcagcagactgagcctgcactgcagctgggactacagactgcccgccggcagacccaccaccctgtgcgagaccatgggcaaggccgagatctggctgatcagaacctactgggacttcgagttccccagaccctacctgcccaacttcgagttcgtgggcggcctgcactgcaagcccgccaagcccctgcccaaggtgctgtggagatacaagggcaagaagcccgccaccctgggcaacaacacccagctgttcgactggatcccccagaacgacctgctgggccaccccaagaccaaggccttcatcacccacggcggcaccaacggcatctacgaggccatctaccacggcgtgcccatggtgggcgtgcccatgttcgccgaccagcccgacaacatcgcccacatgaaggccaagggcgccgccgtggaggtgaacctgaacaccatgaccagcgtggacctgctgagcgccctgagaaccgtgatcaacgagcccagctacaaggagaacgccatgagactgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgatcggcttcctgctggtgtgcgtgaccaccgccatcttcctggtgatccagtgctgcctgttcagctgccagaagttcggcaagatcggcaagaagaagaagagagagtag

SEQ ID NO: 104526 - DNA, 2082 bp, Artificial Sequence
  Description of Artificial Sequence: Synthetic coding sequence
atgctgaacaacctgctgctgttcagcctgcagatcagcctgatcggcaccaccctgggcggcaacgtgctgatctggcccatggagggcagccactggctgaacgtgaagatcatcatcgacgagctgatcaagaaggagcacaacgtgaccgtgctggtggccagcggcgccctgttcatcacccccaccagcaaccccagcctgaccttcgagatctacagagtgcccttcggcaaggagagaatcgagggcgtgatcaaggacttcgtgctgacctggctggagaacagacccagccccagcaccatctggagattctaccaggagatggccaaggtgatcaaggacttccacatggtgagccaggagatctgcgacggcgtgctgaagaaccagcagctgatggccaagctgaagaagagcaagttcgaggtgctggtgagcgaccccgtgttcccctgcggcgacatcgtggccctgaagctgggcatccccttcatgtacagcctgagattcagccccgccagcaccgtggagaagcactgcggcaaggtgccctacccccccagctacgtgcccgccgtgctgagcgagctgaccgaccagatgagcttcaccgacagaatcagaaacttcatcagctaccacctgcaggactacatgttcgagaccctgtggaagagctgggacagctactacagcaaggccctggacggcagccactggctgaacatcaagatcatcctggaggagctgatccagagaaaccacaacgtgaccgtgctggccagcagcgccaccctgttcatcaacagcaaccccgacagccccgtgaacttcgaggtgatccccgtgagctacaagaagagcaacatcgacagcctgatcgagcacatgatcatgctgtggatcgaccacagacccacccccctgaccatctgggccttctacaaggagctgggcaagctgctggacaccttcttccagatcaacatccagctgtgcgacggcgtgctgaagaaccccaagctgatggccagactgcagaagggcggcttcgacgtgctggtggccgaccccgtgaccatctgcggcgacctggtggccctgaagctgggcatccccttcatgtacaccctgagattcagccccgccagcaccgtggagagacactgcggcaagatccccgcccccgtgagctacgtgcccgccgccctgagcgagctgaccgaccagatgaccttcggcgagagaatcaagaacaccatcagctacagcctgcaggactacatcttccagagctactggggcgagtggaacagctactacagcaagatcctgggcagacccaccaccctgtgcgagaccatgggcaaggccgagatctggctgatcagaacctactgggacttcgagttccccagaccctacctgcccaacttcgagttcgtgggcggcctgcactgcaagcccgccaagcccctgcccaaggtgctgtggagatacaagggcaagaagcccgccaccctgggcaacaacacccagctgttcgactggatcccccagaacgacctgctgggccaccccaagaccaaggccttcatcacccacggcggcaccaacggcatctacgaggccatctaccacggcgtgcccatggtgggcgtgcccatgttcgccgaccagcccgacaacatcgcccacatgaaggccaagggcgccgccgtggaggtgaacctgaacaccatgaccagcgtggacctgctgagcgccctgagaaccgtgatcaacgagcccagctacaaggagaacgccatgagactgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgatcggcttcctgctggtgtgcgtgaccaccgccatcttcctggtgatccagtgctgcctgttcagctgccagaagttcggcaagatcggcaagaagaagaagagagagtag

SEQ ID NO: 104527 - DNA, 1611 bp, Artificial Sequence
  Description of Artificial Sequence: Synthetic coding sequence
atggtgagcatcagagacttcaccatgcccaagaagttcgtgcagatgctggtgttcaacctgaccctgaccgaggtggtgctgagcggcaacgtgctgatctggcccaccgacggcagccactggctgaacatcaagatcatcctggaggagctgatccagagaaaccacaacgtgaccgtgctggccagcagcgccaccctgttcatcaacagcaaccccgacagccccgtgaacttcgaggtgatccccgtgagctacaagaagagcaacatcgacagcctgatcgagcacatgatcatgctgtggatcgaccacagacccacccccctgaccatctgggccttctacaaggagctgggcaagctgctggacaccttcttccagatcaacatccagctgtgcgacggcgtgctgaagaaccccaagctgatggccagactgcagaagggcggcttcgacgtgctggtggccgaccccgtgaccatctgcggcgacctggtggccctgaagctgggcatccccttcatgtacaccctgagattcagccccgccagcaccgtggagagacactgcggcaagatccccgcccccgtgagctacgtgcccgccgccctgagcgagctgaccgaccagatgaccttcggcgagagaatcaagaacaccatcagctacagcctgcaggactacatcttccagagctactggggcgagtggaacagctactacagcaagatcctgggcagacccaccaccctgtgcgagaccatgggcaaggccgagatctggctgatcagaacctactgggacttcgagttccccagaccctacctgcccaacttcgagttcgtgggcggcctgcactgcaagcccgccaagcccctgcccaaggagatggaggagttcatccagagcagcggcaagaacggcgtggtggtgttcagcctgggcagcatggtgaagaacctgaccgaggagaaggccaacctgatcgccagcgccctggcccagatcccccagaaggtgctgtggagatacaagggcaagaagcccgccaccctgggcaacaacacccagctgttcgactggatcccccagaacgacctgctgggccaccccaagaccaaggccttcatcacccacggcggcaccaacggcatctacgaggccatctaccacggcgtgcccatggtgggcgtgcccatgttcgccgaccagcccgacaacatcgcccacatgaaggccaagggcgccgccgtggaggtgaacctgaacaccatgaccagcgtggacctgctgagcgccctgagaaccgtgatcaacgagcccagctacaaggagaacgccatgagactgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgatcggcttcctgctggtgtgcgtgaccaccgccatcttcctggtgatccagtgctgcctgttcagctgccagaagttcggcaagatcggcaagaagaagaagagagagtag

SEQ ID NO: 104528 - DNA, 1584 bp, Artificial Sequence
  Description of Artificial Sequence: Synthetic coding sequence
atgctgaacaacctgctgctgttcagcctgcagatcagcctgatcggcaccaccctgggcggcaacgtgctgatctggcccatggagggcagccactggctgaacgtgaagatcatcatcgacgagctgatcaagaaggagcacaacgtgaccgtgctggtggccagcggcgccctgttcatcacccccaccagcaaccccagcctgaccttcgagatctacagagtgcccttcggcaaggagagaatcgagggcgtgatcaaggacttcgtgctgacctggctggagaacagacccagccccagcaccatctggagattctaccaggagatggccaaggtgatcaaggacttccacatggtgagccaggagatctgcgacggcgtgctgaagaaccagcagctgatggccaagctgaagaagagcaagttcgaggtgctggtgagcgaccccgtgttcccctgcggcgacatcgtggccctgaagctgggcatccccttcatgtacagcctgagattcagccccgccagcaccgtggagaagcactgcggcaaggtgccctacccccccagctacgtgcccgccgtgctgagcgagctgaccgaccagatgagcttcaccgacagaatcagaaacttcatcagctaccacctgcaggactacatgttcgagaccctgtggaagagctgggacagctactacagcaaggccctgggcagacccaccaccctgtgcgagaccatgggcaaggccgagatctggctgatcagaacctactgggacttcgagttccccagaccctacctgcccaacttcgagttcgtgggcggcctgcactgcaagcccgccaagcccctgcccaaggagatggaggagttcatccagagcagcggcaagaacggcgtggtggtgttcagcctgggcagcatggtgaagaacctgaccgaggagaaggccaacctgatcgccagcgccctggcccagatcccccagaaggtgctgtggagatacaagggcaagaagcccgccaccctgggcaacaacacccagctgttcgactggatcccccagaacgacctgctgggccaccccaagaccaaggccttcatcacccacggcggcaccaacggcatctacgaggccatctaccacggcgtgcccatggtgggcgtgcccatgttcgccgaccagcccgacaacatcgcccacatgaaggccaagggcgccgccgtggaggtgaacctgaacaccatgaccagcgtggacctgctgagcgccctgagaaccgtgatcaacgagcccagctacaaggagaacgccatgagactgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgatcggcttcctgctggtgtgcgtgaccaccgccatcttcctggtgatccagtgctgcctgttcagctgccagaagttcggcaagatcggcaagaagaagaagagagagtag

SEQ ID NO: 104529 - DNA, 477 bp, Artificial Sequence
  Description of Artificial Sequence: Synthetic coding sequence
atgctgaacaacctgctgctgttcagcctgcagatcagcctgatcggcaccaccctgggcggcaacgtgctgatctggcccatggagggcagccactggctgaacgtgaagatcatcatcgacgagctgatcaagaaggagcacaacgtgaccgtgctggtggccagcggcgccctgttcatcacccccaccagcaaccccagcctgaccttcgagatctacagagtgcccttcggcaaggagagaatcgagggcgtgatcaaggacttcgtgctgacctggctggagaacagacccagccccagcaccatctggagattctaccaggagatggccaaggtgatcaaggacttccacatggtgagccaggagatctgcgacggcgtgctgaagaaccagcagctgatggccaagctgaagaagagcaagttcgaggtgctggtgagcgaccccgtgttcccctgcggcgacatctag

SEQ ID NO: 104530 - DNA, 1590 bp, Artificial Sequence
  Description of Artificial Sequence: Synthetic coding sequence
atgaccctgaagtggaccagcgtgctgctgctgatccacctgagctgctacttcagcagcggcagctgcggcaaggtgctggtgtgggccgccgagtacagccactggatgaacatgaagaccatcctgaaggagctggtgcagagaggccacgaggtgaccgtgctggccagcagcgccagcatcctgttcgaccccaacgacgccagcaccctgaagttcgaggtgtaccccaccagcctgaccaagaccgagttcgagaacatcatcatgcagcaggtgaagagatggagcgacatcagaaaggacagcttctggctgtacttcagccaggagcaggagatcctgtgggagctgtacgacatcttcagaaacttctgcaaggacgtggtgagcaacaagaaggtgatgaagaagctgcaggagagcagattcgacatcgtgttcgccgacgccgtgttcccctgcggcgagctgctggccgccctgctgaacatcagattcgtgtacagcctgagattcacccccggctacaccatcgagagacacagcggcggcctgatcttcccccccagctacatccccatcgtgatgagcaagctgagcgaccagatgaccttcatggagagagtgaagaacatgatctacgtgctgtacttcgacttctggttccagatgagcgacatgaagaagtgggaccagttctacagcgaggtgctgggcagacccaccaccctgttcgagaccatgggcaaggccgacatctggctgatgagaaacagctggagcttccagttcccccaccccttcctgcccaacgtggacttcgtgggcggcttccactgcaagcccgccaagcccctgcccaaggagatggaggagttcgtgcagagcagcggcgagaacggcgtggtggtgttcagcctgggcagcgtgatcagcaacatgaccgccgagagagccaacgtgatcgccaccgccctggccaagatcccccagaaggtgctgtggagattcgacggcaacaagcccgacgccctgggcctgaacaccagactgtacaagtggatcccccagaacgacctgctgggccaccccaagaccagagccttcatcacccacggcggcgccaacggcatctacgaggccatctaccacggcatccccatggtgggcatccccctgttcttcgaccagcccgacaacatcgcccacatgaaggccaagggcgccgccgtgagactggacttcaacaccatgagcagcaccgacctgctgaacgccctgaagaccgtgatcaacgaccccctgtacaaggagaacatcatgaagctgagcagaatccagcacgaccagcccgtgaagcccctggacagagccgtgttctggatcgagttcgtgatgccccacaagggcgccaagcacctgagagtggccgcccacgacctgacctggttccagtaccacagcctggacgtgatcggcttcctgctggcctgcgtggccaccgtgatcttcatcatcaccaagttctgcctgttctgcttctggaagttcgccagaaagggcaagaagggcaagagagactag

SEQ ID NO: 104531 - DNA, 1593 bp, Artificial Sequence
  Description of Artificial Sequence: Synthetic coding sequence
atgagcctgaagtggaccagcgtgttcctgctgatccagctgagctgctacttcagcagcggcagctgcggcaaggtgctggtgtggcccaccgagtacagccactggatcaacatgaagaccatcctggaggagctggtgcagagaggccacgaggtgaccgtgctgaccagcagcgccagcaccctggtgaacgccagcaagagcagcgccatcaagctggaggtgtaccccaccagcctgaccaagaactacctggaggacagcctgctgaagatcctggacagatggatctacggcgtgagcaagaacaccttctggagctacttcagccagctgcaggagctgtgctgggagtactacgactacagcaacaagctgtgcaaggacgccgtgctgaacaagaagctgatgatgaagctgcaggagagcaagttcgacgtgatcctggccgacgccctgaacccctgcggcgagctgctggccgagctgttcaacatccccttcctgtacagcctgagattcagcgtgggctacaccttcgagaagaacggcggcggcttcctgttcccccccagctacgtgcccgtggtgatgagcgagctgagcgaccagatgatcttcatggagagaatcaagaacatgatccacatgctgtacttcgacttctggttccagatctacgacctgaagaagtgggaccagttctacagcgaggtgctgggcagacccaccaccctgttcgagaccatgggcaaggccgagatgtggctgatcagaacctactgggacttcgagttccccagacccttcctgcccaacgtggacttcgtgggcggcctgcactgcaagcccgccaagcccctgcccaaggagatggaggagttcgtgcagagcagcggcgagaacggcatcgtggtgttcagcctgggcagcatgatcagcaacatgagcgaggagagcgccaacatgatcgccagcgccctggcccagatcccccagaaggtgctgtggagattcgacggcaagaagcccaacaccctgggcagcaacaccagactgtacaagtggctgccccagaacgacctgctgggccaccccaagaccaaggccttcatcacccacggcggcaccaacggcatctacgaggccatctaccacggcatccccatggtgggcatccccctgttcgccgaccagcacgacaacatcgcccacatgaaggccaagggcgccgccctgagcgtggacatcagaaccatgagcagcagagacctgctgaacgccctgaagagcgtgatcaacgaccccgtgtacaaggagaacgtgatgaagctgagcagaatccaccacgaccagcccatgaagcccctggacagagccgtgttctggatcgagttcgtgatgagacacaagggcgccaagcacctgagagtggccgcccacaacctgacctggatccagtaccacagcctggacgtgatcgccttcctgctggcctgcgtggccaccgtgatcttcatcatcaccaagttctgcctgttctgcttcagaaagctggccaagaagggcaagaagaagaagagagactag

SEQ ID NO: 104532 - DNA, 1593 bp, Artificial Sequence
  Description of Artificial Sequence: Synthetic coding sequence
atgagcctgaagtggatgagcgtgttcctgctgatgcagctgagctgctacttcagcagcggcagctgcggcaaggtgctggtgtggcccaccgagtacagccactggatcaacatgaagaccatcctggaggagctggtgcagagaggccacgaggtgatcgtgctgaccagcagcgccagcatcctggtgaacgccagcaagagcagcgccatcaagctggaggtgtaccccaccagcctgaccaagaacgacctggaggacttcttcatgaagatgttcgacagatggacctacagcatcagcaagaacaccttctggagctacttcagccagctgcaggagctgtgctgggagtacagcgactacaacatcaagctgtgcgaggacgccgtgctgaacaagaagctgatgagaaagctgcaggagagcaagttcgacgtgctgctggccgacgccgtgaacccctgcggcgagctgctggccgagctgctgaacatccccttcctgtacagcctgagattcagcgtgggctacaccgtggagaagaacggcggcggcttcctgttcccccccagctacgtgcccgtggtgatgagcgagctgagcgaccagatgatcttcatggagagaatcaagaacatgatctacatgctgtacttcgacttctggttccaggcctacgacctgaagaagtgggaccagttctacagcgaggtgctgggcagacccaccaccctgttcgagaccatgggcaaggccgagatgtggctgatcagaacctactgggacttcgagttccccagacccttcctgcccaacgtggacttcgtgggcggcctgcactgcaagcccgccaagcccctgcccaaggagatggaggagttcgtgcagagcagcggcgagaacggcatcgtggtgttcagcctgggcagcatgatcagcaacatgagcgaggagagcgccaacatgatcgccagcgccctggcccagatcccccagaaggtgctgtggagattcgacggcaagaagcccaacaccctgggcagcaacaccagactgtacaagtggctgccccagaacgacctgctgggccaccccaagaccaaggccttcatcacccacggcggcaccaacggcatctacgaggccatctaccacggcatccccatggtgggcatccccctgttcgccgaccagcacgacaacatcgcccacatgaaggccaagggcgccgccctgagcgtggacatcagaaccatgagcagcagagacctgctgaacgccctgaagagcgtgatcaacgaccccatctacaaggagaacatcatgaagctgagcagaatccaccacgaccagcccgtgaagcccctggacagagccgtgttctggatcgagttcgtgatgagacacaagggcgccaagcacctgagagtggccgcccacaacctgacctggatccagtaccacagcctggacgtgatcgccttcctgctggcctgcgtggccaccatgatcttcatgatcaccaagtgctgcctgttctgcttcagaaagctggccaagaccggcaagaagaagaagagagactag

SEQ ID NO: 104533 - DNA, 1590 bp, Artificial Sequence
  Description of Artificial Sequence: Synthetic coding sequence
atggccctgaagtggaccagcgtgctgctgctgatccacctgggctgctacttcagcagcggcagctgcggcaaggtgctggtgtggaccggcgagtacagccactggatgaacatgaagaccatcctgaaggagctggtgcagagaggccacgaggtgaccgtgctggccagcagcgccagcatcctgttcgaccccaacgacgccttcaccctgaagctggaggtgtaccccaccagcctgaccaagaccgagttcgagaacatcatcatgcagcaggtgaagagatggagcgacatccagaaggacagcttctggctgtacttcagccaggagcaggagatcctgtgggagttccacgacatcttcagaaacttctgcaaggacgtggtgagcaacaagaaggtgatgaagaagctgcaggagagcagattcgacatcatcttcgccgacgccttcttcccctgcggcgagctgctggccgccctgctgaacatccccttcgtgtacagcctgtgcttcacccccggctacaccatcgagagacacagcggcggcctgatcttcccccccagctacatccccgtggtgatgagcaagctgagcgaccagatgaccttcatggagagagtgaagaacatgatctacgtgctgtacttcgacttctggttccagatgtgcgacatgaagaagtgggaccagttctacagcgaggtgctgggcagacccaccaccctgttcgagaccatgggcaaggccgacatctggctgatgagaaacagctggagcttccagttcccccaccccttcctgcccaacatcgacttcgtgggcggcctgcactgcaagcccgccaagcccctgcccaaggagatggaggagttcgtgcagagcagcggcgagaacggcgtggtggtgttcagcctgggcagcgtgatcagcaacatgaccgccgagagagccaacgtgatcgccaccgccctggccaagatcccccagaaggtgctgtggagattcgacggcaacaagcccgacgccctgggcctgaacaccagactgtacaagtggatcccccagaacgacctgctgggcctgcccaagaccagagccttcatcacccacggcggcgccaacggcatctacgaggccatctaccacggcatccccatggtgggcatccccctgttctgggaccagcccgacaacatcgcccacatgaaggccaagggcgccgccgtgagactggacttccacaccatgagcagcaccgacctgctgaacgccctgaagaccgtgatcaacgaccccagctacaaggagaacgtgatgaagctgagcatcatccagcacgaccagcccgtgaagcccctgcacagagccgtgttctggatcgagttcgtgatgtgccacaagggcgccaagcacctgagagtggccgccagagacctgacctggttccagtaccacagcctggacgtgatcggcttcctgctggcctgcgtggccaccgtgatcttcgtggtgaccaagttctgcctgttctgcttctggaagttcgccagaaagggcaagaagggcaagagagactag

SEQ ID NO: 104534 - DNA, 1008 bp, Artificial Sequence
  Description of Artificial Sequence: Synthetic coding sequence
atggccctgaagtggaccagcgtgctgctgctgatccacctgggctgctacttcagcagcggcagctgcggcaaggtgctggtgtggaccggcgagtacagccactggatgaacatgaagaccatcctgaaggagctggtgcagagaggccacgaggtgaccgtgctggccagcagcgccagcatcctgttcgaccccaacgacgccttcaccctgaagctggaggtgtaccccaccagcctgaccaagaccgagttcgagaacatcatcatgcagcaggtgaagagatggagcgacatccagaaggacagcttctggctgtacttcagccaggagcaggagatcctgtgggagttccacgacatcttcagaaacttctgcaaggacgtggtgagcaacaagaaggtgatgaagaagctgcaggagagcagattcgacatcatcttcgccgacgccttcttcccctgcggcgagctgctggccgccctgctgaacatccccttcgtgtacagcctgtgcttcacccccggctacaccatcgagagacacagcggcggcctgatcttcccccccagctacatccccgtggtgatgagcaagctgagcgaccagatgaccttcatggagagagtgaagaacatgatctacgtgctgtacttcgacttctggttccagatgtgcgacatgaagaagtgggaccagttctacagcgaggtgctgggcagacccaccaccctgttcgagaccatgggcaaggccgacatctggctgatgagaaacagctggagcttccagttcccccaccccttcctgcccaacatcgacttcgtgggcggcctgcactgcaagcccgccaagcccctgcccaaggagatggaggagttcgtgcagagcagcggcgagaacggcgtggtggtgttcagcctgggcagcgtgatcagcaacatgaccgccgagagagccaacgtgatcgccaccgccctggccaagatcccccagaagatctag

SEQ ID NO: 104535 - DNA, 1587 bp, Artificial Sequence
  Description of Artificial Sequence: Synthetic coding sequence
atgagcatgaagtggaccagcgccctgctgctgatccagctgagctgctacttcagcagcggcagctgcggcaaggtgctggtgtggcccaccgagttcagccactggatgaacatcaagaccatcctggacgagctggtgcagagaggccacgaggtgaccgtgctggccagcagcgccagcatcagcttcgaccccaacagccccagcaccctgaagttcgaggtgtaccccgtgagcctgaccaagaccgagttcgaggacatcatcaagcagctggtgaagagatgggccgagctgcccaaggacaccttctggagctacttcagccaggtgcaggagatcatgtggaccttcaacgacatcctgagaaagttctgcaaggacatcgtgagcaacaagaagctgatgaagaagctgcaggagagcagattcgacgtggtgctggccgacgccgtgttccccttcggcgagctgctggccgagctgctgaagatccccttcgtgtacagcctgagattcagccccggctacgccatcgagaagcacagcggcggcctgctgttcccccccagctacgtgcccgtggtgatgagcgagctgagcgaccagatgaccttcatcgagagagtgaagaacatgatctacgtgctgtacttcgagttctggttccagatcttcgacatgaagaagtgggaccagttctacagcgaggtgctgggcagacccaccaccctgagcgagaccatggccaaggccgacatctggctgatcagaaactactgggacttccagttcccccaccccctgctgcccaacgtggagttcgtgggcggcctgcactgcaagcccgccaagcccctgcccaaggagatggaggagttcgtgcagagcagcggcgagaacggcgtggtggtgttcagcctgggcagcatggtgagcaacaccagcgaggagagagccaacgtgatcgccagcgccctggccaagatcccccagaaggtgctgtggagattcgacggcaacaagcccgacaccctgggcctgaacaccagactgtacaagtggatcccccagaacgacctgctgggccaccccaagaccagagccttcatcacccacggcggcgccaacggcatctacgaggccatctaccacggcatccccatggtgggcgtgcccctgttcgccgaccagcccgacaacatcgcccacatgaaggccaagggcgccgccgtgagcctggacttccacaccatgagcagcaccgacctgctgaacgccctgaagaccgtgatcaacgaccccctgtacaaggagaacgccatgaagctgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgaccggcttcctgctggcctgcgtggccaccgtgatcttcatcatcaccaagtgcctgttctgcgtgtggaagttcgtgagaaccggcaagaagggcaagagagactag

SEQ ID NO: 104536 - DNA, 1179 bp, Artificial Sequence
  Description of Artificial Sequence: Synthetic coding sequence
atgttcttcgccctgctgcacgtgagcagcaccaacggcctggacgccgtgttccccttcggcgagctgctggccgagctgctgaagatccccttcgtgtacagcctgagattcagccccggctacgccatcgagaagcacagcggcggcctgctgttcccccccagctacgtgcccgtggtgatgagcgagctgagcgaccagatgaccttcatcgagagagtgaagaacatgatctacgtgctgtacttcgagttctggttccagatcttcgacatgaagaagtgggaccagttctacagcgaggtgctgggcagacccaccaccctgagcgagaccatggccaaggccgacatctggctgatcagaaactactgggacttccagttcccccaccccctgctgcccaacgtggagttcgtgggcggcctgcactgcaagcccgccaagcccctgcccaaggagatggaggagttcgtgcagagcagcggcgagaacggcgtggtggtgttcagcctgggcagcatggtgagcaacaccagcgaggagagagccaacgtgatcgccagcgccctggccaagatcccccagaaggtgctgtggagattcgacggcaacaagcccgacaccctgggcctgaacaccagactgtacaagtggatcccccagaacgacctgctgggccaccccaagaccagagccttcatcacccacggcggcgccaacggcatctacgaggccatctaccacggcatccccatggtgggcgtgcccctgttcgccgaccagcccgacaacatcgcccacatgaaggccaagggcgccgccgtgagcctggacttccacaccatgagcagcaccgacctgctgaacgccctgaagaccgtgatcaacgaccccctgtacaaggagaacgccatgaagctgagcagaatccaccacgaccagcccgtgaagcccctggacagagccgtgttctggatcgagttcgtgatgagacacaagggcgccaagcacctgagagtggccgcccacgacctgacctggttccagtaccacagcctggacgtgaccggcttcctgctggcctgcgtggccaccgtgatcttcatcatcaccaagtgcctgttctgcgtgtggaagttcgtgagaaccggcaagaagggcaagagagactag

SEQ ID NO: 104537 - DNA, 165 bp, Artificial Sequence
  Description of Artificial Sequence: Synthetic coding sequence
atgagcatgaagtggaccagcgccctgctgctgatccagctgagctgctacttcagcagcggcagctgcggcaaggtgctggtgtggcccaccgagttcagccactggatgaacatcaagaccatcctggacgagctggtgcagagaggccacgaggtgacctag

SEQ ID NO: 104538 - DNA, 1590 bp, Artificial Sequence
  Description of Artificial Sequence: Synthetic coding sequence
atgagcgtgaagtggaccagcgtgatcctgctgatccagctgagcttctgcttcagcagcggcaactgcggcaaggtgctggtgtgggccgccgagtacagccactggatgaacatcaagaccatcctggacgagctgatccagagaggccacgaggtgaccgtgctggccagcagcgccagcatcctgttcgaccccaacaacagcagcgccctgaagatcgagatctaccccaccagcctgaccaagaccgagctggagaacttcatcatgcagcagatcaagagatggagcgacctgcccaaggacaccttctggctgtacttcagccaggtgcaggagatcatgagcatcttcggcgacatcaccagaaagttctgcaaggacgtggtgagcaacaagaagttcatgaagaaggtgcaggagagcagattcgacgtgatcttcgccgacgccatcttcccctgcagcgagctgctggccgagctgttcaacatccccttcgtgtacagcctgagcttcagccccggctacaccttcgagaagcacagcggcggcttcatcttcccccccagctacgtgcccgtggtgatgagcgagctgaccgaccagatgaccttcatggagagagtgaagaacatgatctacgtgctgtacttcgacttctggttcgagatcttcgacatgaagaagtgggaccagttctacagcgaggtgctgggcagacccaccaccctgagcgagaccatgggcaaggccgacgtgtggctgatcagaaacagctggaacttccagttcccctaccccctgctgcccaacgtggacttcgtgggcggcctgcactgcaagcccgccaagcccctgcccaaggagatggaggacttcgtgcagagcagcggcgagaacggcgtggtggtgttcagcctgggcagcatggtgagcaacatgaccgaggagagagccaacgtgatcgccagcgccctggcccagatcccccagaaggtgctgtggagattcgacggcaacaagcccgacaccctgggcctgaacaccagactgtacaagtggatcccccagaacgacctgctgggccaccccaagaccagagccttcatcacccacggcggcgccaacggcatctacgaggccatctaccacggcatccccatggtgggcatccccctgttcgccgaccagcccgacaacatcgcccacatgaaggccagaggcgccgccgtgagagtggacttcaacaccatgagcagcaccgacctgctgaacgccctgaagagagtgatcaacgaccccagctacaaggagaacgtgatgaagctgagcagaatccagcacgaccagcccgtgaagcccctggacagagccgtgttctggatcgagttcgtgatgagacacaagggcgccaagcacctgagagtggccgcccacgacctgacctggttccagtaccacagcctggacgtgatcggcttcctgctggtgtgcgtggccaccgtgatcttcatcgtgaccaagtgctgcctgttctgcttctggaagttcgccagaaaggccaagaagggcaagaacgactag

SEQ ID NO: 104539 - DNA, 1269 bp, Artificial Sequence
  Description of Artificial Sequence: Synthetic coding sequence
atgctgcagtggagaagaagacactgctgcttcgccaagatgacctggaacgccaagagaagcctgttcagaacccacctgatcggcgtgctgagcctggtgttcctgttcgccatgttcctgttcttcaaccaccacgactggctgcccggcagagccggcttcaaggagaaccccgtgacctacaccttcagaggcttcagaagcaccaagagcgagaccaaccacagcagcctgagaaacatctggaaggagaccgtgccccagaccctgagaccccagaccgccaccaacagcaacaacaccgacctgagcccccagggcgtgaccggcctggagaacaccctgagcgccaacggcagcatctacaacgagaagggcaccggccaccccaacagctaccacttcaagtacatcatcaacgagcccgagaagtgccaggagaagagccccttcctgatcctgctgatcgccgccgagcccggccagatcgaggccagaagagccatcagacagacctggggcaacgagagcctggcccccggcatccagatcaccagaatcttcctgctgggcctgagcatcaagctgaacggctacctgcagagagccatcctggaggagagcagacagtaccacgacatcatccagcaggagtacctggacacctactacaacctgaccatcaagaccctgatgggcatgaactgggtggccacctactgcccccacatcccctacgtgatgaagaccgacagcgacatgttcgtgaacaccgagtacctgatcaacaagctgctgaagcccgacctgccccccagacacaactacttcaccggctacctgatgagaggctacgcccccaacagaaacaaggacagcaagtggtacatgccccccgacctgtaccccagcgagagataccccgtgttctgcagcggcaccggctacgtgttcagcggcgacctggccgagaagatcttcaaggtgagcctgggcatcagaagactgcacctggaggacgtgtacgtgggcatctgcctggccaagctgagaatcgaccccgtgcccccccccaacgagttcgtgttcaaccactggagagtgagctacagcagctgcaagtacagccacctgatcaccagccaccagttccagcccagcgagctgatcaagtactggaaccacctgcagcagaacaagcacaacgcctgcgccaacgccgccaaggagaaggccggcagatacagacacagaaagctgcactag

SEQ ID NO: 104540 - DNA, 1137 bp, Artificial Sequence
  Description of Artificial Sequence: Synthetic coding sequence
atgcagctgagactgttcagaagactgctgctggccgccctgctgctggtgatcgtgtggaccctgttcggccccagcggcctgggcgaggagctgctgagcctgagcctggccagcctgctgcccgcccccgccagccccggcccccccctggccctgcccagactgctgatccccaaccaggaggcctgcagcggccccggcgccccccccttcctgctgatcctggtgtgcaccgcccccgagaacctgaaccagagaaacgccatcagagccagctggggcggcctgagagaggccagaggcctgagagtgcagaccctgttcctgctgggcgagcccaacgcccagcaccccgtgtggggcagccagggcagcgacctggccagcgagagcgccgcccagggcgacatcctgcaggccgccttccaggacagctacagaaacctgaccctgaagaccctgagcggcctgaactgggccgagaagcactgccccatggccagatacgtgctgaagaccgacgacgacgtgtacgtgaacgtgcccgagctggtgagcgagctggtgctgagaggcggcagatggggccagtgggagagaagcaccgagccccagagagaggccgagcaggagggcggccaggtgctgcacagcgaggaggtgcccctgctgtacctgggcagagtgcactggagagtgaaccccagcagaacccccggcggcagacacagagtgagcgaggagcagtggccccacacctggggccccttccccccctacgccagcggcaccggctacgtgctgagcgccagcgccgtgcagctgatcctgaaggtggccagcagagcccccctgctgcccctggaggacgtgttcgtgggcgtgagcgccagaagaggcggcctggcccccacccagtgcgtgaagctggccggcgccacccactaccccctggacagatgctgctacggcaagttcctgctgaccagccacagactggacccctggaagatgcaggaggcctggaagctggtgggcggcagcgacggcgagagaaccgcccccttctgcagctggttccagggcgtgctgggcatcctgagatgcagagccatcgcctggctgcagagctag

SEQ ID NO: 104541 - DNA, 1137 bp, Artificial Sequence; identical to SEQ ID NO: 104540
  Description of Artificial Sequence: Synthetic coding sequence

SEQ ID NO: 104542 - DNA, 1137 bp, Artificial Sequence; identical to SEQ ID NO: 104540
  Description of Artificial Sequence: Synthetic coding sequence

SEQ ID NO: 104543 - DNA, 1137 bp, Artificial Sequence; identical to SEQ ID NO: 104540
  Description of Artificial Sequence: Synthetic coding sequence

SEQ ID NO: 104544 - DNA, 1137 bp, Artificial Sequence; identical to SEQ ID NO: 104540
  Description of Artificial Sequence: Synthetic coding sequence

SEQ ID NO: 104545 - DNA, 933 bp, Artificial Sequence
  Description of Artificial Sequence: Synthetic coding sequence
atggccttccccaagatgagactgatgtacatctgcctgctggtgctgggcgccctgtgcctgtacttcagcatgtacagcctgaaccccttcaaggagcagagcttcgtgtacaagaaggacggcaacttcctgaagctgcccgacaccgactgcagacagaccccccccttcctggtgctgctggtgaccagcagccacaagcagctggccgagagaatggccatcagacagacctggggcaaggagagaatggtgaagggcaagcagctgaagaccttcttcctgctgggcaccaccagcagcgccgccgagaccaaggaggtggaccaggagagccagagacacggcgacatcatccagaaggacttcctggacgtgtactacaacctgaccctgaagaccatgatgggcatcgagtgggtgcacagattctgcccccaggccgccttcgtgatgaagaccgacagcgacatgttcatcaacgtggactacctgaccgagctgctgctgaagaagaacagaaccaccagattcttcaccggcttcctgaagctgaacgagttccccatcagacagcccttcagcaagtggttcgtgagcaagagcgagtacccctgggacagatacccccccttctgcagcggcaccggctacgtgttcagcggcgacgtggccagccaggtgtacaacgtgagcaagagcgtgccctacatcaagctggaggacgtgttcgtgggcctgtgcctggagagactgaacatcagactggaggagctgcacagccagcccaccttcttccccggcggcctgagattcagcgtgtgcctgttcagaagaatcgtggcctgccacttcatcaagcccagaaccctgctggactactggcaggccctggagaacagcagaggcgaggactgcccccccgtgtag

SEQ ID NO: 104546 - DNA, 933 bp, Artificial Sequence; identical to SEQ ID NO: 104545
  Description of Artificial Sequence: Synthetic coding sequence

SEQ ID NO: 104547 - DNA, 933 bp, Artificial Sequence; identical to SEQ ID NO: 104545
  Description of Artificial Sequence: Synthetic coding sequence

SEQ ID NO: 104548 - DNA, 933 bp, Artificial Sequence; identical to SEQ ID NO: 104545
  Description of Artificial Sequence: Synthetic coding sequence

SEQ ID NO: 104549 - DNA, 1197 bp, Artificial Sequence
  Description of Artificial Sequence: Synthetic coding sequence
atgagactgagagagcccctgctgagcggcagcgccgccatgcccggcgccagcctgcagagagcctgcagactgctggtggccgtgtgcgccctgcacctgggcgtgaccctggtgtactacctggccggcagagacctgagcagactgccccagctggtgggcgtgagcacccccctgcagggcggcagcaacagcgccgccgccatcggccagagcagcggcgagctgagaaccggcggcgccagaccccccccccccctgggcgccagcagccagcccagacccggcggcgacagcagccccgtggtggacagcggccccggccccgccagcaacctgaccagcgtgcccgtgccccacaccaccgccctgagcctgcccgcctgccccgaggagagccccctgctggtgggccccatgctgatcgagttcaacatgcccgtggacctggagctggtggccaagcagaaccccaacgtgaagatgggcggcagatacgcccccagagactgcgtgagcccccacaaggtggccatcatcatccccttcagaaacagacaggagcacctgaagtactggctgtactacctgcaccccgtgctgcagagacagcagctggactacggcatctacgtgatcaaccaggccggcgacaccatcttcaacagagccaagctgctgaacgtgggcttccaggaggccctgaaggactacgactacacctgcttcgtgttcagcgacgtggacctgatccccatgaacgaccacaacgcctacagatgcttcagccagcccagacacatcagcgtggccatggacaagttcggcttcagcctgccctacgtgcagtacttcggcggcgtgagcgccctgagcaagcagcagttcctgaccatcaacggcttccccaacaactactggggctggggcggcgaggacgacgacatcttcaacagactggtgttcagaggcatgagcatcagcagacccaacgccgtggtgggcagatgcagaatgatcagacacagcagagacaagaagaacgagcccaacccccagagattcgacagaatcgcccacaccaaggagaccatgctgagcgacggcctgaacagcctgacctaccaggtgctggacgtgcagagataccccctgtacacccagatcaccgtggacatcggcacccccagctag

SEQ ID NO: 104550 - DNA, 678 bp, Artificial Sequence
  Description of Artificial Sequence: Synthetic coding sequence
atgagactgagagagcccctgctgagcggcagcgccgccatgcccggcgccagcctgcagagagcctgcagactgctggtggccgtgtgcgccctgcacctgggcgtgaccctggtgtactacctggccggcagagacctgagcagactgccccagctggtgggcgtgagcacccccctgcagggcggcagcaacagcgccgccgccatcggccagagcagcggcgagctgagaaccggcggcgccagaccccccccccccctgggcgccagcagccagcccagacccggcggcgacagcagccccgtggtggacagcggccccggccccgccagcaacctgaccagcgtgcccgtgccccacaccaccgccctgagcctgcccgcctgccccgaggagagccccctgctggtgggccccatgctgatcgagttcaacatgcccgtggacctggagctggtggccaagcagaaccccaacgtgaagatgggcggcagatacgcccccagagactgcgtgagcccccacaaggtggccatcatcatccccttcagaaacagacaggagcacctgaagtactggctgtactacctgcaccccgtgctgcagagacagcagctggactacggcatctacgtgatcaaccagtacgagaagatcagaagactgctgtggtag

SEQ ID NO: 104551 - DNA, 1068 bp, Artificial Sequence
  Description of Artificial Sequence: Synthetic coding sequence
atgagactgagagagcccctgctgagcggcagcgccgccatgcccggcgccagcctgcagagagcctgcagactgctggtggccgtgtgcgccctgcacctgggcgtgaccctggtgtactacctggccggcagagacctgagcagactgccccagctggtgggcgtgagcacccccgtggtggacagcggccccggccccgccagcaacctgaccagcgtgcccgtgccccacaccaccgccctgagcctgcccgcctgccccgaggagagccccctgctggtgggccccatgctgatcgagttcaacatgcccgtggacctggagctggtggccaagcagaaccccaacgtgaagatgggcggcagatacgcccccagagactgcgtgagcccccacaaggtggccatcatcatccccttcagaaacagacaggagcacctgaagtactggctgtactacctgcaccccgtgctgcagagacagcagctggactacggcatctacgtgatcaaccaggccggcgacaccatcttcaacagagccaagctgctgaacgtgggcttccaggaggccctgaaggactacgactacacctgcttcgtgttcagcgacgtggacctgatccccatgaacgaccacaacgcctacagatgcttcagccagcccagacacatcagcgtggccatggacaagttcggcttcagcctgccctacgtgcagtacttcggcggcgtgagcgccctgagcaagcagcagttcctgaccatcaacggcttccccaacaactactggggctggggcggcgaggacgacgacatcttcaacagactggtgttcagaggcatgagcatcagcagacccaacgccgtggtgggcagatgcagaatgatcagacacagcagagacaagaagaacgagcccaacccccagagattcgacagaatcgcccacaccaaggagaccatgctgagcgacggcctgaacagcctgacctaccaggtgctggacgtgcagagataccccctgtacacccagatcaccgtggacatcggcacccccagctag

SEQ ID NO: 104552 - DNA, 438 bp, Artificial Sequence
  Description of Artificial Sequence: Synthetic coding sequence
atgaacgaccacaacgcctacagatgcttcagccagcccagacacatcagcgtggccatggacaagttcggcttcagcctgccctacgtgcagtacttcggcggcgtgagcgccctgagcaagcagcagttcctgaccatcaacggcttccccaacaactactggggctggggcggcgaggacgacgacatcttcaacagactggtgttcagaggcatgagcatcagcagacccaacgccgtggtgggcagatgcagaatgatcagacacagcagagacaagaagaacgagcccaacccccagagattcgacagaatcgcccacaccaaggagaccatgctgagcgacggcctgaacagcctgacctaccaggtgctggacgtgcagagataccccctgtacacccagatcaccgtggacatcggcacccccagctag

SEQ ID NO: 104553 - DNA, 1206 bp, Artificial Sequence
  Description of Artificial Sequence: Synthetic coding sequence
atggccgtggaggtgcaggagcagtggccctgcctgcccgccgccggctgccccggccccctgggcggccccgtggccgcctgcggcatgagcagactgctgggcggcaccctggagagagtgtgcaaggccgtgctgctgctgtgcctgctgcacttcctggtggccgtgatcctgtacttcgacgtgtacgcccagcacctggccttcttcagcagattcagcgccagaggccccgcccacgccctgcaccccgccgccagcagcagcagcagcagcagcaactgcagcagacccaacgccaccgccagcagcagcggcctgcccgaggtgcccagcgccctgcccggccccaccgcccccaccctgcccccctgccccgacagcccccccggcctggtgggcagactgctgatcgagttcaccagccccatgcccctggagagagtgcagagagagaaccccggcgtgctgatgggcggcagatacaccccccccgactgcacccccgcccagaccgtggccgtgatcatccccttcagacacagagagcaccacctgagatactggctgcactacctgcaccccatcctgagaagacagagactgagatacggcgtgtacgtgatcaaccagcacggcgaggacaccttcaacagagccaagctgctgaacgtgggcttcctggaggccctgaaggaggacgccgcctacgactgcttcatcttcagcgacgtggacctggtgcccatggacgacagaaacctgtacagatgcggcgaccagcccagacacttcgccatcgccatggacaagttcggcttcagactgccctacgccggctacttcggcggcgtgagcggcctgagcaaggcccagttcctgagaatcaacggcttccccaacgagtactggggctggggcggcgaggacgacgacatcttcaacagaatcagcctgaccggcatgaagatcagcagacccgacatcagaatcggcagatacagaatgatcaagcacgacagagacaagcacaacgagcccaacccccagagattcaccaagatccagaacaccaagctgaccatgaagagagacggcatcggcagcgtgagataccaggtgctggaggtgagcagacagcccctgttcaccaacatcaccgtggacatcggcagaccccccagctggccccccagaggctag

SEQ ID NO: 104554 - DNA, 1119 bp, Artificial Sequence
  Description of Artificial Sequence: Synthetic coding sequence
atgagcagactgctgggcggcaccctggagagagtgtgcaaggccgtgctgctgctgtgcctgctgcacttcctggtggccgtgatcctgtacttcgacgtgtacgcccagcacctggccttcttcagcagattcagcgccagaggccccgcccacgccctgcaccccgccgccagcagcagcagcagcagcagcaactgcagcagacccaacgccaccgccagcagcagcggcctgcccgaggtgcccagcgccctgcccggccccaccgcccccaccctgcccccctgccccgacagcccccccggcctggtgggcagactgctgatcgagttcaccagccccatgcccctggagagagtgcagagagagaaccccggcgtgctgatgggcggcagatacaccccccccgactgcacccccgcccagaccgtggccgtgatcatccccttcagacacagagagcaccacctgagatactggctgcactacctgcaccccatcctgagaagacagagactgagatacggcgtgtacgtgatcaaccagcacggcgaggacaccttcaacagagccaagctgctgaacgtgggcttcctggaggccctgaaggaggacgccgcctacgactgcttcatcttcagcgacgtggacctggtgcccatggacgacagaaacctgtacagatgcggcgaccagcccagacacttcgccatcgccatggacaagttcggcttcagactgccctacgccggctacttcggcggcgtgagcggcctgagcaaggcccagttcctgagaatcaacggcttccccaacgagtactggggctggggcggcgaggacgacgacatcttcaacagaatcagcctgaccggcatgaagatcagcagacccgacatcagaatcggcagatacagaatgatcaagcacgacagagacaagcacaacgagcccaacccccagagattcaccaagatccagaacaccaagctgaccatgaagagagacggcatcggcagcgtgagataccaggtgctggaggtgagcagacagcccctgttcaccaacatcaccgtggacatcggcagaccccccagctggccccccagaggctag

SEQ ID NO: 104555 - DNA, 1119 bp, Artificial Sequence; identical to SEQ ID NO: 104554
  Description of Artificial Sequence: Synthetic coding sequence

SEQ ID NO: 104556 - DNA, 921 bp, Artificial Sequence
  Description of Artificial Sequence: Synthetic coding sequence
atgcccagcacccagctgctggccgccgccgccgccgccgccaccgcccccggccccacccccccccccctggcccccggcagcctgagaagccccgtgccctgccccgtgcccagactgcccagatgccaccccgtgctgaccagacacctggtgctgagagtgcagagagagaaccccggcgtgctgatgggcggcagatacaccccccccgactgcacccccgcccagaccgtggccgtgatcatccccttcagacacagagagcaccacctgagatactggctgcactacctgcaccccatcctgagaagacagagactgagatacggcgtgtacgtgatcaaccagcacggcgaggacaccttcaacagagccaagctgctgaacgtgggcttcctggaggccctgaaggaggacgccgcctacgactgcttcatcttcagcgacgtggacctggtgcccatggacgacagaaacctgtacagatgcggcgaccagcccagacacttcgccatcgccatggacaagttcggcttcagactgccctacgccggctacttcggcggcgtgagcggcctgagcaaggcccagttcctgagaatcaacggcttccccaacgagtactggggctggggcggcgaggacgacgacatcttcaacagaatcagcctgaccggcatgaagatcagcagacccgacatcagaatcggcagatacagaatgatcaagcacgacagagacaagcacaacgagcccaacccccagagattcaccaagatccagaacaccaagctgaccatgaagagagacggcatcggcagcgtgagataccaggtgctggaggtgagcagacagcccctgttcaccaacatcaccgtggacatcggcagaccccccagctggccccccagaggctag

SEQ ID NO: 104557 - DNA, 441 bp, Artificial Sequence
  Description of Artificial Sequence: Synthetic coding sequence
atgctgagaagactgctggagagaccctgcaccctggccctgctggtgggcagccagctggccgtgatgatgtacctgagcctgggcggcttcagaagcctgagcgccctgttcggcagagaccagggccccaccttcgactacagccaccccagagacgtgtacagcaacctgagccacctgcccggcgcccccggcggcccccccgccccccagggcctgccctactgccccgagagaagccccctgctggtgggccccgtgagcgtgagcttcagccccgtgcccagcctggccgagatcgtggagagaaaccccagagtggagcccggcggcagatacagaccccccgccgccctgccccccgcccccctgctggccgcccccgccgcctgcctgtggcacctgtgccacccccccggctggaagtggaacatctag

SEQ ID NO: 104558 - DNA, 1182 bp, Artificial Sequence
  Description of Artificial Sequence: Synthetic coding sequence
atgctgagaagactgctggagagaccctgcaccctggccctgctggtgggcagccagctggccgtgatgatgtacctgagcctgggcggcttcagaagcctgagcgccctgttcggcagagaccagggccccaccttcgactacagccaccccagagacgtgtacagcaacctgagccacctgcccggcgcccccggcggcccccccgccccccagggcctgccctactgccccgagagaagccccctgctggtgggccccgtgagcgtgagcttcagccccgtgcccagcctggccgagatcgtggagagaaaccccagagtggagcccggcggcagatacagacccgccggctgcgagcccagaagcagaaccgccatcatcgtgccccacagagccagagagcaccacctgagactgctgctgtaccacctgcaccccttcctgcagagacagcagctggcctacggcatctacgtgatccaccaggccggcaacggcaccttcaacagagccaagctgctgaacgtgggcgtgagagaggccctgagagacgaggagtgggactgcctgttcctgcacgacgtggacctgctgcccgagaacgaccacaacctgtacgtgtgcgaccccagaggccccagacacgtggccgtggccatgaacaagttcggctacagcctgccctacccccagtacttcggcggcgtgagcgccctgacccccgaccagtacctgaagatgaacggcttccccaacgagtactggggctggggcggcgaggacgacgacatcgccaccagagtgagactggccggcatgaagatcagcagaccccccaccagcgtgggccactacaagatggtgaagcacagaggcgacaagggcaacgaggagaacccccacagattcgacctgctggtgagaacccagaacagctggacccaggacggcatgaacagcctgacctaccagctgctggccagagagctgggccccctgtacaccaacatcaccgccgacatcggcaccgaccccagaggccccagagcccccagcggccccagatacccccccggcagcagccaggccttcagacaggagatgctgcagagaagaccccccgccagacccggccccctgagcaccgccaaccacaccgccctgagaggcagccactag

SEQ ID NO: 104559 - DNA, 1182 bp, Artificial Sequence
  Description of Artificial Sequence: Synthetic coding sequence
atgctgagaagactgctggagagaccctgcaccctggccctgctggtgggcagccagctggccgtgatgatgtacctgagcctgggcggcttcagaagcctgagcgccctgttcggcagagaccagggccccaccttcgactacagccaccccagagacgtgtacagcaacctgagccacctgcccggcgcccccggcggcccccccgccccccagggcctgccctactgccccgagagaagccccctgctggtgggccccgtgagcgtgagcttcagccccgtgcccagcctggccgagatcgtggagagaaaccccagagtggagcccggcggcagatacagacccgccggctgcgagcccagaagcagaaccgccatcatcgtgccccacagagccagagagcaccacctgagactgctgctgtaccacctgcaccccttcctgcagagacagcagctggcctacggcatctacgtgatccaccaggccggcaacggcaccttcaacagagccaagctgctgaacgtgggcgtgagagaggccctgagagacgaggagtgggactgcctgttcctgcacgacgtggacctgctgcccgagaacgaccacaacctgtacgtgtgcgaccccagaggccccagacacgtggccgtggccatgaacaagttcggctacagcctgccctacccccagtacttcggcggcgtgagcgccctgacccccgaccagtacctgaagatgaacggcttccccaacgagtactggggctggggcggcgaggacgacgacatcgccaccagagtgagactggccggcatgaagatcagcagaccccccaccagcgtgggccactacaagatggtgaagcacagaggcgacaagggcaacgaggagaacccccacagattcgacctgctggtgagaacccagaacagctggacccaggacggcatgaacagcctgacctaccagctgctggccagagagctgggccccctgtacaccaacatcaccgccgacatcggcaccgaccccagaggccccagagcccccagcggccccagatacccccccggcagcagccaggccttcagacaggagatgctgcagagaagaccccccgccagacccggccccctgagcaccgccaaccacacccccagcgaggtgcacacctag

SEQ ID NO: 104560 - DNA, 1182 bp, Artificial Sequence; identical to SEQ ID NO: 104558
  Description of Artificial Sequence: Synthetic coding sequence

SEQ ID NO: 104561 - DNA, 1113 bp, Artificial Sequence
  Description of Artificial Sequence: Synthetic coding sequence
atgctgagaagactgctggagagaccctgcaccctggccctgttcggcagagaccagggccccaccttcgactacagccaccccagagacgtgtacagcaacctgagccacctgcccggcgcccccggcggcccccccgccccccagggcctgccctactgccccgagagaagccccctgctggtgggccccgtgagcgtgagcttcagccccgtgcccagcctggccgagatcgtggagagaaaccccagagtggagcccggcggcagatacagacccgccggctgcgagcccagaagcagaaccgccatcatcgtgccccacagagccagagagcaccacctgagactgctgctgtaccacctgcaccccttcctgcagagacagcagctggcctacggcatctacgtgatccaccaggccggcaacggcaccttcaacagagccaagctgctgaacgtgggcgtgagagaggccctgagagacgaggagtgggactgcctgttcctgcacgacgtggacctgctgcccgagaacgaccacaacctgtacgtgtgcgaccccagaggccccagacacgtggccgtggccatgaacaagttcggctacagcctgccctacccccagtacttcggcggcgtgagcgccctgacccccgaccagtacctgaagatgaacggcttccccaacgagtactggggctggggcggcgaggacgacgacatcgccaccagagtgagactggccggcatgaagatcagcagaccccccaccagcgtgggccactacaagatggtgaagcacagaggcgacaagggcaacgaggagaacccccacagattcgacctgctggtgagaacccagaacagctggacccaggacggcatgaacagcctgacctaccagctgctggccagagagctgggccccctgtacaccaacatcaccgccgacatcggcaccgaccccagaggccccagagcccccagcggccccagatacccccccggcagcagccaggccttcagacaggagatgctgcagagaagaccccccgccagacccggccccctgagcaccgccaaccacaccgccctgagaggcagccactag

SEQ ID NO: 104562 - DNA, 684 bp, Artificial Sequence
  Description of Artificial Sequence: Synthetic coding sequence
atgctgagaagactgctggagagaccctgcaccctggccctgctggtgggcagccagctggccgtgatgatgtacctgagcctgggcggcttcagaagcctgagcgccctgttcggcagagaccagggccccaccttcgactacagccaccccagagacgtgtacagcaacctgagccacctgcccggcgcccccggcggcccccccgccccccagggcctgccctactgccccgagagaagccccctgctggtgggccccgtgagcgtgagcttcagccccgtgcccagcctggccgagatcgtggagagaaaccccagagtggagcccggcggcagatacagacccgccggctgcgagcccagaagcagaaccgccatcatcgtgccccacagagccagagagcaccacctgagactgctgctgtaccacctgcaccccttcctgcagagacagcagctggcctacggcatctacgtgatccaccaggccggcaacggcaccttcaacagagccaagctgctgaacgtgggcgtgagagaggccctgagagacgaggagtgggactgcctgttcctgcacgacgtggacctgctgcccgagaacgaccacaacctgtacgtgtgcgaccccagaggccccagacacgtggccgtggccatgaacaagttcggctacagatag

SEQ ID NO: 104563 - DNA, 1035 bp, Artificial Sequence
  Description of Artificial Sequence: Synthetic coding sequence
atgggcttcaacctgaccttccacctgagctacaagttcagactgctgctgctgctgaccctgtgcctgaccgtggtgggctgggccaccagcaactacttcgtgggcgccatccaggagatccccaaggccaaggagttcatggccaacttccacaagaccctgatcctgggcaagggcaagaccctgaccaacgaggccagcaccaagaaggtggagctggacaactgccccagcgtgagcccctacctgagaggccagagcaagctgatcttcaagcccgacctgaccctggaggaggtgcaggccgagaaccccaaggtgagcagaggcagatacagaccccaggagtgcaaggccctgcagagagtggccatcctggtgccccacagaaacagagagaagcacctgatgtacctgctggagcacctgcaccccttcctgcagagacagcagctggactacggcatctacgtgatccaccaggccgagggcaagaagttcaacagagccaagctgctgaacgtgggctacctggaggccctgaaggaggagaactgggactgcttcatcttccacgacgtggacctggtgcccgagaacgacttcaacctgtacaagtgcgaggagcaccccaagcacctggtggtgggcagaaacagcaccggctacagactgagatacagcggctacttcggcggcgtgaccgccctgagcagagagcagttcttcaaggtgaacggcttcagcaacaactactggggctggggcggcgaggacgacgacctgagactgagagtggagctgcagagaatgaagatcagcagacccctgcccgaggtgggcaagtacaccatggtgttccacaccagagacaagggcaacgaggtgaacgccgagagaatgaagctgctgcaccaggtgagcagagtgtggagaaccgacggcctgagcagctgcagctacaagctggtgagcgtggagcacaaccccctgtacatcaacatcaccgtggacttctggttcggcgcctag

SEQ ID NO: 104564 - DNA, 1035 bp, Artificial Sequence; identical to SEQ ID NO: 104563
  Description of Artificial Sequence: Synthetic coding sequence

SEQ ID NO: 104565 - DNA, 21 bp, Artificial Sequence
  Description of Artificial Sequence: Synthetic coding sequence
atgggcttcaacctgacctag

SEQ ID NO: 104566 - DNA, 9 bp, Artificial Sequence
  Description of Artificial Sequence: Synthetic coding sequence
atgggctag

SEQ ID NO: 104567 - DNA, 168 bp, Artificial Sequence
  Description of Artificial Sequence: Synthetic coding sequence
atgggcttcaacctgaccttccacctgagctacaagttcagactgctgctgctgctgaccctgtgcctgaccgtggtgggctgggccaccagcaactacttcgtgggcgccatccaggagatccccaaggccaaggagttcatggccaacttccacaagaccctgtag

SEQ ID NO: 104568 - DNA, 66 bp, Artificial Sequence
  Description of Artificial Sequence: Synthetic coding sequence
atgggcttcaacctgaccttccacctgagctacaagttcagactgctgctgctgctgaccctgtag

SEQ ID NO: 104569 - DNA, 411 bp, Artificial Sequence
  Description of Artificial Sequence: Synthetic coding sequence
atgggcttcaacctgaccttccacctgagctacaagttcagactgctgctgctgctgaccctgtgcctgaccgtggtgggctgggccaccagcaactacttcgtgggcgccatccaggagatccccaaggccaaggagttcatggccaacttccacaagaccctgatcctgggcaagggcaagaccctgaccaacgaggccagcaccaagaaggtggagctggacaactgccccagcgtgagcccctacctgagaggccagagcaagctgatcttcaagcccgacctgaccctggaggaggtgcaggccgagaaccccaaggtgagcagaggcagatacagaccccaggagtgcaaggccctgcagagagtggccatcctggtgccccacagaaacagagagaagcactag

SEQ ID NO: 104570 - DNA, 357 bp, Artificial Sequence
  Description of Artificial Sequence: Synthetic coding sequence
atgggcttcaacctgaccttccacctgagctacaagttcagactgctgctgctgctgaccctgtgcctgaccgtggtgggctgggccaccagcaactacttcgtgggcgccatccaggagatccccaaggccaaggagttcatggccaacttccacaagaccctgatcctgggcaagggcaagaccctgaccaacgaggccagcaccaagaaggtggagctggacaactgccccagcgtgagcccctacctgagaggccagagcaagctgatcttcaagcccgacctgaccctggaggaggtgcaggccgagaaccccaaggtgagcagaggcagatacagaccccaggagtgctag

SEQ ID NO: 104571 - DNA, 1035 bp, Artificial Sequence; identical to SEQ ID NO: 104563
  Description of Artificial Sequence: Synthetic coding sequence

SEQ ID NO: 104572 - DNA, 129 bp, Artificial Sequence
  Description of Artificial Sequence: Synthetic coding sequence
atgggcttcaacctgaccttccacctgagctacaagttcagactgctgctgctgctgaccctgtgcctgaccgtggtgggctgggccaccagcaactacttcgtgggcgccatccaggagatcccctag

SEQ ID NO: 104573 - DNA, 1167 bp, Artificial Sequence
  Description of Artificial Sequence: Synthetic coding sequence
atgagagccagaagaggcctgctgagactgcccagaagaagcctgctggccgccctgttcttcttcagcctgagcagcagcctgctgtacttcgtgtacgtggcccccggcatcgtgaacacctacctgttcatgatgcaggcccagggcatcctgatcagagacaacgtgagaaccatcggcgcccaggtgtacgagcaggtgctgagaagcgcctacgccaagagaaacagcagcgtgaacgacagcgactaccccctggacctgaaccacagcgagaccttcctgcagaccaccaccttcctgcccgaggacttcacctacttcgccaaccacacctgccccgagagactgcccagcatgaagggccccatcgacatcaacatgagcgagatcggcatggactacatccacgagctgttcagcaaggaccccaccatcaagctgggcggccactggaagcccagcgactgcatgcccagatggaaggtggccatcctgatccccttcagaaacagacacgagcacctgcccgtgctgttcagacacctgctgcccatgctgcagagacagagactgcagttcgccttctacgtggtggagcaggtgggcacccagcccttcaacagagccatgctgttcaacgtgggcttccaggaggccatgaaggacctggactgggactgcctgatcttccacgacgtggaccacatccccgagagcgacagaaactactacggctgcggccagatgcccagacacttcgccaccaagctggacaagtacatgtacctgctgccctacaccgagttcttcggcggcgtgagcggcctgaccgtggagcagttcagaaagatcaacggcttccccaacgccttctggggctggggcggcgaggacgacgacctgtggaacagagtgcagaacgccggctacagcgtgagcagacccgagggcgacaccggcaagtacaagagcatcccccaccaccacagaggcgaggtgcagttcctgggcagatacgccctgctgagaaagagcaaggagagacagggcctggacggcctgaacaacctgaactacttcgccaacatcacctacgacgccctgtacaagaacatcaccgtgaacctgacccccgagctggcccaggtgaacgagtactag

SEQ ID NO: 104574 - DNA, 1032 bp, Artificial Sequence
  Description of Artificial Sequence: Synthetic coding sequence
atgagcgtgctgagaagaatgatgagagtgagcaacagaagcctgctggccttcatcttcttcttcagcctgagcagcagctgcctgtacttcatctacgtggcccccggcatcgactaccccgagggcaacaacagcagcgactacctggtgcagaccaccacctacctgcccgagaacttcacctacagcccctacctgccctgccccgagaagctgccctacatgagaggcttcctgaacgtgaacgtgagcgaggtgagcttcgacgagatccaccagctgttcagcaaggacctggacatcgagcccggcggccactggagacccaaggactgcaagcccagatggaaggtggccgtgctgatccccttcagaaacagacacgagcacctgcccatcttcttcctgcacctgatccccatgctgcagaagcagagactggagttcgccttctacgtgatcgagcagaccggcacccagcccttcaacagagccatgctgttcaacgtgggcttcaaggaggccatgaaggacagcgtgtgggactgcgtgatcttccacgacgtggaccacctgcccgagaacgacagaaactactacggctgcggcgagatgcccagacacttcgccgccaagctggacaagtacatgtacatcctgccctacaaggagttcttcggcggcgtgagcggcctgaccgtggagcagttcagaaagatcaacggcttccccaacgccttctggggctggggcggcgaggacgacgacctgtggaacagagtgcactacgccggctacaacgtgaccagacccgagggcgacctgggcaagtacaagagcatcccccaccaccacagaggcgaggtgcagttcctgggcagatacaagctgctgagatacagcaaggagagacagtacatcgacggcctgaacaacctgatctacagacccaagatcctggtggacagactgtacaccaacatcagcgtgaacctgatgcccgagctggcccccatcgaggactactag

SEQ ID NO: 104575 - DNA, 1149 bp, Artificial Sequence
  Description of Artificial Sequence: Synthetic coding sequence
atgagcgtgctgagaagaatgatgagagtgagcaacagaagcctgctggccttcatcttcttcttcagcctgagcagcagctgcctgtacttcatctacgtggcccccggcatcgccaacacctacctgttcatggtgcaggccagaggcatcatgctgagagagaacgtgaagaccatcggccacatgatcagactgtacaccaacaagaacagcaccctgaacggcaccgactaccccgagggcaacaacagcagcgactacctggtgcagaccaccacctacctgcccgagaacttcacctacagcccctacctgccctgccccgagaagctgccctacatgagaggcttcctgaacgtgaacgtgagcgaggtgagcttcgacgagatccaccagctgttcagcaaggacctggacatcgagcccggcggccactggagacccaaggactgcaagcccagatggaaggtggccgtgctgatccccttcagaaacagacacgagcacctgcccatcttcttcctgcacctgatccccatgctgcagaagcagagactggagttcgccttctacgtgatcgagcagaccggcacccagcccttcaacagagccatgctgttcaacgtgggcttcaaggaggccatgaaggacagcgtgtgggactgcgtgatcttccacgacgtggaccacctgcccgagaacgacagaaactactacggctgcggcgagatgcccagacacttcgccgccaagctggacaagtacatgtacatcctgccctacaaggagttcttcggcggcgtgagcggcctgaccgtggagcagttcagaaagatcaacggcttccccaacgccttctggggctggggcggcgaggacgacgacctgtggaacagagtgcactacgccggctacaacgtgaccagacccgagggcgacctgggcaagtacaagagcatcccccaccaccacagaggcgaggtgcagttcctgggcagatacaagctgctgagatacagcaaggagagacagtacatcgacggcctgaacaacctgatctacagacccaagatcctggtggacagactgtacaccaacatcagcgtgaacctgatgcccgagctggcccccatcgaggactactag

SEQ ID NO: 104576 - DNA, 1032 bp, Artificial Sequence
  Description of Artificial Sequence: Synthetic coding sequence
atgagcgtgctgagaagaatgatgagagtgagcaacagaagcctgctggccttcatcttcttcttcagcctgagcagcagctgcctgtacttcatctacgtggcccccggcatcgccaacacctacctgttcatggtgcaggccagaggcatcatgctgagagagaacgtgaagaccatcggccacatgatcagactgtacaccaacaagaacagcaccctgaacggcaccgactaccccgagggcaacaacagcagcgactacctggtgcagaccaccacctacctgcccgagaacttcacctacagcccctacctgccctgccccgagaagctgccctacatgagaggcttcctgaacgtgaacgtgagcgaggtgagcttcgacgagatccaccagctgttcagcaaggacctggacatcgagcccggcggccactggagacccaaggactgcaagcccagatggaagaccggcacccagcccttcaacagagccatgctgttcaacgtgggcttcaaggaggccatgaaggacagcgtgtgggactgcgtgatcttccacgacgtggaccacctgcccgagaacgacagaaactactacggctgcggcgagatgcccagacacttcgccgccaagctggacaagtacatgtacatcctgccctacaaggagttcttcggcggcgtgagcggcctgaccgtggagcagttcagaaagatcaacggcttccccaacgccttctggggctggggcggcgaggacgacgacctgtggaacagagtgcactacgccggctacaacgtgaccagacccgagggcgacctgggcaagtacaagagcatcccccaccaccacagaggcgaggtgcagttcctgggcagatacaagctgctgagatacagcaaggagagacagtacatcgacggcctgaacaacctgatctacagacccaagatcctggtggacagactgtacaccaacatcagcgtgaacctgatgcccgagctggcccccatcgaggactactag

SEQ ID NO: 104577 - DNA, 1047 bp, Artificial Sequence
  Description of Artificial Sequence: Synthetic coding sequence
atggccgagaaggtgctggtgaccggcggcgccggctacatcggcagccacaccgtgctggagctgctggaggccggctacctgcccgtggtgatcgacaacttccacaacgccttcagaggcggcggcagcctgcccgagagcctgagaagagtgcaggagctgaccggcagaagcgtggagttcgaggagatggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagcggctgcatcggcgaggacccccagggcatccccaacaacctgatgccctacgtgagccaggtggccatcggcagaagagaggccctgaacgtgttcggcaacgactacgacaccgaggacggcaccggcgtgagagactacatccacgtggtggacctggccaagggccacatcgccgccctgagaaagctgaaggagcagtgcggctgcagaatctacaacctgggcaccggcaccggctacagcgtgctgcagatggtgcaggccatggagaaggccagcggcaagaagatcccctacaaggtggtggccagaagagagggcgacgtggccgcctgctacgccaaccccagcctggcccaggaggagctgggctggaccgccgccctgggcctggacagaatgtgcgaggacctgtggagatggcagaagcagaaccccagcggcttcggcacccaggcctag

SEQ ID NO: 104578 - DNA, 777 bp, Artificial Sequence
  Description of Artificial Sequence: Synthetic coding sequence
atggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagcggctgcatcggcgaggacccccagggcatccccaacaacctgatgccctacgtgagccaggtggccatcggcagaagagaggccctgaacgtgttcggcaacgactacgacaccgaggacggcaccggcgtgagagactacatccacgtggtggacctggccaagggccacatcgccgccctgagaaagctgaaggagcagtgcggctgcagaatcccctacaaggtggtggccagaagagagggcgacgtggccgcctgctacgccaaccccagcctggcccaggaggagctgggctggaccgccgccctgggcctggacagaatgtgcgaggacctgtggagatggcagaagcagaaccccagcggcttcggcacccaggcctag

SEQ ID NO: 104579 - DNA, 684 bp, Artificial Sequence
  Description of Artificial Sequence: Synthetic coding sequence
atggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagcggctgcatcggcgaggacccccagggcatccccaacaacctgatgccctacgtgagccaggtggccatcggcagaagagaggccctgaacgtgttcggcaacgactacgacaccgaggacggcaccggcgtgagagactacatccacgtggtggacctggccaagggccacatcgccgccctgagaaagctgaaggagcagtgcggctgcagaatctacaacctgggcaccggcaccggctacagcgtgctgcagatggtgcaggccatggagaaggccagcggcaagaagtag

SEQ ID NO: 104580 - DNA, 588 bp, Artificial Sequence
  Description of Artificial Sequence: Synthetic coding sequence
atggccgagaaggtgctggtgaccggcggcgccggctacatcggcagccacaccgtgctggagctgctggaggccggctacctgcccgtggtgatcgacaacttccacaacgccttcagaggcggcggcagcctgcccgagagcctgagaagagtgcaggagctgaccggcagaagcgtggagttcgaggagatggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagcggctag

SEQ ID NO: 104581 - DNA, 720 bp, Artificial Sequence
  Description of Artificial Sequence: Synthetic coding sequence
atggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagcggctgcatcggcgaggacccccagggcatccccaacaacctgatgccctacgtgagccaggtggccatcggcagaagagaggccctgaacgtgttcggcaacgactacgacaccgaggacggcaccggcgtgagagactacatccacgtggtggacctggccaagggccacatcgccgccctgagaaagctgaaggagcagtgcggctgcagaatcccctacaaggtggtggccagaagagagggcgacgtggccgcctgctacgccaaccccagcctggcccaggaggagctgggctggaccgccgccctgggcctggacagaatgtag

SEQ ID NO: 104582 - DNA, 585 bp, Artificial Sequence
  Description of Artificial Sequence: Synthetic coding sequence
atggccgagaaggtgctggtgaccggcggcgccggctacatcggcagccacaccgtgctggagctgctggaggccggctacctgcccgtggtgatcgacaacttccacaacgccttcagaggcggcggcagcctgcccgagagcctgagaagagtgcaggagctgaccggcagaagcgtggagttcgaggagatggacatcctggaccagggcgccctgcagagactgttcaagaagtacagcttcatggccgtgatccacttcgccggcctgaaggccgtgggcgagagcgtgcagaagcccctggactactacagagtgaacctgaccggcaccatccagctgctggagatcatgaaggcccacggcgtgaagaacctggtgttcagcagcagcgccaccgtgtacggcaacccccagtacctgcccctggacgaggcccaccccaccggcggctgcaccaacccctacggcaagagcaagttcttcatcgaggagatgatcagagacctgtgccaggccgacaagacctggaacgccgtgctgctgagatacttcaaccccaccggcgcccacgccagctag

SEQ ID NO: 104583 - DNA, 327 bp, Artificial Sequence
  Description of Artificial Sequence: Synthetic coding sequence
gtggccatcggcagaagagaggccctgaacgtgttcggcaacgactacgacaccgaggacggcaccggcgtgagagactacatccacgtggtggacctggccaagggccacatcgccgccctgagaaagctgaaggagcagtgcggctgcagaatcccctacaaggtggtggccagaagagagggcgacgtggccgcctgctacgccaaccccagcctggcccaggaggagctgggctggaccgccgccctgggcctggacagaatgtgcgaggacctgtggagatggcagaagcagaaccccagcggcttcggcacccaggcctag

SEQ ID NO: 104584 - DNA, 1119 bp, Artificial Sequence
  Description of Artificial Sequence: Synthetic coding sequence
atgaagtacctgagacacagaagacccaacgccaccctgatcctggccatcggcgccttcaccctgctgctgttcagcctgctggtgagcccccccacctgcaaggtgcaggagcagccccccgccatccccgaggccctggcctggcccaccccccccaccagacccgcccccgccccctgccacgccaacaccagcatggtgacccaccccgacttcgccacccagccccagcacgtgcagaacttcctgctgtacagacactgcagacacttccccctgctgcaggacgtgccccccagcaagtgcgcccagcccgtgttcctgctgctggtgatcaagagcagccccagcaactacgtgagaagagagctgctgagaagaacctggggcagagagagaaaggtgagaggcctgcagctgagactgctgttcctggtgggcaccgccagcaacccccacgaggccagaaaggtgaacagactgctggagctggaggcccagacccacggcgacatcctgcagtgggacttccacgacagcttcttcaacctgaccctgaagcaggtgctgttcctgcagtggcaggagaccagatgcgccaacgccagcttcgtgctgaacggcgacgacgacgtgttcgcccacaccgacaacatggtgttctacctgcaggaccacgaccccggcagacacctgttcgtgggccagctgatccagaacgtgggccccatcagagccttctggagcaagtactacgtgcccgaggtggtgacccagaacgagagataccccccctactgcggcggcggcggcttcctgctgagcagattcaccgccgccgccctgagaagagccgcccacgtgctggacatcttccccatcgacgacgtgttcctgggcatgtgcctggagctggagggcctgaagcccgccagccacagcggcatcagaaccagcggcgtgagagcccccagccagagactgagcagcttcgacccctgcttctacagagacctgctgctggtgcacagattcctgccctacgagatgctgctgatgtgggacgccctgaaccagcccaacctgacctgcggcaaccagacccagatctactag

SEQ ID NO: 104585 - DNA, 1137 bp, Artificial Sequence
  Description of Artificial Sequence: Synthetic coding sequence
atgctgcccccccagcccagcgccgcccaccagggcagaggcggcagaagcggcctgctgcccaagggccccgccatgctgtgcagactgtgctggctggtgagctacagcctggccgtgctgctgctgggctgcctgctgttcctgagaaaggccgccaagcccgccggcgaccccaccgcccaccagcccttctgggccccccccacccccagacacagcagatgcccccccaaccacaccgtgagcagcgccagcctgagcctgcccagcagacacagactgttcctgacctacagacactgcagaaacttcagcatcctgctggagcccagcggctgcagcaaggacaccttcctgctgctggccatcaagagccagcccggccacgtggagagaagagccgccatcagaagcacctggggcagagtgggcggctgggccagaggcagacagctgaagctggtgttcctgctgggcgtggccggcagcgccccccccgcccagctgctggcctacgagagcagagagttcgacgacatcctgcagtgggacttcaccgaggacttcttcaacctgaccctgaaggagctgcacctgcagagatgggtggtggccgcctgcccccaggcccacttcatgctgaagggcgacgacgacgtgttcgtgcacgtgcccaacgtgctggagttcctggacggctgggaccccgcccaggacctgctggtgggcgacgtgatcagacaggccctgcccaacagaaacaccaaggtgaagtacttcatcccccccagcatgtacagagccacccactaccccccctacgccggcggcggcggctacgtgatgagcagagccaccgtgagaagactgcaggccatcatggaggacgccgagctgttccccatcgacgacgtgttcgtgggcatgtgcctgagaagactgggcctgagccccatgcaccacgccggcttcaagaccttcggcatcagaagacccctggaccccctggacccctgcctgtacagaggcctgctgctggtgcacagactgagccccctggagatgtggaccatgtgggccctggtgaccgacgagggcctgaagtgcgccgccggccccatcccccagagatag

SEQ ID NO: 104586 - DNA, 1062 bp, Artificial Sequence
  Description of Artificial Sequence: Synthetic coding sequence
atgctgtgcagactgtgctggctggtgagctacagcctggccgtgctgctgctgggctgcctgctgttcctgagaaaggccgccaagcccgccggcgaccccaccgcccaccagcccttctgggccccccccacccccagacacagcagatgcccccccaaccacaccgtgagcagcgccagcctgagcctgcccagcagacacagactgttcctgacctacagacactgcagaaacttcagcatcctgctggagcccagcggctgcagcaaggacaccttcctgctgctggccatcaagagccagcccggccacgtggagagaagagccgccatcagaagcacctggggcagagtgggcggctgggccagaggcagacagctgaagctggtgttcctgctgggcgtggccggcagcgccccccccgcccagctgctggcctacgagagcagagagttcgacgacatcctgcagtgggacttcaccgaggacttcttcaacctgaccctgaaggagctgcacctgcagagatgggtggtggccgcctgcccccaggcccacttcatgctgaagggcgacgacgacgtgttcgtgcacgtgcccaacgtgctggagttcctggacggctgggaccccgcccaggacctgctggtgggcgacgtgatcagacaggccctgcccaacagaaacaccaaggtgaagtacttcatcccccccagcatgtacagagccacccactaccccccctacgccggcggcggcggctacgtgatgagcagagccaccgtgagaagactgcaggccatcatggaggacgccgagctgttccccatcgacgacgtgttcgtgggcatgtgcctgagaagactgggcctgagccccatgcaccacgccggcttcaagaccttcggcatcagaagacccctggaccccctggacccctgcctgtacagaggcctgctgctggtgcacagactgagccccctggagatgtggaccatgtgggccctggtgaccgacgagggcctgaagtgcgccgccggccccatcccccagagatag

SEQ ID NO: 104587 - DNA, 1062 bp, Artificial Sequence; identical to SEQ ID NO: 104586
  Description of Artificial Sequence: Synthetic coding sequence

SEQ ID NO: 104588 - DNA, 1485 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgttcatcagcgtgaacacccccaccaagacctacggcatgggcaagggcagagccgccgacctgaagtacatcgaggcctgcgccagaagaatcgtgcagaacagcaacggctacaagatcgtgaccgagaagagcaccgtgcccgtgagagccgccgagagcatcagaagaatcttcgacgccaacaccaagcccaacctgaacctgcaggtgctgagcaaccccgagttcctggccgagggcaccgccatcaaggacctgaagaaccccgacagagtgctgatcggcggcgacgagacccccgagggccagagagccgtgcaggccctgtgcgccgtgtacgagcactgggtgcccagagagaagatcctgaccaccaacacctggagcagcgagctgagcaagctggccgccaacgccttcctggcccagagaatcagcagcatcaacagcatcagcgccctgtgcgaggccaccggcgccgacgtggaggaggtggccaccgccatcggcatggaccagagaatcggcaacaagttcctgaaggccagcgtgggcttcggcggcagctgcttccagaaggacgtgctgaacctggtgtacctgtgcgaggccctgaacctgcccgaggtggccagatactggcagcaggtgatcgacatgaacgactaccagagaagaagattcgccagcagaatcatcgacagcctgttcaacaccgtgaccgacaagaagatcgccatcctgggcttcgccttcaagaaggacaccggcgacaccagagagagcagcagcatctacatcagcaagtacctgatggacgagggcgcccacctgcacatctacgaccccaaggtgcccagagagcagatcgtggtggacctgagccaccccggcgtgagcgaggacgaccaggtgagcagactggtgaccatcagcaaggacccctacgaggcctgcgacggcgcccacgccgtggtgatctgcaccgagtgggacatgttcaaggagctggactacgagagaatccacaagaagatgctgaagcccgccttcatcttcgacggcagaagagtgctggacggcctgcacaacgagctgcagaccatcggcttccagatcgagaccatcggcaagaaggtgagcagcaagagaatcccctacgcccccagcggcgagatccccaagttcagcctgcaggacccccccaacaagaagcccaaggtgtag

SEQ ID NO: 104589 - DNA, 1284 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgttcatcagcgtgctgagcaaccccgagttcctggccgagggcaccgccatcaaggacctgaagaaccccgacagagtgctgatcggcggcgacgagacccccgagggccagagagccgtgcaggccctgtgcgccgtgtacgagcactgggtgcccagagagaagatcctgaccaccaacacctggagcagcgagctgagcaagctggccgccaacgccttcctggcccagagaatcagcagcatcaacagcatcagcgccctgtgcgaggccaccggcgccgacgtggaggaggtggccaccgccatcggcatggaccagagaatcggcaacaagttcctgaaggccagcgtgggcttcggcggcagctgcttccagaaggacgtgctgaacctggtgtacctgtgcgaggccctgaacctgcccgaggtggccagatactggcagcaggtgatcgacatgaacgactaccagagaagaagattcgccagcagaatcatcgacagcctgttcaacaccgtgaccgacaagaagatcgccatcctgggcttcgccttcaagaaggacaccggcgacaccagagagagcagcagcatctacatcagcaagtacctgatggacgagggcgcccacctgcacatctacgaccccaaggtgcccagagagcagatcgtggtggacctgagccaccccggcgtgagcgaggacgaccaggtgagcagactggtgaccatcagcaaggacccctacgaggcctgcgacggcgcccacgccgtggtgatctgcaccgagtgggacatgttcaaggagctggactacgagagaatccacaagaagatgctgaagcccgccttcatcttcgacggcagaagagtgctggacggcctgcacaacgagctgcagaccatcggcttccagatcgagaccatcggcaagaaggtgagcagcaagagaatcccctacgcccccagcggcgagatccccaagttcagcctgcaggacccccccaacaagaagcccaaggtgtag

SEQ ID NO: 104590 - DNA, 168 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgaggactag

SEQ ID NO: 104591 - DNA, 258 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgtag

SEQ ID NO: 104592 - DNA, 1485 bp, Artificial Sequence; identical to SEQ ID NO: 104588
  Description of Artificial Sequence: Synthetic coding sequence

SEQ ID NO: 104593 - DNA, 1194 bp, Artificial Sequence
  Description of Artificial Sequence: Synthetic coding sequence
atgggcaagggcagagccgccgacctgaagtacatcgaggcctgcgccagaagaatcgtgcagaacagcaacggctacaagatcgtgaccgagaagagcaccgtgcccgtgagagccgccgagagcatcagaagaatcttcgacgccaacaccaagcccaacctgaacctgcaggtgctgagcaaccccgagttcctggccgagggcaccgccatcaaggacctgaagaaccccgacagagtgctgatcggcggcgacgagacccccgagggccagagagccgtgcaggccctgtgcgccgtgtacgagcactgggtgcccagagagaagatcctgaccaccaacacctggagcagcgagctgagcaagctggccgccaacgccttcctggcccagagaatcagcagcatcaacagcatcagcgccctgtgcgaggccaccggcgccgacgtggaggaggtggccaccgccatcggcatggaccagagaatcggcaacaagttcctgaaggccagcgtgggcttcggcggcagctgcttccagaaggacgtgctgaacctggtgtacctgtgcgaggccctgaacctgcccgaggtggccagatactggcagcaggtgatcgacatgaacgactaccagagaagaagattcgccagcagaatcatcgacagcctgttcaacaccgtgaccgacaagaagatcgccatcctgggcttcgccttcaagaaggacaccggcgacaccagagagagcagcagcatctacatcagcaagtacctgatggacgagggcgcccacctgcacatctacgaccccaaggtgcccagagagcagatcgtggtggacctgagccaccccggcgtgagcgaggacgaccaggtgagcagactggtgaccatcagcaaggacccctacgaggcctgcgacggcgcccacgccgtggtgatctgcaccgagtgggacatgttcaaggagctggactacgagagaatccacaagaagatgctgaagcccgccttcatcttcgacggcagaagagtgctggacggcctgcacaacgagctgcagaccatcggcttccagatcgagaccatcggcaagaaggtgagcagcaagagaatcccctacgcccccagcggcgagatccccaagttcagcctgcaggacccccccaacaagaagcccaaggtgtag

SEQ ID NO: 104594 - DNA, 393 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgttcatcagcgtgaacacccccaccaagacctacggcatgggcaagggcagagccgccgacctgaagtacatcgaggcctgcgccagaagaatcgtgcagaacagcaacggctacaagatcgtgaccgagaagagctag

SEQ ID NO: 104595 - DNA, 162 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctactag

SEQ ID NO: 104596 - DNA, 168 bp, Artificial Sequence; identical to SEQ ID NO: 104590
  Description of Artificial Sequence: Synthetic coding sequence

SEQ ID NO: 104597 - DNA, 462 bp, Artificial Sequence
  Description of Artificial Sequence: Synthetic coding sequence
atgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgttcatcagcgtgaacacccccaccaagacctacggcatgggcaagggcagagccgccgacctgaagtacatcgaggcctgcgccagaagaatcgtgcagaacagcaacggctacaagatcgtgaccgagaagagcaccgtgcccgtgagagccgccgagagcatcagaagaatcttcgacgccaacaccaagcccaacctgaactag

SEQ ID NO: 104598 - DNA, 546 bp, Artificial Sequence
  Description of Artificial Sequence: Synthetic coding sequence
atgtggagcagcggcctgctgatccaggacagcaccatcatgttcgagatcaagaagatctgctgcatcggcgccggctacgtgggcggccccacctgcagcgtgatcgcccacatgtgccccgagatcagagtgaccgtggtggacgtgaacgagagcagaatcaacgcctggaacagccccaccctgcccatctacgagcccggcctgaaggaggtggtggagagctgcagaggcaagaacctgttcttcagcaccaacatcgacgacgccatcaaggaggccgacctggtgttcatcagcgtgaacacccccaccaagacctacggcatgggcaagggcagagccgccgacctgaagtacatcgaggcctgcgccagaagaatcgtgcagaacagcaacggctacaagatcgtgaccgagaagagcaccgtgcccgtgagagccgccgagagcatcagaagaatcttcgacgccaacaccaagcccaacctgaacctgcaggtgctgagcaaccccgagttcctggccgagggcaccgcctag

SEQ ID NO: 104599 - DNA, 1185 bp, Artificial Sequence
  Description of Artificial Sequence: Synthetic coding sequence
atggccctgctggacctggccctggagggcatggccgtgttcggcttcgtgctgttcctggtgctgtggctgatgcacttcatggccatcatctacaccagactgcacctgaacaagaaggccaccgacaagcagccctacagcaagctgcccggcgtgagcctgctgaagcccctgaagggcgtggaccccaacctgatcaacaacctggagaccttcttcgagctggactaccccaagtacgaggtgctgctgtgcgtgcaggaccacgacgaccccgccatcgacgtgtgcaagaagctgctgggcaagtaccccaacgtggacgccagactgttcatcggcggcaagaaggtgggcatcaaccccaagatcaacaacctgatgcccggctacgaggtggccaagtacgacctgatctggatctgcgacagcggcatcagagtgatccccgacaccctgaccgacatggtgaaccagatgaccgagaaggtgggcctggtgcacggcctgccctacgtggccgacagacagggcttcgccgccaccctggagcaggtgtacttcggcaccagccaccccagatactacatcagcgccaacgtgaccggcttcaagtgcgtgaccggcatgagctgcctgatgagaaaggacgtgctggaccaggccggcggcctgatcgccttcgcccagtacatcgccgaggactacttcatggccaaggccatcgccgacagaggctggagattcgccatgagcacccaggtggccatgcagaacagcggcagctacagcatcagccagttccagagcagaatgatcagatggaccaagctgagaatcaacatgctgcccgccaccatcatctgcgagcccatcagcgagtgcttcgtggccagcctgatcatcggctgggccgcccaccacgtgttcagatgggacatcatggtgttcttcatgtgccactgcctggcctggttcatcttcgactacatccagctgagaggcgtgcagggcggcaccctgtgcttcagcaagctggactacgccgtggcctggttcatcagagagagcatgaccatctacatcttcctgagcgccctgtgggaccccaccatcagctggagaaccggcagatacagactgagatgcggcggcaccgccgaggagatcctggacgtgtag

SEQ ID NO: 104600 - DNA, 4668 bp, Artificial Sequence
  Description of Artificial Sequence: Synthetic coding sequence
atgggctgcaagggcgacgccagcggcgcctgcgccgccggcgccctgcccgtgaccggcgtgtgctacaagatgggcgtgctggtggtgctgaccgtgctgtggctgttcagcagcgtgaaggccgacagcaaggccatcaccaccagcctgaccaccaagtggttcagcacccccctgctgctggaggccagcgagttcctggccgaggacagccaggagaagttctggaacttcgtggaggccagccagaacatcggcagcagcgaccacgacggcaccgactacagctactaccacgccatcctggaggccgccttccagttcctgagccccctgcagcagaacctgttcaagttctgcctgagcctgagaagctacagcgccaccatccaggccttccagcagatcgccgccgacgagcccccccccgagggctgcaacagcttcttcagcgtgcacggcaagaagacctgcgagagcgacaccctggaggccctgctgctgaccgccagcgagagacccaagcccctgctgttcaagggcgaccacagataccccagcagcaaccccgagagccccgtggtgatcttctacagcgagatcggcagcgaggagttcagcaacttccacagacagctgatcagcaagagcaacgccggcaagatcaactacgtgttcagacactacatcttcaaccccagaaaggagcccgtgtacctgagcggctacggcgtggagctggccatcaagagcaccgagtacaaggccaaggacgacacccaggtgaagggcaccgaggtgaacaccaccgtgatcggcgagaacgaccccatcgacgaggtgcagggcttcctgttcggcaagctgagagacctgcaccccgacctggagggccagctgaaggagctgagaaagcacctggtggagagcaccaacgagatggcccccctgaaggtgtggcagctgcaggacctgagcttccagaccgccgccagaatcctggccagccccgtggagctggccctggtggtgatgaaggacctgagccagaacttccccaccaaggccagagccatcaccaagaccgccgtgagcagcgagctgagaaccgaggtggaggagaaccagaagtacttcaagggcaccctgggcctgcagcccggcgacagcgccctgttcatcaacggcctgcacatggacctggacacccaggacatcttcagcctgttcgacgtgctgagaaacgaggccagagtgatggagggcctgcacagactgggcatcgagggcctgagcctgcacaacgtgctgaagctgaacatccagcccagcgaggccgactacgccgtggacatcagaagccccgccatcagctgggtgaacaacctggaggtggacagcagatacaacagctggcccagcagcctgcaggagctgctgagacccaccttccccggcgtgatcagacagatcagaaagaacctgcacaacatggtgttcatcgtggaccccgcccacgagaccaccgccgagctgatgaacaccgccgagatgttcctgagcaaccacatccccctgagaatcggcttcatcttcgtggtgaacgacagcgaggacgtggacggcatgcaggacgccggcgtggccgtgctgagagcctacaactacgtggcccaggaggtggacgactaccacgccttccagaccctgacccacatctacaacaaggtgagaaccggcgagaaggtgaaggtggagcacgtggtgagcgtgctggagaagaagtacccctacgtggaggtgaacagcatcctgggcatcgacagcgcctacgacagaaacagaaaggaggccagaggctactacgagcagaccggcgtgggccccctgcccgtggtgctgttcaacggcatgcccttcgagagagagcagctggaccccgacgagctggagaccatcaccatgcacaagatcctggagaccaccaccttcttccagagagccgtgtacctgggcgagctgccccacgaccaggacgtggtggagtacatcatgaaccagcccaacgtggtgcccagaatcaacagcagaatcctgaccgccgagagagactacctggacctgaccgccagcaacaacttcttcgtggacgactacgccagattcaccatcctggacagccagggcaagaccgccgccgtggccaacagcatgaactacctgaccaagaagggcatgagcagcaaggagatctacgacgacagcttcatcagacccgtgaccttctggatcgtgggcgacttcgacagccccagcggcagacagctgctgtacgacgccatcaagcaccagaagagcagcaacaacgtgagaatcagcatgatcaacaaccccgccaaggagatcagctacgagaacacccagatcagcagagccatctgggccgccctgcagacccagaccagcaacgccgccaagaacttcatcaccaagatggccaaggagggcgccgccgaggccctggccgccggcgccgacatcgccgagttcagcgtgggcggcatggacttcagcctgttcaaggaggtgttcgagagcagcaagatggacttcatcctgagccacgccgtgtactgcagagacgtgctgaagctgaagaagggccagagagccgtgatcagcaacggcagaatcatcggccccctggaggacagcgagctgttcaaccaggacgacttccacctgctggagaacatcatcctgaagaccagcggccagaagatcaagagccacatccagcagctgagagtggaggaggacgtggccagcgacctggtgatgaaggtggacgccctgctgagcgcccagcccaagggcgaccccagaatcgagtaccagttcttcgaggacagacacagcgccatcaagctgagacccaaggagggcgagacctacttcgacgtggtggccgtggtggaccccgtgaccagagaggcccagagactggcccccctgctgctggtgctggcccagctgatcaacatgaacctgagagtgttcatgaactgccagagcaagctgagcgacatgcccctgaagagcttctacagatacgtgctggagcccgagatcagcttcaccagcgacaacagcttcgccaagggccccatcgccaagttcctggacatgccccagagccccctgttcaccctgaacctgaacacccccgagagctggatggtggagagcgtgagaaccccctacgacctggacaacatctacctggaggaggtggacagcgtggtggccgccgagtacgagctggagtacctgctgctggagggccactgctacgacatcaccaccggccagccccccagaggcctgcagttcaccctgggcaccagcgccaaccccgtgatcgtggacaccatcgtgatggccaacctgggctacttccagctgaaggccaaccccggcgcctggatcctgagactgagaaagggcagaagcgaggacatctacagaatctacagccacgacggcaccgacagcccccccgacgccgacgaggtggtgatcgtgctgaacaacttcaagagcaagatcatcaaggtgaaggtgcagaagaaggccgacatggtgaacgaggacctgctgagcgacggcaccagcgagaacgagagcggcttctgggacagcttcaagtggggcttcaccggccagaagaccgaggaggtgaagcaggacaaggacgacatcatcaacatcttcagcgtggccagcggccacctgtacgagagattcctgagaatcatgatgctgagcgtgctgaagaacaccaagacccccgtgaagttctggttcctgaagaactacctgagccccaccttcaaggagttcatcccctacatggccaacgagtacaacttccagtacgagctggtgcagtacaagtggcccagatggctgcaccagcagaccgagaagcagagaatcatctggggctacaagatcctgttcctggacgtgctgttccccctggtggtggacaagttcctgttcgtggacgccgaccagatcgtgagaaccgacctgaaggagctgagagacttcaacctggacggcgccccctacggctacacccccttctgcgacagcagaagagagatggacggctacagattctggaagagcggctactgggccagccacctggccggcagaaagtaccacatcagcgccctgtacgtggtggacctgaagaagttcagaaagatcgccgccggcgacagactgagaggccagtaccagggcctgagccaggaccccaacagcctgagcaacctggaccaggacctgcccaacaacatgatccaccaggtgcccatcaagagcctgccccaggagtggctgtggtgcgagacctggtgcgacgacgccagcaagaagagagccaagaccatcgacctgtgcaacaaccccatgaccaaggagcccaagctggaggccgccgtgagaatcgtgcccgagtggcaggactacgaccaggagatcaagcagctgcagatcagattccagaaggagaaggagaccggcgccctgtacaaggagaagaccaaggagcccagcagagagggcccccagaagagagaggagctgtag

SEQ ID NO: 104601 - DNA, 4596 bp, Artificial Sequence
  Description of Artificial Sequence: Synthetic coding sequence
atgggcgtgctggtggtgctgaccgtgctgtggctgttcagcagcgtgaaggccgacagcaaggccatcaccaccagcctgaccaccaagtggttcagcacccccctgctgctggaggccagcgagttcctggccgaggacagccaggagaagttctggaacttcgtggaggccagccagaacatcggcagcagcgaccacgacggcaccgactacagctactaccacgccatcctggaggccgccttccagttcctgagccccctgcagcagaacctgttcaagttctgcctgagcctgagaagctacagcgccaccatccaggccttccagcagatcgccgccgacgagcccccccccgagggctgcaacagcttcttcagcgtgcacggcaagaagacctgcgagagcgacaccctggaggccctgctgctgaccgccagcgagagacccaagcccctgctgttcaagggcgaccacagataccccagcagcaaccccgagagccccgtggtgatcttctacagcgagatcggcagcgaggagttcagcaacttccacagacagctgatcagcaagagcaacgccggcaagatcaactacgtgttcagacactacatcttcaaccccagaaaggagcccgtgtacctgagcggctacggcgtggagctggccatcaagagcaccgagtacaaggccaaggacgacacccaggtgaagggcaccgaggtgaacaccaccgtgatcggcgagaacgaccccatcgacgaggtgcagggcttcctgttcggcaagctgagagacctgcaccccgacctggagggccagctgaaggagctgagaaagcacctggtggagagcaccaacgagatggcccccctgaaggtgtggcagctgcaggacctgagcttccagaccgccgccagaatcctggccagccccgtggagctggccctggtggtgatgaaggacctgagccagaacttccccaccaaggccagagccatcaccaagaccgccgtgagcagcgagctgagaaccgaggtggaggagaaccagaagtacttcaagggcaccctgggcctgcagcccggcgacagcgccctgttcatcaacggcctgcacatggacctggacacccaggacatcttcagcctgttcgacgtgctgagaaacgaggccagagtgatggagggcctgcacagactgggcatcgagggcctgagcctgcacaacgtgctgaagctgaacatccagcccagcgaggccgactacgccgtggacatcagaagccccgccatcagctgggtgaacaacctggaggtggacagcagatacaacagctggcccagcagcctgcaggagctgctgagacccaccttccccggcgtgatcagacagatcagaaagaacctgcacaacatggtgttcatcgtggaccccgcccacgagaccaccgccgagctgatgaacaccgccgagatgttcctgagcaaccacatccccctgagaatcggcttcatcttcgtggtgaacgacagcgaggacgtggacggcatgcaggacgccggcgtggccgtgctgagagcctacaactacgtggcccaggaggtggacgactaccacgccttccagaccctgacccacatctacaacaaggtgagaaccggcgagaaggtgaaggtggagcacgtggtgagcgtgctggagaagaagtacccctacgtggaggtgaacagcatcctgggcatcgacagcgcctacgacagaaacagaaaggaggccagaggctactacgagcagaccggcgtgggccccctgcccgtggtgctgttcaacggcatgcccttcgagagagagcagctggaccccgacgagctggagaccatcaccatgcacaagatcctggagaccaccaccttcttccagagagccgtgtacctgggcgagctgccccacgaccaggacgtggtggagtacatcatgaaccagcccaacgtggtgcccagaatcaacagcagaatcctgaccgccgagagagactacctggacctgaccgccagcaacaacttcttcgtggacgactacgccagattcaccatcctggacagccagggcaagaccgccgccgtggccaacagcatgaactacctgaccaagaagggcatgagcagcaaggagatctacgacgacagcttcatcagacccgtgaccttctggatcgtgggcgacttcgacagccccagcggcagacagctgctgtacgacgccatcaagcaccagaagagcagcaacaacgtgagaatcagcatgatcaacaaccccgccaaggagatcagctacgagaacacccagatcagcagagccatctgggccgccctgcagacccagaccagcaacgccgccaagaacttcatcaccaagatggccaaggagggcgccgccgaggccctggccgccggcgccgacatcgccgagttcagcgtgggcggcatggacttcagcctgttcaaggaggtgttcgagagcagcaagatggacttcatcctgagccacgccgtgtactgcagagacgtgctgaagctgaagaagggccagagagccgtgatcagcaacggcagaatcatcggccccctggaggacagcgagctgttcaaccaggacgacttccacctgctggagaacatcatcctgaagaccagcggccagaagatcaagagccacatccagcagctgagagtggaggaggacgtggccagcgacctggtgatgaaggtggacgccctgctgagcgcccagcccaagggcgaccccagaatcgagtaccagttcttcgaggacagacacagcgccatcaagctgagacccaaggagggcgagacctacttcgacgtggtggccgtggtggaccccgtgaccagagaggcccagagactggcccccctgctgctggtgctggcccagctgatcaacatgaacctgagagtgttcatgaactgccagagcaagctgagcgacatgcccctgaagagcttctacagatacgtgctggagcccgagatcagcttcaccagcgacaacagcttcgccaagggccccatcgccaagttcctggacatgccccagagccccctgttcaccctgaacctgaacacccccgagagctggatggtggagagcgtgagaaccccctacgacctggacaacatctacctggaggaggtggacagcgtggtggccgccgagtacgagctggagtacctgctgctggagggccactgctacgacatcaccaccggccagccccccagaggcctgcagttcaccctgggcaccagcgccaaccccgtgatcgtggacaccatcgtgatggccaacctgggctacttccagctgaaggccaaccccggcgcctggatcctgagactgagaaagggcagaagcgaggacatctacagaatctacagccacgacggcaccgacagcccccccgacgccgacgaggtggtgatcgtgctgaacaacttcaagagcaagatcatcaaggtgaaggtgcagaagaaggccgacatggtgaacgaggacctgctgagcgacggcaccagcgagaacgagagcggcttctgggacagcttcaagtggggcttcaccggccagaagaccgaggaggtgaagcaggacaaggacgacatcatcaacatcttcagcgtggccagcggccacctgtacgagagattcctgagaatcatgatgctgagcgtgctgaagaacaccaagacccccgtgaagttctggttcctgaagaactacctgagccccaccttcaaggagttcatcccctacatggccaacgagtacaacttccagtacgagctggtgcagtacaagtggcccagatggctgcaccagcagaccgagaagcagagaatcatctggggctacaagatcctgttcctggacgtgctgttccccctggtggtggacaagttcctgttcgtggacgccgaccagatcgtgagaaccgacctgaaggagctgagagacttcaacctggacggcgccccctacggctacacccccttctgcgacagcagaagagagatggacggctacagattctggaagagcggctactgggccagccacctggccggcagaaagtaccacatcagcgccctgtacgtggtggacctgaagaagttcagaaagatcgccgccggcgacagactgagaggccagtaccagggcctgagccaggaccccaacagcctgagcaacctggaccaggacctgcccaacaacatgatccaccaggtgcccatcaagagcctgccccaggagtggctgtggtgcgagacctggtgcgacgacgccagcaagaagagagccaagaccatcgacctgtgcaacaaccccatgaccaaggagcccaagctggaggccgccgtgagaatcgtgcccgagtggcaggactacgaccaggagatcaagcagctgcagatcagattccagaaggagaaggagaccggcgccctgtacaaggagaagaccaaggagcccagcagagagggcccccagaagagagaggagctgtag

SEQ ID NO: 104602 - DNA, 843 bp, Artificial Sequence
  Description of Artificial Sequence: Synthetic coding sequence
atggcccccgccaaggccaccaacgtggtgagactgctgctgggcagcaccgccctgtggctgagccagctgggcagcggcaccgtggccgccagcaagagcgtgaccgcccacctggccgccaagtggcccgagacccccctgctgctggaggccagcgagttcatggccgaggagagcaacgagaagttctggcagttcctggagaccgtgcaggagctggccatctacaagcagaccgagagcgactacagctactacaacctgatcctgaagaaggccggccagttcctggacaacctgcacatcaacctgctgaagttcgccttcagcatcagagcctacagccccgccatccagatgttccagcagatcgccgccgacgagcccccccccgacggctgcaacgccttcgtggtgatccacaagaagcacacctgcaagatcaacgagatcaagaagctgctgaagaaggccgccagcagaaccagaccctacctgttcaagggcgaccacaagttccccaccaacaaggagaacctgcccgtggtgatcctgtacgccgagatgggcaccagaaccttcagcgccttccacaaggtgctgagcgagaaggcccagaacgaggagatcctgtacgtgctgagacactacatccagaagcccagcagcagaaagatgtacctgagcggctacggcgtggagctggccatcaagagcaccgagtacaaggccctggacgacacccaggtgaagaccgtgaccaacaccaccgtggaggacgagaccgagaccaacgaggtgcagggcttcctgttcggcaagctgaagctggtgtactag

SEQ ID NO: 104603 - DNA, 837 bp, Artificial Sequence
  Description of Artificial Sequence: Synthetic coding sequence
atggcccccgccaaggccaccaacgtggtgagactgctgctgggcagcaccgccctgtggctgagccagctgggcagcggcaccgtggccgccagcaagagcgtgaccgcccacctggccgccaagtggcccgagacccccctgctgctggaggccagcgagttcatggccgaggagagcaacgagaagttctggcagttcctggagaccgtgcaggagctggccatctacaagcagaccgagagcgactacagctactacaacctgatcctgaagaaggccggccagttcctggacaacctgcacatcaacctgctgaagttcgccttcagcatcagagcctacagccccgccatccagatgttccagcagatcgccgccgacgagcccccccccgacggctgcaacgccttcgtggtgatccacaagaagcacacctgcaagatcaacgagatcaagaagctgctgaagaaggccgccagcagaaccagaccctacctgttcaagggcgaccacaagttccccaccaacaaggagaacctgcccgtggtgatcctgtacgccgagatgggcaccagaaccttcagcgccttccacaaggtgctgagcgagaaggcccagaacgaggagatcctgtacgtgctgagacactacatccagaagcccagcagcagaaagatgtacctgagcggctacggcgtggagctggccatcaagagcaccgagtacaaggccctggacgacacccaggtgaagaccgtgaccaacaccaccgtggaggacgagaccgagaccaacgaggtgcagggcttcctgttcggcaagctgaagagctag

SEQ ID NO: 104604 - DNA, 786 bp, Artificial Sequence
  Description of Artificial Sequence: Synthetic coding sequence
atggcccccgccaaggccaccaacgtggtgagactgctgctgggcagcaccgccctgtggctgagccagctgggcagcggcaccgtggccgccagcaagagcgtgaccgcccacctggccgccaagtggcccgagacccccctgctgctggaggccagcgagttcatggccgaggagagcaacgagaagttctggcagttcctggagaccgtgcaggagctggccatctacaagcagaccgagagcgactacagctactacaacctgatcctgaagaaggccggccagttcctggacaacctgcacatcaacctgctgaagttcgccttcagcatcagagcctacagccccgccatccagatgttccagcagatcgccgccgacgagcccccccccgacggctgcaacgccttcgtggtgatccacaagaagcacacctgcaagatcaacgagatcaagaagctgctgaagaaggccgccagcagaaccagaccctacctgttcaagggcgaccacaagttccccaccaacaaggagaacctgcccgtggtgatcctgtacgccgagatgggcaccagaaccttcagcgccttccacaaggtgctgagcgagaaggcccagaacgaggagatcctgtacgtgctgagacactacatccagaagcccagcagcagaaagatgtacctgagcggctacggcgtggagctggccatcaagagcaccgagtacaaggccctggacgacacccaggtgaaggtgttccaggaccccgaggccttcttctag

SEQ ID NO: 104605 - DNA, 4551 bp, Artificial Sequence
  Description of Artificial Sequence: Synthetic coding sequence
atggcccccgccaaggccaccaacgtggtgagactgctgctgggcagcaccgccctgtggctgagccagctgggcagcggcaccgtggccgccagcaagagcgtgaccgcccacctggccgccaagtggcccgagacccccctgctgctggaggccagcgagttcatggccgaggagagcaacgagaagttctggcagttcctggagaccgtgcaggagctggccatctacaagcagaccgagagcgactacagctactacaacctgatcctgaagaaggccggccagttcctggacaacctgcacatcaacctgctgaagttcgccttcagcatcagagcctacagccccgccatccagatgttccagcagatcgccgccgacgagcccccccccgacggctgcaacgccttcgtggtgatccacaagaagcacacctgcaagatcaacgagatcaagaagctgctgaagaaggccgccagcagaaccagaccctacctgttcaagggcgaccacaagttccccaccaacaaggagaacctgcccgtggtgatcctgtacgccgagatgggcaccagaaccttcagcgccttccacaaggtgctgagcgagaaggcccagaacgaggagatcctgtacgtgctgagacactacatccagaagcccagcagcagaaagatgtacctgagcggctacggcgtggagctggccatcaagagcaccgagtacaaggccctggacgacacccaggtgaagaccgtgaccaacaccaccgtggaggacgagaccgagaccaacgaggtgcagggcttcctgttcggcaagctgaaggagatctacagcgacctgagagacaacctgaccgccttccagaagtacctgatcgagagcaacaagcagatgatgcccctgaaggtgtgggagctgcaggacctgagcttccaggccgccagccagatcatgagcgcccccgtgtacgacagcatcaagctgatgaaggacatcagccagaacttccccatcaaggccagaagcctgaccagaatcgccgtgaaccagcacatgagagaggagatcaaggagaaccagaaggacctgcaggtgagattcaagatccagcccggcgacgccagactgttcatcaacggcctgagagtggacatggacgtgtacgacgccttcagcatcctggacatgctgaagctggagggcaagatgatgaacggcctgagaaacctgggcatcaacggcgaggacatgagcaagttcctgaagctgaacagccacatctgggagtacacctacgtgctggacatcagacacagcagcatcatgtggatcaacgacctggagaacgacgacctgtacatcacctggcccaccagctgccagaagctgctgaagcccgtgttccccggcagcgtgcccagcatcagaagaaacttccacaacctggtgctgttcatcgaccccgcccaggagtacaccctggacttcatcaagctggccgacgtgttctacagccacgaggtgcccctgagaatcggcttcgtgttcatcctgaacaccgacgacgaggtggacggcgccaacgacgccggcgtggccctgtggagagccttcaactacatcgccgaggagttcgacatcagcgaggccttcatcagcatcgtgcacatgtaccagaaggtgaagaaggaccagaacatcctgaccgtggacaacgtgaagagcgtgctgcagaacaccttcccccacgccaacatctgggacatcctgggcatccacagcaagtacgacgaggagagaaaggccggcgccagcttctacaagatgaccggcctgggccccctgccccaggccctgtacaacggcgagcccttcaagcacgaggagatgaacatcaaggagctgaagatggccgtgctgcagagaatgatggacgccagcgtgtacctgcagagagaggtgttcctgggcaccctgaacgacagaaccaacgccatcgacttcctgatggacagaaacaacgtggtgcccagaatcaacaccctgatcctgagaaccaaccagcagtacctgaacctgatcagcaccagcgtgaccgccgacgtggaggacttcagcaccttcttcttcctggacagccaggacaagagcgccgtgatcgccaagaacatgtactacctgacccaggacgacgagagcatcatcagcgccgtgaccctgtggatcatcgccgacttcgacaagcccagcggcagaaagctgctgttcaacgccctgaagcacatgaagaccagcgtgcacagcagactgggcatcatctacaaccccaccagcaagatcaacgaggagaacaccgccatcagcagaggcatcctggccgccttcctgacccagaagaacatgttcctgagaagcttcctgggccagctggccaaggaggagatcgccaccgccatctacagcggcgacaagatcaagaccttcctgatcgagggcatggacaagaacgccttcgagaagaagtacaacaccgtgggcgtgaacatcttcagaacccaccagctgttctgccaggacgtgctgaagctgagacccggcgagatgggcatcgtgagcaacggcagattcctgggccccctggacgaggacttctacgccgaggacttctacctgctggagaagatcaccttcagcaacctgggcgagaagatcaagggcatcgtggagaacatgggcatcaacgccaacaacatgagcgacttcatcatgaaggtggacgccctgatgagcagcgtgcccaagagagccagcagatacgacgtgaccttcctgagagagaaccacagcgtgatcaagaccaacccccaggagaacgacatgttcttcaacgtgatcgccatcgtggaccccctgaccagagaggcccagaagatggcccagctgctggtggtgctgggcaagatcatcaacatgaagatcaagctgttcatgaactgcagaggcagactgagcgaggcccccctggagagcttctacagattcgtgctggagcccgagctgatgagcggcgccaacgacgtgagcagcctgggccccgtggccaagttcctggacatccccgagagccccctgctgatcctgaacatgatcacccccgagggctggctggtggagaccgtgcacagcaactgcgacctggacaacatccacctgaaggacaccgagaagaccgtgaccgccgagtacgagctggagtacctgctgctggagggccagtgcttcgacaaggtgaccgagcagccccccagaggcctgcagttcaccctgggcaccaagaacaagcccgccgtggtggacaccatcgtgatggcccaccacggctacttccagctgaaggccaaccccggcgcctggatcctgagactgcaccagggcaagagcgaggacatctaccagatcgtgggccacgagggcaccgacagccaggccgacctggaggacatcatcgtggtgctgaacagcttcaagagcaagatcctgaaggtgaaggtgaagaaggagaccgacaagatcaaggaggacatcctgaccgacgaggacgagaagaccaagggcctgtgggacagcatcaagagcttcaccgtgagcctgcacaaggagaacaagaaggagaaggacgtgctgaacatcttcagcgtggccagcggccacctgtacgagagattcctgagaatcatgatgctgagcgtgctgagaaacaccaagacccccgtgaagttctggctgctgaagaactacctgagccccaccttcaaggaggtgatcccccacatggccaaggagtacggcttcagatacgagctggtgcagtacagatggcccagatggctgagacagcagaccgagagacagagaatcatctggggctacaagatcctgttcctggacgtgctgttccccctggccgtggacaagatcatcttcgtggacgccgaccagatcgtgagacacgacctgaaggagctgagagacttcgacctggacggcgccccctacggctacacccccttctgcgacagcagaagagagatggacggctacagattctggaagaccggctactgggccagccacctgctgagaagaaagtaccacatcagcgccctgtacgtggtggacctgaagaagttcagaagaatcggcgccggcgacagactgagaagccagtaccaggccctgagccaggaccccaacagcctgagcaacctggaccaggacctgcccaacaacatgatctaccaggtggccatcaagagcctgccccaggactggctgtggtgcgagacctggtgcgacgacgagagcaagcagagagccaagaccatcgacctgtgcaacaaccccaagaccaaggagagcaagctgaaggccgccgccagaatcgtgcccgagtgggtggagtacgacgccgagatcagacagctgctggaccacctggagaacaagaagcaggacaccatcctgacccacgacgagctgtag

SEQ ID NO: 104606 - DNA, 1119 bp, Artificial Sequence
  Description of Artificial Sequence: Synthetic coding sequence
atggcccccgccaaggccaccaacgtggtgagactgctgctgggcagcaccgccctgtggctgagccagctgggcagcggcaccgtggccgccagcaagagcgtgaccgcccacctggccgccaagtggcccgagacccccctgctgctggaggccagcgagttcatggccgaggagagcaacgagaagttctggcagttcctggagaccgtgcaggagctggccatctacaagcagaccgagagcgactacagctactacaacctgatcctgaagaaggccggccagttcctggacaacctgcacatcaacctgctgaagttcgccttcagcatcagagcctacagccccgccatccagatgttccagcagatcgccgccgacgagcccccccccgacggctgcaacgccttcgtggtgatccacaagaagcacacctgcaagatcaacgagatcaagaagctgctgaagaaggccgccagcagaaccagaccctacctgttcaagggcgaccacaagttccccaccaacaaggagaacctgcccgtggtgatcctgtacgccgagatgggcaccagaaccttcagcgccttccacaaggtgctgagcgagaaggcccagaacgaggagatcctgtacgtgctgagacactacatccagaagcccagcagcagaaagatgtacctgagcggctacggcgtggagctggccatcaagagcaccgagtacaaggccctggacgacacccaggtgaagaccgtgaccaacaccaccgtggaggacgagaccgagaccaacgaggtgcagggcttcctgttcggcaagctgaaggagatctacagcgacctgagagacaacctgaccgccttccagaagtacctgatcgagagcaacaagcagatgatgcccctgaaggtgtgggagctgcaggacctgagcttccaggccgccagccagatcatgagcgcccccgtgtacgacagcatcaagctgatgaaggacatcagccagaacttccccatcaaggccagactgagaatgaacatcctgatctgcctgttccagagcaccctgaacgtgaagaacctgagaagcagacacctgtacaacaagacctag

SEQ ID NO: 104607 - DNA, 1527 bp, Artificial Sequence
  Description of Artificial Sequence: Synthetic coding sequence
atgagcagattcgtgcaggacctgagcaaggccatgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgatgaacagcttcaacaccgacgaggacaccaagaagatcctgcagaagtacaaccactgcagagtgaagatctacaccttcaaccagagcagataccccagaatcaacaaggagagcctgctgcccgtggccaaggacgtgagctacagcggcgagaacaccgaggcctggtacccccccggccacggcgacatctacgccagcttctacaacagcggcctgctggacaccttcatcggcgagggcaaggagtacatcttcgtgagcaacatcgacaacctgggcgccaccgtggacctgtacatcctgaaccacctgatgaacccccccaacggcaagagatgcgagttcgtgatggaggtgaccaacaagaccagagccgacgtgaagggcggcaccctgacccagtacgagggcaagctgagactggtggagatcgcccaggtgcccaaggcccacgtggacgagttcaagagcgtgagcaagttcaagatcttcaacaccaacaacctgtggatcagcctggccgccgtgaagagactgcaggagcagaacgccatcgacatggagatcatcgtgaacgccaagaccctggacggcggcctgaacgtgatccagctggagaccgccgtgggcgccgccatcaagagcttcgagaacagcctgggcatcaacgtgcccagaagcagattcctgcccgtgaagaccaccagcgacctgctgctggtgatgagcaacctgtacagcctgaacgccggcagcctgaccatgagcgagaagagagagttccccaccgtgcccctggtgaagctgggcagcagcttcaccaaggtgcaggactacctgagaagattcgagagcatccccgacatgctggagctggaccacctgaccgtgagcggcgacgtgaccttcggcaagaacgtgagcctgaagggcaccgtgatcatcatcgccaaccacggcgacagaatcgacatcccccccggcgccgtgctggagaacaagatcgtgagcggcaacctgagaatcctggaccactag

SEQ ID NO: 104608 - DNA, 1494 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgatgaacagcttcaacaccgacgaggacaccaagaagatcctgcagaagtacaaccactgcagagtgaagatctacaccttcaaccagagcagataccccagaatcaacaaggagagcctgctgcccgtggccaaggacgtgagctacagcggcgagaacaccgaggcctggtacccccccggccacggcgacatctacgccagcttctacaacagcggcctgctggacaccttcatcggcgagggcaaggagtacatcttcgtgagcaacatcgacaacctgggcgccaccgtggacctgtacatcctgaaccacctgatgaacccccccaacggcaagagatgcgagttcgtgatggaggtgaccaacaagaccagagccgacgtgaagggcggcaccctgacccagtacgagggcaagctgagactggtggagatcgcccaggtgcccaaggcccacgtggacgagttcaagagcgtgagcaagttcaagatcttcaacaccaacaacctgtggatcagcctggccgccgtgaagagactgcaggagcagaacgccatcgacatggagatcatcgtgaacgccaagaccctggacggcggcctgaacgtgatccagctggagaccgccgtgggcgccgccatcaagagcttcgagaacagcctgggcatcaacgtgcccagaagcagattcctgcccgtgaagaccaccagcgacctgctgctggtgatgagcaacctgtacagcctgaacgccggcagcctgaccatgagcgagaagagagagttccccaccgtgcccctggtgaagctgggcagcagcttcaccaaggtgcaggactacctgagaagattcgagagcatccccgacatgctggagctggaccacctgaccgtgagcggcgacgtgaccttcggcaagaacgtgagcctgaagggcaccgtgatcatcatcgccaaccacggcgacagaatcgacatcccccccggcgccgtgctggagaacaagatcgtgagcggcaacctgagaatcctggaccactag

SEQ ID NO: 104609 - DNA, 1554 bp, Artificial Sequence
  Description of Artificial Sequence: Synthetic coding sequence
atgctgctgtaccccgccggcttcagcttcgccagcctgaagagcgacctgagcaaggccatgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgatgaacagcttcaacaccgacgaggacaccaagaagatcctgcagaagtacaaccactgcagagtgaagatctacaccttcaaccagagcagataccccagaatcaacaaggagagcctgctgcccgtggccaaggacgtgagctacagcggcgagaacaccgaggcctggtacccccccggccacggcgacatctacgccagcttctacaacagcggcctgctggacaccttcatcggcgagggcaaggagtacatcttcgtgagcaacatcgacaacctgggcgccaccgtggacctgtacatcctgaaccacctgatgaacccccccaacggcaagagatgcgagttcgtgatggaggtgaccaacaagaccagagccgacgtgaagggcggcaccctgacccagtacgagggcaagctgagactggtggagatcgcccaggtgcccaaggcccacgtggacgagttcaagagcgtgagcaagttcaagatcttcaacaccaacaacctgtggatcagcctggccgccgtgaagagactgcaggagcagaacgccatcgacatggagatcatcgtgaacgccaagaccctggacggcggcctgaacgtgatccagctggagaccgccgtgggcgccgccatcaagagcttcgagaacagcctgggcatcaacgtgcccagaagcagattcctgcccgtgaagaccaccagcgacctgctgctggtgatgagcaacctgtacagcctgaacgccggcagcctgaccatgagcgagaagagagagttccccaccgtgcccctggtgaagctgggcagcagcttcaccaaggtgcaggactacctgagaagattcgagagcatccccgacatgctggagctggaccacctgaccgtgagcggcgacgtgaccttcggcaagaacgtgagcctgaagggcaccgtgatcatcatcgccaaccacggcgacagaatcgacatcccccccggcgccgtgctggagaacaagatcgtgagcggcaacctgagaatcctggaccactag

SEQ ID NO: 104610 - DNA, 1494 bp, Artificial Sequence; identical to SEQ ID NO: 104608
  Description of Artificial Sequence: Synthetic coding sequence

SEQ ID NO: 104611 - DNA, 453 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgtag

SEQ ID NO: 104612 - DNA, 516 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgatgaacagcttcaacaccgacgaggacaccaagaagatcctgcagaagtacaaccactgcagatag

SEQ ID NO: 104613 - DNA, 117 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagtag

SEQ ID NO: 104614 - DNA, 318 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggctag

SEQ ID NO: 104615 - DNA, 150 bp, Artificial Sequence
  Description of Artificial Sequence: Synthetic coding sequence
atgagcagattcgtgcaggacctgagcaaggccatgagccaggacggcgccagccagttccaggaggtgatcagacaggagctggagctgagcgtgaagaaggagctggagaagatcctgaccaccgccagcagccacgagttcgagtag

SEQ ID NO: 104616 - DNA, 408 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatctag

SEQ ID NO: 104617 - DNA, 642 bp, Artificial Sequence
  Description of Artificial Sequence: Synthetic coding sequence
atgagccaggacggcgccagccagttccaggaggtgatcagacaggagctggagctgagcgtgaagaaggagctggagaagatcctgaccaccgccagcagccacgagttcgagcacaccaagaaggacctggacggcttcagaaagctgttccacagattcctgcaggagaagggccccagcgtggactggggcaagatccagagaccccccgaggacagcatccagccctacgagaagatcaaggccagaggcctgcccgacaacatcagcagcgtgctgaacaagctggtggtggtgaagctgaacggcggcctgggcaccagcatgggctgcaagggccccaagagcctgatcggcgtgagaaacgagaacaccttcctggacctgaccgtgcagcagatcgagcacctgaacaagacctacaacaccgacgtgcccctggtgctgatgaacagcttcaacaccgacgaggacaccaagaagatcctgcagaagtacaaccactgcagagtgaagatctacaccttcaaccagagcagataccccagaatcaacaaggagagcctgctgcccgtggccaaggacgtgagctacagcggcgagaacaccgaggcctggtacccccccggccacggctag

SEQ ID NO: 104618 - DNA, 1278 bp, Artificial Sequence
  Description of Artificial Sequence: Synthetic coding sequence
atggtgagcaaggccctgctgagactggtgagcgccgtgaacagaagaagaatgaagctgctgctgggcatcgccctgctggcctacgtggccagcgtgtggggcaacttcgtgaacatgagcttcctgctgaacagaagcatccaggagaacggcgagctgaagatcgagagcaagatcgaggagatggtggagcccctgagagagaagatcagagacctggagaagagcttcacccagaagtacccccccgtgaagttcctgagcgagaaggacagaaagagaatcctgatcaccggcggcgccggcttcgtgggcagccacctgaccgacaagctgatgatggacggccacgaggtgaccgtggtggacaacttcttcaccggcagaaagagaaacgtggagcactggatcggccacgagaacttcgagctgatcaaccacgacgtggtggagcccctgtacatcgaggtggaccagatctaccacctggccagccccgccagcccccccaactacatgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgagcgacctggtgaacggcctggtggccctgatgaacagcaacgtgagcagccccgtgaacctgggcaaccccgaggagcacaccatcctggagttcgcccagctgatcaagaacctggtgggcagcggcagcgagatccagttcctgagcgaggcccaggacgacccccagaagagaaagcccgacatcaagaaggccaagctgatgctgggctgggagcccgtggtgcccctggaggagggcctgaacaaggccatccactacttcagaaaggagctggagtaccaggccaacaaccagtacatccccaagcccaagcccgccagaatcaagaagggcagaaccagacacagctag

SEQ ID NO: 104619 - DNA, 759 bp, Artificial Sequence
  Description of Artificial Sequence: Synthetic coding sequence
atgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgagcgacctggtgaacggcctggtggccctgatgaacagcaacgtgagcagccccgtgaacctgggcaaccccgaggagcacaccatcctggagttcgcccagctgatcaagaacctggtgggcagcggcagcgagatccagttcctgagcgaggcccaggacgacccccagaagagaaagcccgacatcaagaaggccaagctgatgctgggctgggagcccgtggtgcccctggaggagggcctgaacaaggccatccactacttcagaaaggagctggagtaccaggccaacaaccagtacatccccaagcccaagcccgccagaatcaagaagggcagaaccagacacagctag

SEQ ID NO: 104620 - DNA, 1263 bp, Artificial Sequence
  Description of Artificial Sequence: Synthetic coding sequence
atggtgagcaaggccctgctgagactggtgagcgccgtgaacagaagaagaatgaagctgctgctgggcatcgccctgctggcctacgtggccagcgtgtggggcaacttcgtgaacatgagaagcatccaggagaacggcgagctgaagatcgagagcaagatcgaggagatggtggagcccctgagagagaagatcagagacctggagaagagcttcacccagaagtacccccccgtgaagttcctgagcgagaaggacagaaagagaatcctgatcaccggcggcgccggcttcgtgggcagccacctgaccgacaagctgatgatggacggccacgaggtgaccgtggtggacaacttcttcaccggcagaaagagaaacgtggagcactggatcggccacgagaacttcgagctgatcaaccacgacgtggtggagcccctgtacatcgaggtggaccagatctaccacctggccagccccgccagcccccccaactacatgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgagcgacctggtgaacggcctggtggccctgatgaacagcaacgtgagcagccccgtgaacctgggcaaccccgaggagcacaccatcctggagttcgcccagctgatcaagaacctggtgggcagcggcagcgagatccagttcctgagcgaggcccaggacgacccccagaagagaaagcccgacatcaagaaggccaagctgatgctgggctgggagcccgtggtgcccctggaggagggcctgaacaaggccatccactacttcagaaaggagctggagtaccaggccaacaaccagtacatccccaagcccaagcccgccagaatcaagaagggcagaaccagacacagctag

SEQ ID NO: 104621 - DNA, 405 bp, Artificial Sequence
  Description of Artificial Sequence: Synthetic coding sequence
atgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgtag

SEQ ID NO: 104622 - DNA, 558 bp, Artificial Sequence
  Description of Artificial Sequence: Synthetic coding sequence
atggtgagcaaggccctgctgagactggtgagcgccgtgaacagaagaagaatgaagctgctgctgggcatcgccctgctggcctacgtggcctggctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgagcgacctggtgaacggcctggtggccctgatgaacagcaacgtgagcagccccgtgaacctggtgagcgcccccctgccccccctgtgcagaaccgcccagaccttcgtgcacctgtag

SEQ ID NO: 104623 - DNA, 159 bp, Artificial Sequence
  Description of Artificial Sequence: Synthetic coding sequence
atgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggctag

SEQ ID NO: 104624 - DNA, 366 bp, Artificial Sequence
  Description of Artificial Sequence: Synthetic coding sequence
atgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtag

SEQ ID NO: 104625 - DNA, 1092 bp, Artificial Sequence
  Description of Artificial Sequence: Synthetic coding sequence
atggtggagcccctgagagagaagatcagagacctggagaagagcttcacccagaagtacccccccgtgaagttcctgagcgagaaggacagaaagagaatcctgatcaccggcggcgccggcttcgtgggcagccacctgaccgacaagctgatgatggacggccacgaggtgaccgtggtggacaacttcttcaccggcagaaagagaaacgtggagcactggatcggccacgagaacttcgagctgatcaaccacgacgtggtggagcccctgtacatcgaggtggaccagatctaccacctggccagccccgccagcccccccaactacatgtacaaccccatcaagaccctgaagaccaacaccatcggcaccctgaacatgctgggcctggccaagagagtgggcgccagactgctgctggccagcaccagcgaggtgtacggcgaccccgaggtgcacccccagagcgaggactactggggccacgtgaaccccatcggccccagagcctgctacgacgagggcaagagagtggccgagaccatgtgctacgcctacatgaagcaggagggcgtggaggtgagagtggccagaatcttcaacaccttcggccccagaatgcacatgaacgacggcagagtggtgagcaacttcatcctgcaggccctgcagggcgagcccctgaccgtgtacggcagcggcagccagaccagagccttccagtacgtgagcgacctggtgaacggcctggtggccctgatgaacagcaacgtgagcagccccgtgaacctgggcaaccccgaggagcacaccatcctggagttcgcccagctgatcaagaacctggtgggcagcggcagcgagatccagttcctgagcgaggcccaggacgacccccagaagagaaagcccgacatcaagaaggccaagctgatgctgggctgggagcccgtggtgcccctggaggagggcctgaacaaggccatccactacttcagaaaggagctggagtaccaggccaacaaccagtacatccccaagcccaagcccgccagaatcaagaagggcagaaccagacacagctag

SEQ ID NO: 104626 - DNA, 1680 bp, Artificial Sequence
  Description of Artificial Sequence: Synthetic coding sequence
atgagaaagttcgcctactgcaaggtggtgctggccaccagcctgatctgggtgctgctggacatgttcctgctgctgtacttcagcgagtgcaacaagtgcgacgagaagaaggagagaggcctgcccgccggcgacgtgctggagcccgtgcagaagccccacgagggccccggcgagatgggcaagcccgtggtgatccccaaggaggaccaggagaagatgaaggagatgttcaagatcaaccagttcaacctgatggccagcgagatgatcgccctgaacagaagcctgcccgacgtgagactggagggctgcaagaccaaggtgtaccccgacaacctgcccaccaccagcgtggtgatcgtgttccacaacgaggcctggagcaccctgctgagaaccgtgcacagcgtgatcaacagaagccccagacacatgatcgaggagatcgtgctggtggacgacgccagcgagagagacttcctgaagagacccctggagagctacgtgaagaagctgaaggtgcccgtgcacgtgatcagaatggagcagagaagcggcctgatcagagccagactgaagggcgccgccgtgagcaagggccaggtgatcaccttcctggacgcccactgcgagtgcaccgtgggctggctggagcccctgctggccagaatcaagcacgacagaagaaccgtggtgtgccccatcatcgacgtgatcagcgacgacaccttcgagtacatggccggcagcgacatgacctacggcggcttcaactggaagctgaacttcagatggtaccccgtgccccagagagagatggacagaagaaagggcgacagaaccctgcccgtgagaacccccaccatggccggcggcctgttcagcatcgacagagactacttccaggagatcggcacctacgacgccggcatggacatctggggcggcgagaacctggagatcagcttcagaatctggcagtgcggcggcaccctggagatcgtgacctgcagccacgtgggccacgtgttcagaaaggccaccccctacaccttccccggcggcaccggccagatcatcaacaagaacaacagaagactggccgaggtgtggatggacgagttcaagaacttcttctacatcatcagccccggcgtgaccaaggtggactacggcgacatcagcagcagagtgggcctgagacacaagctgcagtgcaagcccttcagctggtacctggagaacatctaccccgacagccagatccccagacactacttcagcctgggcgagatcagaaacgtggagaccaaccagtgcctggacaacatggccagaaaggagaacgagaaggtgggcatcttcaactgccacggcatgggcggcaaccaggtgttcagctacaccgccaacaaggagatcagaaccgacgacctgtgcctggacgtgagcaagctgaacggccccgtgaccatgctgaagtgccaccacctgaagggcaaccagctgtgggagtacgaccccgtgaagctgaccctgcagcacgtgaacagcaaccagtgcctggacaaggccaccgaggaggacagccaggtgcccagcatcagagactgcaacggcagcagaagccagcagtggctgctgagaaacgtgaccctgcccgagatcttctag

SEQ ID NO: 104627 - DNA, 1500 bp, Artificial Sequence
  Description of Artificial Sequence: Synthetic coding sequence
atgggcaagcccgtggtgatccccaaggaggaccaggagaagatgaaggagatgttcaagatcaaccagttcaacctgatggccagcgagatgatcgccctgaacagaagcctgcccgacgtgagactggagggctgcaagaccaaggtgtaccccgacaacctgcccaccaccagcgtggtgatcgtgttccacaacgaggcctggagcaccctgctgagaaccgtgcacagcgtgatcaacagaagccccagacacatgatcgaggagatcgtgctggtggacgacgccagcgagagagacttcctgaagagacccctggagagctacgtgaagaagctgaaggtgcccgtgcacgtgatcagaatggagcagagaagcggcctgatcagagccagactgaagggcgccgccgtgagcaagggccaggtgatcaccttcctggacgcccactgcgagtgcaccgtgggctggctggagcccctgctggccagaatcaagcacgacagaagaaccgtggtgtgccccatcatcgacgtgatcagcgacgacaccttcgagtacatggccggcagcgacatgacctacggcggcttcaactggaagctgaacttcagatggtaccccgtgccccagagagagatggacagaagaaagggcgacagaaccctgcccgtgagaacccccaccatggccggcggcctgttcagcatcgacagagactacttccaggagatcggcacctacgacgccggcatggacatctggggcggcgagaacctggagatcagcttcagaatctggcagtgcggcggcaccctggagatcgtgacctgcagccacgtgggccacgtgttcagaaaggccaccccctacaccttccccggcggcaccggccagatcatcaacaagaacaacagaagactggccgaggtgtggatggacgagttcaagaacttcttctacatcatcagccccggcgtgaccaaggtggactacggcgacatcagcagcagagtgggcctgagacacaagctgcagtgcaagcccttcagctggtacctggagaacatctaccccgacagccagatccccagacactacttcagcctgggcgagatcagaaacgtggagaccaaccagtgcctggacaacatggccagaaaggagaacgagaaggtgggcatcttcaactgccacggcatgggcggcaaccaggtgttcagctacaccgccaacaaggagatcagaaccgacgacctgtgcctggacgtgagcaagctgaacggccccgtgaccatgctgaagtgccaccacctgaagggcaaccagctgtgggagtacgaccccgtgaagctgaccctgcagcacgtgaacagcaaccagtgcctggacaaggccaccgaggaggacagccaggtgcccagcatcagagactgcaacggcagcagaagccagcagtggctgctgagaaacgtgaccctgcccgagatcttctag

SEQ ID NO: 104628 - DNA, 1680 bp, Artificial Sequence; identical to SEQ ID NO: 104626
  Description of Artificial Sequence: Synthetic coding sequence

SEQ ID NO: 104629 - DNA, 1812 bp, Artificial Sequence
  Description of Artificial Sequence: Synthetic coding sequence
atgagaagaaaggagaagagactgctgcaggccgtggccctggtgctggccgccctggtgctgctgcccaacgtgggcctgtgggccctgtacagagagagacagcccgacggcacccccggcggcagcggcgccgccgtggcccccgccgccggccagggcagccacagcagacagaagaagaccttcttcctgggcgacggccagaagctgaaggactggcacgacaaggaggccatcagaagagacgcccagagagtgggcaacggcgagcagggcagaccctaccccatgaccgacgccgagagagtggaccaggcctacagagagaacggcttcaacatctacgtgagcgacaagatcagcctgaacagaagcctgcccgacatcagacaccccaactgcaacagcaagagatacctggagaccctgcccaacaccagcatcatcatccccttccacaacgagggctggagcagcctgctgagaaccgtgcacagcgtgctgaacagaagcccccccgagctggtggccgagatcgtgctggtggacgacttcagcgacagagagcacctgaagaagcccctggaggactacatggccctgttccccagcgtgagaatcctgagaaccaagaagagagagggcctgatcagaaccagaatgctgggcgccagcgtggccaccggcgacgtgatcaccttcctggacagccactgcgaggccaacgtgaactggctgccccccctgctggacagaatcgccagaaacagaaagaccatcgtgtgccccatgatcgacgtgatcgaccacgacgacttcagatacgagacccaggccggcgacgccatgagaggcgccttcgactgggagatgtactacaagagaatccccatcccccccgagctgcagaaggccgaccccagcgaccccttcgagagccccgtgatggccggcggcctgttcgccgtggacagaaagtggttctgggagctgggcggctacgaccccggcctggagatctggggcggcgagcagtacgagatcagcttcaaggtgtggatgtgcggcggcagaatggaggacatcccctgcagcagagtgggccacatctacagaaagtacgtgccctacaaggtgcccgccggcgtgagcctggccagaaacctgaagagagtggccgaggtgtggatggacgagtacgccgagtacatctaccagagaagacccgagtacagacacctgagcgccggcgacgtggccgtgcagaagaagctgagaagcagcctgaactgcaagagcttcaagtggttcatgaccaagatcgcctgggacctgcccaagttctacccccccgtggagccccccgccgccgcctggggcgagatcagaaacgtgggcaccggcctgtgcgccgacaccaagcacggcgccctgggcagccccctgagactggagggctgcgtgagaggcagaggcgaggccgcctggaacaacatgcaggtgttcaccttcacctggagagaggacatcagacccggcgacccccagcacaccaagaagttctgcttcgacgccatcagccacaccagccccgtgaccctgtacgactgccacagcatgaagggcaaccagctgtggaagtacagaaaggacaagaccctgtaccaccccgtgagcggcagctgcatggactgcagcgagagcgaccacagaatcttcatgaacacctgcaaccccagcagcctgacccagcagtggctgttcgagcacaccaacagcaccgtgctggagaagttcaacagaaactag

SEQ ID NO: 104630 - DNA, 831 bp, Artificial Sequence
  Description of Artificial Sequence: Synthetic coding sequence
atgctggcctggagagacggcgagctggaggccgagaccagcagcagcctgttcctgctggccatgcaggtgtggatgtgcggcggcagaatggaggacatcccctgcagcagagtgggccacatctacagaaagtacgtgccctacaaggtgcccgccggcgtgagcctggccagagtgagaaacctgaagagagtggccgaggtgtggatggacgagtacgccgagtacatctaccagagaagacccgagtacagacacctgagcgccggcgacgtggccgtgcagaagaagctgagaagcagcctgaactgcaagagcttcaagtggttcatgaccaagatcgcctgggacctgcccaagttctacccccccgtggagccccccgccgccgcctggggcgagatcagaaacgtgggcaccggcctgtgcgccgacaccaagcacggcgccctgggcagccccctgagactggagggctgcgtgagaggcagaggcgaggccgcctggaacaacatgcaggtgttcaccttcacctggagagaggacatcagacccggcgacccccagcacaccaagaagttctgcttcgacgccatcagccacaccagccccgtgaccctgtacgactgccacagcatgaagggcaaccagctgtggaagtacagaaaggacaagaccctgtaccaccccgtgagcggcagctgcatggactgcagcgagagcgaccacagaatcttcatgaacacctgcaaccccagcagcctgacccagcagtggctgttcgagcacaccaacagcaccgtgctggagaagttcaacagaaactag

SEQ ID NO: 104631 - DNA, 1626 bp, Artificial Sequence
  Description of Artificial Sequence: Synthetic coding sequence
atgagaagaaaggagaagagactgctgcaggccgtggccctggtgctggccgccctggtgctgctgcccaacgtgggcctgtgggccctgtacagagagagacagcccgacggcacccccggcggcagcggcgccgccgtggcccccgccgccggccagggcagccacagcagacagaagaagaccttcttcctgggcgacggccagaagctgaaggactggcacgacaaggaggccatcagaagagacgcccagagagtgggcaacggcgagcagggcagaccctaccccatgaccgacgccgagagagtggaccaggcctacagagagaacggcttcaacatctacgtgagcgacaagatcagcctgaacagaagcctgcccgacatcagacaccccaactgcaacagcaagagatacctggagaccctgcccaacaccagcatcatcatccccttccacaacgagggctggagcagcctgctgagaaccgtgcacagcgtgctgaacagaagcccccccgagctggtggccgagatcgtgctggtggacgacttcagcgacagagacagaatcgccagaaacagaaagaccatcgtgtgccccatgatcgacgtgatcgaccacgacgacttcagatacgagacccaggccggcgacgccatgagaggcgccttcgactgggagatgtactacaagagaatccccatcccccccgagctgcagaaggccgaccccagcgaccccttcgagagccccgtgatggccggcggcctgttcgccgtggacagaaagtggttctgggagctgggcggctacgaccccggcctggagatctggggcggcgagcagtacgagatcagcttcaaggtgtggatgtgcggcggcagaatggaggacatcccctgcagcagagtgggccacatctacagaaagtacgtgccctacaaggtgcccgccggcgtgagcctggccagaaacctgaagagagtggccgaggtgtggatggacgagtacgccgagtacatctaccagagaagacccgagtacagacacctgagcgccggcgacgtggccgtgcagaagaagctgagaagcagcctgaactgcaagagcttcaagtggttcatgaccaagatcgcctgggacctgcccaagttctacccccccgtggagccccccgccgccgcctggggcgagatcagaaacgtgggcaccggcctgtgcgccgacaccaagcacggcgccctgggcagccccctgagactggagggctgcgtgagaggcagaggcgaggccgcctggaacaacatgcaggtgttcaccttcacctggagagaggacatcagacccggcgacccccagcacaccaagaagttctgcttcgacgccatcagccacaccagccccgtgaccctgtacgactgccacagcatgaagggcaaccagctgtggaagtacagaaaggacaagaccctgtaccaccccgtgagcggcagctgcatggactgcagcgagagcgaccacagaatcttcatgaacacctgcaaccccagcagcctgacccagcagtggctgttcgagcacaccaacagcaccgtgctggagaagttcaacagaaactag

SEQ ID NO: 104632 - DNA, 1101 bp, Artificial Sequence
  Description of Artificial Sequence: Synthetic coding sequence
atgagaagaaaggagaagagactgctgcaggccgtggccctggtgctggccgccctggtgctgctgcccaacgtgggcctgtgggccctgtacagagagagacagcccgacggcacccccggcggcagcggcgccgccgtggcccccgccgccggccagggcagccacagcagacagaagaagaccttcttcctgggcgacggccagaagctgaaggactggcacgacaaggaggccatcagaagagacgcccagagagtgggcaacggcgagcagggcagaccctaccccatgaccgacgccgagagagtggaccaggcctacagagagaacggcttcaacatctacgtgagcgacaagatcagcctgaacagaagcctgcccgacatcagacaccccaactgcaacagcaagagatacctggagaccctgcccaacaccagcatcatcatccccttccacaacgagggctggagcagcctgctgagaaccgtgcacagcgtgctgaacagaagcccccccgagctggtggccgagatcgtgctggtggacgacttcagcgacagagagcacctgaagaagcccctggaggactacatggccctgttccccagcgtgagaatcctgagaaccaagaagagagagggcctgatcagaaccagaatgctgggcgccagcgtggccaccggcgacgtgatcaccttcctggacagccactgcgaggccaacgtgaactggctgccccccctgctggacagaatcgccagaaacagaaagaccatcgtgtgccccatgatcgacgtgatcgaccacgacgacttcagatacgagacccaggccggcgacgccatgagaggcgccttcgactgggagatgtactacaagagaatccccatcccccccgagctgcagaaggccgaccccagcgaccccttcgagagccccgtgatggccggcggcctgttcgccgtggacagaaagtggttctgggagctgggcggctacgaccccggcctggagatctggggcggcgagcagtacgagatcagcttcaaggtgagccagctgagcagaagacccgtgctgggcaccgccagctag

SEQ ID NO: 104633 - DNA, 1746 bp, Artificial Sequence
  Description of Artificial Sequence: Synthetic coding sequence
atgtggggcagaaccgccagaagaagatgccccagagagctgagaagaggcagagaggccctgctggtgctgctggccctgctggccctggccggcctgggcagcgtgctgagagcccagagaggcgccggcgccggcgccgccgagcccggcccccccagaacccccagacccggcagaagagagcccgtgatgcccagaccccccgtgcccgccaacgccctgggcgccagaggcgaggccgtgagactgcagctgcagggcgaggagctgagactgcaggaggagagcgtgagactgcaccagatcaacatctacctgagcgacagaatcagcctgcacagaagactgcccgagagatggaaccccctgtgcaaggagaagaagtacgactacgacaacctgcccagaaccagcgtgatcatcgccttctacaacgaggcctggagcaccctgctgagaaccgtgtacagcgtgctggagaccagccccgacatcctgctggaggaggtgatcctggtggacgactacagcgacagagagcacctgaaggagagactggccaacgagctgagcggcctgcccaaggtgagactgatcagagccaacaagagagagggcctggtgagagccagactgctgggcgccagcgccgccagaggcgacgtgctgaccttcctggactgccactgcgagtgccacgagggctggctggagcccctgctgcagagaatccacgaggaggagagcgccgtggtgtgccccgtgatcgacgtgatcgactggaacaccttcgagtacctgggcaacagcggcgagccccagatcggcggcttcgactggagactggtgttcacctggcacaccgtgcccgagagagagagaatcagaatgcagagccccgtggacgtgatcagaagccccaccatggccggcggcctgttcgccgtgagcaagaagtacttcgagtacctgggcagctacgacaccggcatggaggtgtggggcggcgagaacctggagttcagcttcagaatctggcagtgcggcggcgtgctggagacccacccctgcagccacgtgggccacgtgttccccaagcaggccccctacagcagaaacaaggccctggccaacagcgtgagagccgccgaggtgtggatggacgagttcaaggagctgtactaccacagaaaccccagagccagactggagcccttcggcgacgtgaccgagagaaagcagctgagagacaagctgcagtgcaaggacttcaagtggttcctggagaccgtgtaccccgagctgcacgtgcccgaggacagacccggcttcttcggcatgctgcagaacaagggcctgaccgactactgcttcgactacaacccccccgacgagaaccagatcgtgggccaccaggtgatcctgtacctgtgccacggcatgggccagaaccagttcttcgagtacaccagccagaaggagatcagatacaacacccaccagcccgagggctgcatcgccgtggaggccggcatggacaccctgatcatgcacctgtgcgaggagaccgcccccgagaaccagaagttcatcctgcaggaggacggcagcctgttccacgagcagagcaagaagtgcgtgcaggccgccagaaaggagagcagcgacagcttcgtgcccctgctgagagactgcaccaacagcgaccaccagaagtggttcttcaaggagagaatgctgtag

SEQ ID NO: 104634 - DNA, 1671 bp, Artificial Sequence
  Description of Artificial Sequence: Synthetic coding sequence
atgagaagattcgtgtactgcaaggtggtgctggccaccagcctgatgtgggtgctggtggacgtgttcctgctgctgtacttcagcgagtgcaacaagtgcgacgacaagaaggagagaagcctgctgcccgccctgagagccgtgatcagcagaaaccaggagggccccggcgagatgggcaaggccgtgctgatccccaaggacgaccaggagaagatgaaggagctgttcaagatcaaccagttcaacctgatggccagcgacctgatcgccctgaacagaagcctgcccgacgtgagactggagggctgcaagaccaaggtgtaccccgacgagctgcccaacaccagcgtggtgatcgtgttccacaacgaggcctggagcaccctgctgagaaccgtgtacagcgtgatcaacagaagcccccactacctgctgagcgaggtgatcctggtggacgacgccagcgagagagacttcctgaagctgaccctggagaactacgtgaagaacctggaggtgcccgtgaagatcatcagaatggaggagagaagcggcctgatcagagccagactgagaggcgccgccgccagcaagggccaggtgatcaccttcctggacgcccactgcgagtgcaccctgggctggctggagcccctgctggccagaatcaaggaggacagaaagaccgtggtgtgccccatcatcgacgtgatcagcgacgacaccttcgagtacatggccggcagcgacatgacctacggcggcttcaactggaagctgaacttcagatggtaccccgtgccccagagagagatggacagaagaaagggcgacagaaccctgcccgtgagaacccccaccatggccggcggcctgttcagcatcgacagaaactacttcgaggagatcggcacctacgacgccggcatggacatctggggcggcgagaacctggagatgagcttcagaatctggcagtgcggcggcagcctggagatcgtgacctgcagccacgtgggccacgtgttcagaaaggccaccccctacaccttccccggcggcaccggccacgtgatcaacaagaacaacagaagactggccgaggtgtggatggacgagttcaaggacttcttctacatcatcagccccggcgtggtgaaggtggactacggcgacgtgagcgtgagaaagaccctgagagagaacctgaagtgcaagcccttcagctggtacctggagaacatctaccccgacagccagatccccagaagatactacagcctgggcgagatcagaaacgtggagaccaaccagtgcctggacaacatgggcagaaaggagaacgagaaggtgggcatcttcaactgccacggcatgggcggcaaccaggtgttcagctacaccgccgacaaggagatcagaaccgacgacctgtgcctggacgtgagcagactgaacggccccgtgatcatgctgaagtgccaccacatgagaggcaaccagctgtgggagtacgacgccgagagactgaccctgagacacgtgaacagcaaccagtgcctggacgagcccagcgaggaggacaagatggtgcccaccatgcaggactgcagcggcagcagaagccagcagtggctgctgagaaacatgaccctgggcacctag

SEQ ID NO: 104635 - DNA, 1686 bp, Artificial Sequence
  Description of Artificial Sequence: Synthetic coding sequence
atgagaagattcgtgtactgcaaggtggtgctggccaccagcctgatgtgggtgctggtggacgtgttcctgctgctgtacttcagcgagtgcaacaagtgcgacgacaagaaggagagaagcctgctgcccgccctgagagccgtgatcagcagaaaccaggagggccccggcgagatgggcaaggccgtgctgatccccaaggacgaccaggagaagatgaaggagctgttcaagatcaaccagttcaacctgatggccagcgacctgatcgccctgaacagaagcctgcccgacgtgagactggagggctgcaagaccaaggtgtaccccgacgagctgcccaacaccagcgtggtgatcgtgttccacaacgaggcctggagcaccctgctgagaaccgtgtacagcgtgatcaacagaagcccccactacctgctgagcgaggtgatcctggtggacgacgccagcgagagagacttcctgaagctgaccctggagaactacgtgaagaacctggaggtgcccgtgaagatcatcagaatggaggagagaagcggcctgatcagagccagactgagaggcgccgccgccagcaagggccaggtgatcaccttcctggacgcccactgcgagtgcaccctgggctggctggagcccctgctggccagaatcaaggaggacagaaagaccgtggtgtgccccatcatcgacgtgatcagcgacgacaccttcgagtacatggccggcagcgacatgacctacggcggcttcaactggaagctgaacttcagatggtaccccgtgccccagagagagatggacagaagaaagggcgacagaaccctgcccgtgagaacccccaccatggccggcggcctgttcagcatcgacagaaactacttcgaggagatcggcacctacgacgccggcatggacatctggggcggcgagaacctggagatgagcttcagaatctggcagtgcggcggcagcctggagatcgtgacctgcagccacgtgggccacgtgttcagaaaggccaccccctacaccttccccggcggcaccggccacgtgatcaacaagaacaacagaagactggccgaggtgtggatggacgagttcaaggacttcttctacatcatcagccccggcgtggtgaaggtggactacggcgacgtgagcgtgagaaagaccctgagagagaacctgaagtgcaagcccttcagctggtacctggagaacatctaccccgacagccagatccccagaagatactacagcctgggcgagatcagaaacgtggagaccaaccagtgcctggacaacatgggcagaaaggagaacgagaaggtgggcatcttcaactgccacggcatgggcggcaaccaggtgttcagctacaccgccgacaaggagatcagaaccgacgacctgtgcctggacgtgagcagactgaacggccccgtgatcatgctgaagtgccaccacatgagaggcaaccagctgtgggagtacgacgccgagagctgcctgagcgtgaacaaggtggccgacggcagccagcaccccaccgtggagacctgcaacgacagcaccctgcagaagtggctgctgagaaactacaccagaatggagatcttcagaaacatcttcggcaacagcaccgactacatcctgtag

SEQ ID NO: 104636 - DNA, 60 bp, Artificial Sequence
  Description of Artificial Sequence: Synthetic coding sequence
atgagaagattcgtgtactgcaaggtggtgctggccaccagcctgatgtgggtgctgtag

SEQ ID NO: 104637 - DNA, 1659 bp, Artificial Sequence
  Description of Artificial Sequence: Synthetic coding sequence
atgagaagactgaccagaagactggtgctgcccgtgttcggcgtgctgtggatcaccgtgctgctgttcttctgggtgaccaagagaaagctggaggtgcccaccggccccgaggtgcagacccccaagcccagcgacgccgactgggacgacctgtgggaccagttcgacgagagaagatacctgaacgccaagaagtggagagtgggcgacgacccctacaagctgtacgccttcaaccagagagagagcgagagaatcagcagcaacagagccatccccgacaccagacacctgagatgcaccctgctggtgtactgcaccgacctgccccccaccagcatcatcatcaccttccacaacgaggccagaagcaccctgctgagaaccatcagaagcgtgctgaacagaacccccacccacctgatcagagagatcatcctggtggacgacttcagcaacgaccccgacgactgcaagcagctgatcaagctgcccaaggtgaagtgcctgagaaacaacgagagacagggcctggtgagaagcagaatcagaggcgccgacatcgcccagggcaccaccctgaccttcctggacagccactgcgaggtgaacagagactggctgcagcccctgctgcacagagtgaaggaggactacaccagagtggtgtgccccgtgatcgacatcatcaacctggacaccttcacctacatcgagagcgccagcgagctgagaggcggcttcgactggagcctgcacttccagtgggagcagctgagccccgagcagaaggccagaagactggaccccaccgagcccatcagaacccccatcatcgccggcggcctgttcgtgatcgacaaggcctggttcgactacctgggcaagtacgacatggacatggacatctggggcggcgagaacttcgagatcagcttcagagtgtggatgtgcggcggcagcctggagatcgtgccctgcagcagagtgggccacgtgttcagaaagaagcacccctacgtgttccccgacggcaacgccaacacctacatcaagaacaccaagagaaccgccgaggtgtggatggacgagtacaagcagtactactacgccgccagacccttcgccctggagagacccttcggcaacgtggagagcagactggacctgagaaagaacctgagatgccagagcttcaagtggtacctggagaacatctaccccgagctgagcatccccaaggagagcagcatccagaagggcaacatcagacagagacagaagtgcctggagagccagagacagaacaaccaggagacccccaacctgaagctgagcccctgcgccaaggtgaagggcgaggacgccaagagccaggtgtgggccttcacctacacccagcagatcctgcaggaggagctgtgcctgagcgtgatcaccctgttccccggcgcccccgtggtgctggtgctgtgcaagaacggcgacgacagacagcagtggaccaagaccggcagccacatcgagcacatcgccagccacctgtgcctggacaccgacatgttcggcgacggcaccgagaacggcaaggagatcgtggtgaacccctgcgagagcagcctgatgagccagcactgggacatggtgagcagctag

SEQ ID NO: 104638 - DNA, 1560 bp, Artificial Sequence
  Description of Artificial Sequence: Synthetic coding sequence
atgagaagactgaccagaagactggtgctgcccgtgttcggcgtgctgtggatcaccgtgctgctgttcttctgggtgaccaagagaaagctggaggtgcccaccggccccgaggtgcagacccccaagcccagcgacgccgactgggacgacctgtgggaccagttcgacgagagaagatacctgaacgccaagaagtggagagtgggcgacgacccctacaagctgtacgccttcaaccagagagagagcgagagaatcagcagcaacagagccatccccgacaccagacacctgagcgtgctgaacagaacccccacccacctgatcagagagatcatcctggtggacgacttcagcaacgaccccgacgactgcaagcagctgatcaagctgcccaaggtgaagtgcctgagaaacaacgagagacagggcctggtgagaagcagaatcagaggcgccgacatcgcccagggcaccaccctgaccttcctggacagccactgcgaggtgaacagagactggctgcagcccctgctgcacagagtgaaggaggactacaccagagtggtgtgccccgtgatcgacatcatcaacctggacaccttcacctacatcgagagcgccagcgagctgagaggcggcttcgactggagcctgcacttccagtgggagcagctgagccccgagcagaaggccagaagactggaccccaccgagcccatcagaacccccatcatcgccggcggcctgttcgtgatcgacaaggcctggttcgactacctgggcaagtacgacatggacatggacatctggggcggcgagaacttcgagatcagcttcagagtgtggatgtgcggcggcagcctggagatcgtgccctgcagcagagtgggccacgtgttcagaaagaagcacccctacgtgttccccgacggcaacgccaacacctacatcaagaacaccaagagaaccgccgaggtgtggatggacgagtacaagcagtactactacgccgccagacccttcgccctggagagacccttcggcaacgtggagagcagactggacctgagaaagaacctgagatgccagagcttcaagtggtacctggagaacatctaccccgagctgagcatccccaaggagagcagcatccagaagggcaacatcagacagagacagaagtgcctggagagccagagacagaacaaccaggagacccccaacctgaagctgagcccctgcgccaaggtgaagggcgaggacgccaagagccaggtgtgggccttcacctacacccagcagatcctgcaggaggagctgtgcctgagcgtgatcaccctgttccccggcgcccccgtggtgctggtgctgtgcaagaacggcgacgacagacagcagtggaccaagaccggcagccacatcgagcacatcgccagccacctgtgcctggacaccgacatgttcggcgacggcaccgagaacggcaaggagatcgtggtgaacccctgcgagagcagcctgatgagccagcactgggacatggtgagcagctag

SEQ ID NO: 104639 - DNA, 1599 bp, Artificial Sequence
  Description of Artificial Sequence: Synthetic coding sequence
atgagcttccccatgagcctggccagaagcagcgtgcccttcgccgacagcggcctgagcagcagccagcccagcgacgccgactgggacgacctgtgggaccagttcgacgagagaagatacctgaacgccaagaagtggagagtgggcgacgacccctacaagctgtacgccttcaaccagagagagagcgagagaatcagcagcaacagagccatccccgacaccagacacctgagatgcaccctgctggtgtactgcaccgacctgccccccaccagcatcatcatcaccttccacaacgaggccagaagcaccctgctgagaaccatcagaagcgtgctgaacagaacccccacccacctgatcagagagatcatcctggtggacgacttcagcaacgaccccgacgactgcaagcagctgatcaagctgcccaaggtgaagtgcctgagaaacaacgagagacagggcctggtgagaagcagaatcagaggcgccgacatcgcccagggcaccaccctgaccttcctggacagccactgcgaggtgaacagagactggctgcagcccctgctgcacagagtgaaggaggactacaccagagtggtgtgccccgtgatcgacatcatcaacctggacaccttcacctacatcgagagcgccagcgagctgagaggcggcttcgactggagcctgcacttccagtgggagcagctgagccccgagcagaaggccagaagactggaccccaccgagcccatcagaacccccatcatcgccggcggcctgttcgtgatcgacaaggcctggttcgactacctgggcaagtacgacatggacatggacatctggggcggcgagaacttcgagatcagcttcagagtgtggatgtgcggcggcagcctggagatcgtgccctgcagcagagtgggccacgtgttcagaaagaagcacccctacgtgttccccgacggcaacgccaacacctacatcaagaacaccaagagaaccgccgaggtgtggatggacgagtacaagcagtactactacgccgccagacccttcgccctggagagacccttcggcaacgtggagagcagactggacctgagaaagaacctgagatgccagagcttcaagtggtacctggagaacatctaccccgagctgagcatccccaaggagagcagcatccagaagggcaacatcagacagagacagaagtgcctggagagccagagacagaacaaccaggagacccccaacctgaagctgagcccctgcgccaaggtgaagggcgaggacgccaagagccaggtgtgggccttcacctacacccagcagatcctgcaggaggagctgtgcctgagcgtgatcaccctgttccccggcgcccccgtggtgctggtgctgtgcaagaacggcgacgacagacagcagtggaccaagaccggcagccacatcgagcacatcgccagccacctgtgcctggacaccgacatgttcggcgacggcaccgagaacggcaaggagatcgtggtgaacccctgcgagagcagcctgatgagccagcactgggacatggtgagcagctag

SEQ ID NO: 104640 - DNA, 1554 bp, Artificial Sequence
  Description of Artificial Sequence: Synthetic coding sequence
atggcccaggacgagagctgcccccccagcgacgccgactgggacgacctgtgggaccagttcgacgagagaagatacctgaacgccaagaagtggagagtgggcgacgacccctacaagctgtacgccttcaaccagagagagagcgagagaatcagcagcaacagagccatccccgacaccagacacctgagatgcaccctgctggtgtactgcaccgacctgccccccaccagcatcatcatcaccttccacaacgaggccagaagcaccctgctgagaaccatcagaagcgtgctgaacagaacccccacccacctgatcagagagatcatcctggtggacgacttcagcaacgaccccgacgactgcaagcagctgatcaagctgcccaaggtgaagtgcctgagaaacaacgagagacagggcctggtgagaagcagaatcagaggcgccgacatcgcccagggcaccaccctgaccttcctggacagccactgcgaggtgaacagagactggctgcagcccctgctgcacagagtgaaggaggactacaccagagtggtgtgccccgtgatcgacatcatcaacctggacaccttcacctacatcgagagcgccagcgagctgagaggcggcttcgactggagcctgcacttccagtgggagcagctgagccccgagcagaaggccagaagactggaccccaccgagcccatcagaacccccatcatcgccggcggcctgttcgtgatcgacaaggcctggttcgactacctgggcaagtacgacatggacatggacatctggggcggcgagaacttcgagatcagcttcagagtgtggatgtgcggcggcagcctggagatcgtgccctgcagcagagtgggccacgtgttcagaaagaagcacccctacgtgttccccgacggcaacgccaacacctacatcaagaacaccaagagaaccgccgaggtgtggatggacgagtacaagcagtactactacgccgccagacccttcgccctggagagacccttcggcaacgtggagagcagactggacctgagaaagaacctgagatgccagagcttcaagtggtacctggagaacatctaccccgagctgagcatccccaaggagagcagcatccagaagggcaacatcagacagagacagaagtgcctggagagccagagacagaacaaccaggagacccccaacctgaagctgagcccctgcgccaaggtgaagggcgaggacgccaagagccaggtgtgggccttcacctacacccagcagatcctgcaggaggagctgtgcctgagcgtgatcaccctgttccccggcgcccccgtggtgctggtgctgtgcaagaacggcgacgacagacagcagtggaccaagaccggcagccacatcgagcacatcgccagccacctgtgcctggacaccgacatgttcggcgacggcaccgagaacggcaaggagatcgtggtgaacccctgcgagagcagcctgatgagccagcactgggacatggtgagcagctag

SEQ ID NO: 104641 - DNA, 1674 bp, Artificial Sequence
  Description of Artificial Sequence: Synthetic coding sequence
atgagaagactgaccagaagactggtgctgcccgtgttcggcgtgctgtggatcaccgtgctgctgttcttctgggtgaccaagagaaagctggaggtgcccaccggccccgaggtgcagacccccaaggtgtggagcctgttcttcaaggtggccggcatgagcccctgggccccccaggtgcccgtgagccccacccccccctaccagagaggccacctgcccaccggcggccacctggccgtgtgccacttcccctgcctgctgcaggaggcccagttccacctgcagacccaggtgttcctgcaggtgagatgcaccctgctggtgtactgcaccgacctgccccccaccagcatcatcatcaccttccacaacgaggccagaagcaccctgctgagaaccatcagaagcgtgctgaacagaacccccacccacctgatcagagagatcatcctggtggacgacttcagcaacgaccccgacgactgcaagcagctgatcaagctgcccaaggtgaagtgcctgagaaacaacgagagacagggcctggtgagaagcagaatcagaggcgccgacatcgcccagggcaccaccctgaccttcctggacagccactgcgaggtgaacagagactggctgcagcccctgctgcacagagtgaaggaggactacaccagagtggtgtgccccgtgatcgacatcatcaacctggacaccttcacctacatcgagagcgccagcgagctgagaggcggcttcgactggagcctgcacttccagtgggagcagctgagccccgagcagaaggccagaagactggaccccaccgagcccatcagaacccccatcatcgccggcggcctgttcgtgatcgacaaggcctggttcgactacctgggcaagtacgacatggacatggacatctggggcggcgagaacttcgagatcagcttcagagtgtggatgtgcggcggcagcctggagatcgtgccctgcagcagagtgggccacgtgttcagaaagaagcacccctacgtgttccccgacggcaacgccaacacctacatcaagaacaccaagagaaccgccgaggtgtggatggacgagtacaagcagtactactacgccgccagacccttcgccctggagagacccttcggcaacgtggagagcagactggacctgagaaagaacctgagatgccagagcttcaagtggtacctggagaacatctaccccgagctgagcatccccaaggagagcagcatccagaagggcaacatcagacagagacagaagtgcctggagagccagagacagaacaaccaggagacccccaacctgaagctgagcccctgcgccaaggtgaagggcgaggacgccaagagccaggtgtgggccttcacctacacccagcagatcctgcaggaggagctgtgcctgagcgtgatcaccctgttccccggcgcccccgtggtgctggtgctgtgcaagaacggcgacgacagacagcagtggaccaagaccggcagccacatcgagcacatcgccagccacctgtgcctggacaccgacatgttcggcgacggcaccgagaacggcaaggagatcgtggtgaacccctgcgagagcagcctgatgagccagcactgggacatggtgagcagctag

SEQ ID NO: 104642 - DNA, 1716 bp, Artificial Sequence
  Description of Artificial Sequence: Synthetic coding sequence
atgagaagaagaagcagaatgctgctgtgcttcgccttcctgtgggtgctgggcatcgcctactacatgtacagcggcggcggcagcgccctggccggcggcgccggcggcggcgccggcagaaaggaggactggaacgagatcgaccccatcaagaagaaggacctgcaccacagcaacggcgaggagaaggcccagagcatggagaccctgccccccggcaaggtgagatggcccgacttcaaccaggaggcctacgtgggcggcaccatggtgagaagcggccaggacccctacgccagaaacaagttcaaccaggtggagagcgacaagctgagaatggacagagccatccccgacaccagacacgaccagtgccagagaaagcagtggagagtggacctgcccgccaccagcgtggtgatcaccttccacaacgaggccagaagcgccctgctgagaaccgtggtgagcgtgctgaagaagagccccccccacctgatcaaggagatcatcctggtggacgactacagcaacgaccccgaggacggcgccctgctgggcaagatcgagaaggtgagagtgctgagaaacgacagaagagagggcctgatgagaagcagagtgagaggcgccgacgccgcccaggccaaggtgctgaccttcctggacagccactgcgagtgcaacgagcactggctggagcccctgctggagagagtggccgaggacagaaccagagtggtgagccccatcatcgacgtgatcaacatggacaacttccagtacgtgggcgccagcgccgacctgaagggcggcttcgactggaacctggtgttcaagtgggactacatgacccccgagcagagaagaagcagacagggcaaccccgtggcccccatcaagacccccatgatcgccggcggcctgttcgtgatggacaagttctacttcgaggagctgggcaagtacgacatgatgatggacgtgtggggcggcgagaacctggagatcagcttcagagtgtggcagtgcggcggcagcctggagatcatcccctgcagcagagtgggccacgtgttcagaaagcagcacccctacaccttccccggcggcagcggcaccgtgttcgccagaaacaccagaagagccgccgaggtgtggatggacgagtacaagaacttctactacgccgccgtgcccagcgccagaaacgtgccctacggcaacatccagagcagactggagctgagaaagaagctgagctgcaagcccttcaagtggtacctggagaacgtgtaccccgagctgagagtgcccgaccaccaggacatcgccttcggcgccctgcagcagggcaccaactgcctggacaccctgggccacttcgccgacggcgtggtgggcgtgtacgagtgccacaacgccggcggcaaccaggagtgggccctgaccaaggagaagagcgtgaagcacatggacctgtgcctgaccgtggtggacagagcccccggcagcctgatcaagctgcagggctgcagagagaacgacagcagacagaagtgggagcagatcgagggcaacagcaagctgagacacgtgggcagcaacctgtgcctggacagcagaaccgccaagagcggcggcctgagcgtggaggtgtgcggccccgccctgagccagcagtggaagttcaccctgaacctgcagcagtag

SEQ ID NO: 104643 - DNA, 798 bp, Artificial Sequence
  Description of Artificial Sequence: Synthetic coding sequence
atggtgagaagcggccaggacccctacgccagaaacaagttcaaccaggtggagagcgacaagctgagaatggacagagccatccccgacaccagacacgaccagtgccagagaaagcagtggagagtggacctgcccgccaccagcgtggtgatcaccttccacaacgaggccagaagcgccctgctgagaaccgtggtgagcgtgctgaagaagagccccccccacctgatcaaggagatcatcctggtggacgactacagcaacgaccccgaggacggcgccctgctgggcaagatcgagaaggtgagagtgctgagaaacgacagaagagagggcctgatgagaagcagagtgagaggcgccgacgccgcccaggccaaggtgctgaccttcctggacagccactgcgagtgcaacgagcactggctggagcccctgctggagagagtggccgaggacagaaccagagtggtgagccccatcatcgacgtgatcaacatggacaacttccagtacgtgggcgccagcgccgacctgaagggcggcttcgactggaacctggtgttcaagtgggactacatgacccccgagcagagaagaagcagacagggcaaccccgtggcccccatcaaggacctggtgcccagagtggccgtgtggtggcagcccggcgaccaccccgtgcagccctgcggcaccagagtgcccgaggccgcccccctgcacgtgcccggctggcagtggcactgcctgtgccccaagcacccccccggcagcagaggcctggacggctag

SEQ ID NO: 104644 - DNA, 1086 bp, Artificial Sequence
  Description of Artificial Sequence: Synthetic coding sequence
atgagaagaagaagcagaatgctgctgtgcttcgccttcctgtgggtgctgggcatcgcctactacatgtacagcggcggcggcagcgccctggccggcggcgccggcggcggcgccggcagaaaggaggactggaacgagatcgaccccatcaagaagaaggacctgcaccacagcaacggcgccgaggacggcgccctgctgggcaagatcgagaaggtgagagtgctgagaaacgacagaagagagggcctgatgagaagcagagtgagaggcgccgacgccgcccaggccaaggtgctgaccttcctggacagccactgcgagtgcaacgagcactggctggagcccctgctggagagagtggccgaggacagaaccagagtggtgagccccatcatcgacgtgatcaacatggacaacttccagtacgtgggcgccagcgccgacctgaagggcggcttcgactggaacctggtgttcaagtgggactacatgacccccgagcagagaagaagcagacagggcaaccccgtggcccccatcaagacccccatgatcgccggcggcctgttcgtgatggacaagttctacttcgaggagctgggcaagtacgacatgatgatggacgtgtggggcggcgagaacctggagatcagcttcagagtgtggcagtgcggcggcagcctggagatcatcccctgcagcagagtgggccacgtgttcagaaagcagcacccctacaccttccccggcggcagcggcaccgtgttcgccagaaacaccagaagagccgccgaggtgtggatggacgagtacaagaacttctactacgccgccgtgcccagcgccagaaacgtgccctacggcaacatccagagcagactggagctgagaaagaagctgagctgcaagcccttcaagtggtacctggagaacgtgtaccccgagctgagagtgcccgaccaccaggacatcgccttcggcgccctgcagcagggcaccaactgcctggacaccctgggccacttcgccgacggcgtggtgggcgtgtacgagtgccacgtggccggcctgagacagtag

SEQ ID NO: 104645 - DNA, 1602 bp, Artificial Sequence
  Description of Artificial Sequence: Synthetic coding sequence
atggccgacagagaggactggaacgagatcgaccccatcaagaagaaggacctgcaccacagcaacggcgaggagaaggcccagagcatggagaccctgccccccggcaaggtgagatggcccgacttcaaccaggaggcctacgtgggcggcaccatggtgagaagcggccaggacccctacgccagaaacaagttcaaccaggtggagagcgacaagctgagaatggacagagccatccccgacaccagacacgaccagtgccagagaaagcagtggagagtggacctgcccgccaccagcgtggtgatcaccttccacaacgaggccagaagcgccctgctgagaaccgtggtgagcgtgctgaagaagagccccccccacctgatcaaggagatcatcctggtggacgactacagcaacgaccccgaggacggcgccctgctgggcaagatcgagaaggtgagagtgctgagaaacgacagaagagagggcctgatgagaagcagagtgagaggcgccgacgccgcccaggccaaggtgctgaccttcctggacagccactgcgagtgcaacgagcactggctggagcccctgctggagagagtggccgaggacagaaccagagtggtgagccccatcatcgacgtgatcaacatggacaacttccagtacgtgggcgccagcgccgacctgaagggcggcttcgactggaacctggtgttcaagtgggactacatgacccccgagcagagaagaagcagacagggcaaccccgtggcccccatcaagacccccatgatcgccggcggcctgttcgtgatggacaagttctacttcgaggagctgggcaagtacgacatgatgatggacgtgtggggcggcgagaacctggagatcagcttcagagtgtggcagtgcggcggcagcctggagatcatcccctgcagcagagtgggccacgtgttcagaaagcagcacccctacaccttccccggcggcagcggcaccgtgttcgccagaaacaccagaagagccgccgaggtgtggatggacgagtacaagaacttctactacgccgccgtgcccagcgccagaaacgtgccctacggcaacatccagagcagactggagctgagaaagaagctgagctgcaagcccttcaagtggtacctggagaacgtgtaccccgagctgagagtgcccgaccaccaggacatcgccttcggcgccctgcagcagggcaccaactgcctggacaccctgggccacttcgccgacggcgtggtgggcgtgtacgagtgccacaacgccggcggcaaccaggagtgggccctgaccaaggagaagagcgtgaagcacatggacctgtgcctgaccgtggtggacagagcccccggcagcctgatcaagctgcagggctgcagagagaacgacagcagacagaagtgggagcagatcgagggcaacagcaagctgagacacgtgggcagcaacctgtgcctggacagcagaaccgccaagagcggcggcctgagcgtggaggtgtgcggccccgccctgagccagcagtggaagttcaccctgaacctgcagcagtag

SEQ ID NO: 104646 - DNA, 1902 bp, Artificial Sequence
  Description of Artificial Sequence: Synthetic coding sequence
atggcccacctgaagagactggtgaagctgcacatcaagagacactaccacaagaagttctggaagctgggcgccgtgatcttcttcttcatcatcgtgctggtgctgatgcagagagaggtgagcgtgcagtacagcaaggaggagagcagaatggagagaaacatgaagaacaagaacaagatgctggacctgatgctggaggccgtgaacaacatcaaggacgccatgcccaagatgcagatcggcgcccccgtgagacagaacatcgacgccggcgagagaccctgcctgcagggctactacaccgccgccgagctgaagcccgtgctggacagacccccccaggacagcaacgcccccggcgccagcggcaaggccttcaagaccaccaacctgagcgtggaggagcagaaggagaaggagagaggcgaggccaagcactgcttcaacgccttcgccagcgacagaatcagcctgcacagagacctgggccccgacaccagaccccccgagtgcatcgagcagaagttcaagagatgcccccccctgcccaccaccagcgtgatcatcgtgttccacaacgaggcctggagcaccctgctgagaaccgtgcacagcgtgctgtacagcagccccgccatcctgctgaaggagatcatcctggtggacgacgccagcgtggacgagtacctgcacgacaagctggacgagtacgtgaagcagttcagcatcgtgaagatcgtgagacagagagagagaaagggcctgatcaccgccagactgctgggcgccaccgtggccaccgccgagaccctgaccttcctggacgcccactgcgagtgcttctacggctggctggagcccctgctggccagaatcgccgagaactacaccgccgtggtgagccccgacatcgccagcatcgacctgaacaccttcgagttcaacaagcccagcccctacggcagcaaccacaacagaggcaacttcgactggagcctgagcttcggctgggagagcctgcccgaccacgagaagcagagaagaaaggacgagacctaccccatcaagacccccaccttcgccggcggcctgttcagcatcagcaaggagtacttcgagtacatcggcagctacgacgaggagatggagatctggggcggcgagaacatcgagatgagcttcagagtgtggcagtgcggcggccagctggagatcatgccctgcagcgtggtgggccacgtgttcagaagcaagagcccccacagcttccccaagggcacccaggtgatcgccagaaaccaggtgagactggccgaggtgtggatggacgagtacaaggagatcttctacagaagaaacaccgacgccgccaagatcgtgaagcagaaggccttcggcgacctgagcaagagattcgagatcaagcacagactgcagtgcaagaacttcacctggtacctgaacaacatctaccccgaggtgtacgtgcccgacctgaaccccgtgatcagcggctacatcaagagcgtgggccagcccctgtgcctggacgtgggcgagaacaaccagggcggcaagcccctgatcatgtacacctgccacggcctgggcggcaaccagtacttcgagtacagcgcccagcacgagatcagacacaacatccagaaggagctgtgcctgcacgccgcccagggcctggtgcagctgaaggcctgcacctacaagggccacaagaccgtggtgaccggcgagcagatctgggagatccagaaggaccagctgctgtacaaccccttcctgaagatgtgcctgagcgccaacggcgagcaccccagcctggtgagctgcaaccccagcgaccccctgcagaagtggatcctgagccagaacgactag

SEQ ID NO: 104647 - DNA, 1395 bp, Artificial Sequence
  Description of Artificial Sequence: Synthetic coding sequence
atggcccacctgaagagactggtgaagctgcacatcaagagacactaccacaagaagttctggaagctgggcgccgtgatcttcttcttcatcatcgtgctggtgctgatgcagagagaggtgagcgtgcagtacagcaaggaggagagcagaatggagagaaacatgaagaacaagaacaagatgctggacctgatgctggaggccgtgaacaacatcaaggacgccatgcccaagatgcagatcggcgcccccgtgagacagaacatcgacgccggcgagagaccctgcctgcagggctactacaccgccgccgagctgaagcccgtgctggacagacccccccaggacagcaacgcccccggcgccagcggcaaggccttcaagaccaccaacctgagcgtggaggagcagaaggagaaggagagaggcgaggccaagcactgcttcaacgccttcgccagcgacagaatcagcctgcacagagacctgggccccgacaccagaccccccgagtgcatcgagcagaagttcaagagatgcccccccctgcccaccaccagcgtgatcatcgtgttccacaacgaggcctggagcaccctgctgagaaccgtgcacagcgtgctgtacagcagccccgccatcctgctgaaggagatcatcctggtggacgacgccagcgtggacgagtacctgcacgacaagctggacgagtacgtgaagcagttcagcatcgtgaagatcgtgagacagagagagagaaagggcctgatcaccgccagactgctgggcgccaccgtggccaccgccgagaccctgaccttcctggacgcccactgcgagtgcttctacggctggctggagcccctgctggccagaatcgccgagaactacaccgccgtggtgagccccgacatcgccagcatcgacctgaacaccttcgagttcaacaagcccagcccctacggcagcaaccacaacagaggcaacttcgactggagcctgagcttcggctgggagagcctgcccgaccacgagaagcagagaagaaaggacgagacctaccccatcaagacccccaccttcgccggcggcctgttcagcatcagcaaggagtacttcgagtacatcggcagctacgacgaggagatggagatctggggcggcgagaacatcgagatgagcttcagagtgtggcagtgcggcggccagctggagatcatgccctgcagcgtggtgggccacgtgttcagaagcaagagcccccacagcttccccaagggcacccaggtgatcgccagaaaccaggtgagactggccgaggtgtggatggacgagtacaaggagatcttctacagaagaaacaccgacgccgccaagatcgtgaagcagtag

SEQ ID NO: 104648 - DNA, 174 bp, Artificial Sequence
  Description of Artificial Sequence: Synthetic coding sequence
atggcccacctgaagagactggtgaagctgcacatcaagagacactaccacaagaagttctggaagctgggcgccgtgatcttcttcttcatcatcgtgctggtgctgatgcagagagaggtgagcgtgcagtacagcaaggaggagagcagaatggagagaaacatgaagtag

SEQ ID NO: 104649 - DNA, 78 bp, Artificial Sequence
  Description of Artificial Sequence: Synthetic coding sequence
atggcccacctgaagagactggtgaagctgcacatcaagagacactaccacaagaagttctggaagctgggcgcctag

SEQ ID NO: 104650 - DNA, 273 bp, Artificial Sequence
  Description of Artificial Sequence: Synthetic coding sequence
atggcccacctgaagagactggtgaagctgcacatcaagagacactaccacaagaagttctggaagctgggcgccgtgatcttcttcttcatcatcgtgctggtgctgatgcagagagaggtgagcgtgcagtacagcaaggaggagagcagaatggagagaaacatgaagaacaagaacaagatgctggacctgatgctggaggccgtgaacaacatcaaggacgccatgcccaagatgcagatcggcgcccccgtgagacagaacatctag

SEQ ID NO: 104651 - DNA, 36 bp, Artificial Sequence
  Description of Artificial Sequence: Synthetic coding sequence
atggcccacctgaagagactggtgaagctgcactag

SEQ ID NO: 104652 - DNA, 1737 bp, Artificial Sequence
  Description of Artificial Sequence: Synthetic coding sequence
atggccgtgagatggacctgggccggcaagagctgcctgctgctggccttcctgaccgtggcctacatcttcgtggagctgctggtgagcaccttccacgccagcgccggcgccggcagagccagagagctgggcagcagaagactgagcgacctgcagaagaacaccgaggacctgagcagacccctgtacaagaagccccccgccgacagcagagccctgggcgagtggggcaaggccagcaagctgcagctgaacgaggacgagctgaagcagcaggaggagctgatcgagagatacgccatcaacatctacctgagcgacagaatcagcctgcacagacacatcgaggacaagagaatgtacgagtgcaagagccagaagttcaactacagaaccctgcccaccaccagcgtgatcatcgccttctacaacgaggcctggagcaccctgctgagaaccatccacagcgtgctggagaccagccccgccgtgctgctgaaggagatcatcctggtggacgacctgagcgacagagtgtacctgaagacccagctggagacctacatcagcaacctggacagagtgagactgatcagaaccaacaagagagagggcctggtgagagccagactgatcggcgccaccttcgccaccggcgacgtgctgaccttcctggactgccactgcgagtgcaacagcggctggctggagcccctgctggagagaatcggcagagacgagaccgccgtggtgtgccccgtgatcgacaccatcgactggaacaccttcgagttctacatgcagatcggcgagcccatgatcggcggcttcgactggagactgaccttccagtggcacagcgtgcccaagcaggagagagacagaagaatcagcagaatcgaccccatcagaagccccaccatggccggcggcctgttcgccgtgagcaagaagtacttccagtacctgggcacctacgacaccggcatggaggtgtggggcggcgagaacctggagctgagcttcagagtgtggcagtgcggcggcaagctggagatccacccctgcagccacgtgggccacgtgttccccaagagagccccctacgccagacccaacttcctgcagaacaccgccagagccgccgaggtgtggatggacgagtacaaggagcacttctacaacagaaacccccccgccagaaaggaggcctacggcgacatcagcgagagaaagctgctgagagagagactgagatgcaagagcttcgactggtacctgaagaacgtgttccccaacctgcacgtgcccgaggacagacccggctggcacggcgccatcagaagcagaggcatcagcagcgagtgcctggactacaacagccccgacaacaaccccaccggcgccaacctgagcctgttcggctgccacggccagggcggcaaccagttcttcgagtacaccagcaacaaggagatcagattcaacagcgtgaccgagctgtgcgccgaggtgcccgagcagaagaactacgtgggcatgcagaactgccccaaggacggcttccccgtgcccgccaacatcatctggcacttcaaggaggacggcaccatcttccacccccacagcggcctgtgcctgagcgcctacagaacccccgagggcagacccgacgtgcagatgagaacctgcgacgccctggacaagaaccagatctggagcttcgagaagtag

SEQ ID NO: 104653 - DNA, 1869 bp, Artificial Sequence
  Description of Artificial Sequence: Synthetic coding sequence
atgagactgctgagaagaagacacatgcccctgagactggccatggtgggctgcgccttcgtgctgttcctgttcctgctgcacagagacgtgagcagcagagaggaggccaccgagaagccctggctgaagagcctggtgagcagaaaggaccacgtgctggacctgatgctggaggccatgaacaacctgagagacagcatgcccaagctgcagatcagagcccccgaggcccagcagaccctgttcagcatcaaccagagctgcctgcccggcttctacacccccgccgagctgaagcccttctgggagagacccccccaggaccccaacgcccccggcgccgacggcaaggccttccagaagagcaagtggacccccctggagacccaggagaaggaggagggctacaagaagcactgcttcaacgccttcgccagcgacagaatcagcctgcagagaagcctgggccccgacaccagaccccccgagtgcgtggaccagaagttcagaagatgcccccccctggccaccaccagcgtgatcatcgtgttccacaacgaggcctggagcaccctgctgagaaccgtgtacagcgtgctgcacaccacccccgccatcctgctgaaggagatcatcctggtggacgacgccagcaccgaggagcacctgaaggagaagctggagcagtacgtgaagcagctgcaggtggtgagagtggtgagacaggaggagagaaagggcctgatcaccgccagactgctgggcgccagcgtggcccaggccgaggtgctgaccttcctggacgcccactgcgagtgcttccacggctggctggagcccctgctggccagaatcgccgaggacaagaccgtggtggtgagccccgacatcgtgaccatcgacctgaacaccttcgagttcgccaagcccgtgcagagaggcagagtgcacagcagaggcaacttcgactggagcctgaccttcggctgggagaccctgcccccccacgagaagcagagaagaaaggacgagacctaccccatcaagagccccaccttcgccggcggcctgttcagcatcagcaagagctacttcgagcacatcggcacctacgacaaccagatggagatctggggcggcgagaacgtggagatgagcttcagagtgtggcagtgcggcggccagctggagatcatcccctgcagcgtggtgggccacgtgttcagaaccaagagcccccacaccttccccaagggcaccagcgtgatcgccagaaaccaggtgagactggccgaggtgtggatggacagctacaagaagatcttctacagaagaaacctgcaggccgccaagatggcccaggagaagagcttcggcgacatcagcgagagactgcagctgagagagcagctgcactgccacaacttcagctggtacctgcacaacgtgtaccccgagatgttcgtgcccgacctgacccccaccttctacggcgccatcaagaacctgggcaccaaccagtgcctggacgtgggcgagaacaacagaggcggcaagcccctgatcatgtacagctgccacggcctgggcggcaaccagtacttcgagtacaccacccagagagacctgagacacaacatcgccaagcagctgtgcctgcacgtgagcaagggcgccctgggcctgggcagctgccacttcaccggcaagaacagccaggtgcccaaggacgaggagtgggagctggcccaggaccagctgatcagaaacagcggcagcggcacctgcctgaccagccaggacaagaagcccgccatggccccctgcaaccccagcgacccccaccagctgtggctgttcgtgtag

SEQ ID NO: 104654 - DNA, 1869 bp, Artificial Sequence; identical to SEQ ID NO: 104653
  Description of Artificial Sequence: Synthetic coding sequence

SEQ ID NO: 104655 - DNA, 1812 bp, Artificial Sequence
  Description of Artificial Sequence: Synthetic coding sequence
atgagactgctgagaagaagacacatgcccctgagactggccatggtgggctgcgccttcgtgctgttcctgttcctgctggtgagcagaaaggaccacgtgctggacctgatgctggaggccatgaacaacctgagagacagcatgcccaagctgcagatcagagcccccgaggcccagcagaccctgttcagcatcaaccagagctgcctgcccggcttctacacccccgccgagctgaagcccttctgggagagacccccccaggaccccaacgcccccggcgccgacggcaaggccttccagaagagcaagtggacccccctggagacccaggagaaggaggagggctacaagaagcactgcttcaacgccttcgccagcgacagaatcagcctgcagagaagcctgggccccgacaccagaccccccgagtgcgtggaccagaagttcagaagatgcccccccctggccaccaccagcgtgatcatcgtgttccacaacgaggcctggagcaccctgctgagaaccgtgtacagcgtgctgcacaccacccccgccatcctgctgaaggagatcatcctggtggacgacgccagcaccgaggagcacctgaaggagaagctggagcagtacgtgaagcagctgcaggtggtgagagtggtgagacaggaggagagaaagggcctgatcaccgccagactgctgggcgccagcgtggcccaggccgaggtgctgaccttcctggacgcccactgcgagtgcttccacggctggctggagcccctgctggccagaatcgccgaggacaagaccgtggtggtgagccccgacatcgtgaccatcgacctgaacaccttcgagttcgccaagcccgtgcagagaggcagagtgcacagcagaggcaacttcgactggagcctgaccttcggctgggagaccctgcccccccacgagaagcagagaagaaaggacgagacctaccccatcaagagccccaccttcgccggcggcctgttcagcatcagcaagagctacttcgagcacatcggcacctacgacaaccagatggagatctggggcggcgagaacgtggagatgagcttcagagtgtggcagtgcggcggccagctggagatcatcccctgcagcgtggtgggccacgtgttcagaaccaagagcccccacaccttccccaagggcaccagcgtgatcgccagaaaccaggtgagactggccgaggtgtggatggacagctacaagaagatcttctacagaagaaacctgcaggccgccaagatggcccaggagaagagcttcggcgacatcagcgagagactgcagctgagagagcagctgcactgccacaacttcagctggtacctgcacaacgtgtaccccgagatgttcgtgcccgacctgacccccaccttctacggcgccatcaagaacctgggcaccaaccagtgcctggacgtgggcgagaacaacagaggcggcaagcccctgatcatgtacagctgccacggcctgggcggcaaccagtacttcgagtacaccacccagagagacctgagacacaacatcgccaagcagctgtgcctgcacgtgagcaagggcgccctgggcctgggcagctgccacttcaccggcaagaacagccaggtgcccaaggacgaggagtgggagctggcccaggaccagctgatcagaaacagcggcagcggcacctgcctgaccagccaggacaagaagcccgccatggccccctgcaaccccagcgacccccaccagctgtggctgttcgtgtag

SEQ ID NO: 104656 - DNA, 1974 bp, Artificial Sequence
  Description of Artificial Sequence: Synthetic coding sequence
atgagactgaagatcggcttcatcctgagaagcctgctggtggtgggcagcttcctgggcctggtggtgctgtggagcagcctgacccccagacccgacgaccccagccccctgagcagaatgagagaggacagagacgtgaacgaccccatgcccaacagaggcggcaacggcctggcccccggcgaggacagattcaagcccgtggtgccctggccccacgtggagggcgtggaggtggacctggagagcatcagaagaatcaacaaggccaagaacgagcaggagcaccacgccggcggcgacagccagaaggacatcatgcagagacagtacctgaccttcaagccccagaccttcacctaccacgaccccgtgctgagacccggcatcctgggcaacttcgagcccaaggagcccgagccccccggcgtggtgggcggccccggcgagaaggccaagcccctggtgctgggccccgagttcaagcaggccatccaggccagcatcaaggagttcggcttcaacatggtggccagcgacatgatcagcctggacagaagcgtgaacgacctgagacaggaggagtgcaagtactggcactacgacgagaacctgctgaccagcagcgtggtgatcgtgttccacaacgagggctggagcaccctgatgagaaccgtgcacagcgtgatcaagagaacccccagaaagtacctggccgagatcgtgctgatcgacgacttcagcaacaaggagcacctgaaggagaagctggacgagtacatcaagctgtggaacggcctggtgaaggtgttcagaaacgagagaagagagggcctgatccaggccagaagcatcggcgcccagaaggccaagctgggccaggtgctgatctacctggacgcccactgcgaggtggccgtgaactggtacgcccccctggtggcccccatcagcaaggacagaaccatctgcaccgtgcccctgatcgacgtgatcaacggcaacacctacgagatcatcccccagggcggcggcgacgaggacggctacgccagaggcgcctgggactggagcatgctgtggaagagagtgcccctgaccccccaggagaagagactgagaaagaccaagaccgagccctacagaagccccgccatggccggcggcctgttcgccatcgagagagagttcttcttcgagctgggcctgtacgaccccggcctgcagatctggggcggcgagaacttcgagatcagctacaagatctggcagtgcggcggcaagctgctgttcgtgccctgcagcagagtgggccacatctacagactggagggctggcagggcaaccccccccccatctacgtgggcagcagccccaccctgaagaactacgtgagagtggtggaggtgtggtgggacgagtacaaggactacttctacgccagcagacccgagagccaggccctgccctacggcgacatcagcgagctgaagaagttcagagaggaccacaactgcaagagcttcaagtggttcatggaggagatcgcctacgacatcaccagccactaccccctgccccccaagaacgtggactggggcgagatcagaggcttcgagaccgcctactgcatcgacagcatgggcaagaccaacggcggcttcgtggagctgggcccctgccacagaatgggcggcaaccagctgttcagaatcaacgaggccaaccagctgatgcagtacgaccagtgcctgaccaagggcgccgacggcagcaaggtgatgatcacccactgcaacctgaacgagttcaaggagtggcagtacttcaagaacctgcacagattcacccacatccccagcggcaagtgcctggacagaagcgaggtgctgcaccaggtgttcatcagcaactgcgacagcagcaagaccacccagaagtgggagatgaacaacatccacagcgtgtag

SEQ ID NO: 104657 - DNA, 717 bp, Artificial Sequence
  Description of Artificial Sequence: Synthetic coding sequence
atgagaaccgtgcacagcgtgatcaagagaacccccagaaagtacctggccgagatcgtgctgatcgacgacttcagcaacaaggagcacctgaaggagaagctggacgagtacatcaagctgtggaacggcctggtgaaggtgttcagaaacgagagaagagagggcctgatccaggccagaagcatcggcgcccagaaggccaagctgggccaggtgctgatctacctggacgcccactgcgaggtggccgtgaactggtacgcccccctggtggcccccatcagcaaggacagaaccacctgcaccgtgcccctgatcgactacatcgacggcaacgactacagcatcgagccccagcagggcggcgacgaggacggcttcgccagaggcgcctgggactggagcctgctgtggaagagaatccccctgagccacaaggagaaggccaagagaaagcacaagaccgagccctacagaagccccgccatggccggcggcctgttcgccatcgagagagagttcttcttcgagctgggcctgtacgaccccggcctgcagatctggggcggcaagaccctgagaagccacaccagatacggcagcgtggtggccaactactacctgttcctggtgctggtgctggacatcagcaccgtgctgagagccggcaaggagatcctgagacccttcatgctgggcctgctgcagctgtag

SEQ ID NO: 104658 - DNA, 1914 bp, Artificial Sequence
  Description of Artificial Sequence: Synthetic coding sequence
atgatgttctggagaaagctgcccaaggccctgttcatcggcctgaccctggccatcgccgtgaacctgctgctggtgttcagcagcaagggcaccctgcagaacctgttcaccggcggcctgcacagagagctgcccctgcacctgaacaagagatacggcgccgtgatcaagagactgagccacctggaggtggagctgcaggacctgaaggagagcatgaagctggccctgagacagcaggagaacgtgaacagcaccctgaagagagccaaggacgaggtgagacccctgctgaaggccatggagaccaaggtgaacgagaccaagaagcacaagacccagatgaagctgttcccccacagccagctgttcagacagtggggcgaggacctgagcgaggcccagcagaaggccgcccaggacctgttcagaaagttcggctacaacgcctacctgagcaaccagctgcccctgaacagaaccatccccgacaccagagactacagatgcctgagaaagacctaccccagccagctgcccagcctgagcgtgatcctgatcttcgtgaacgaggccctgagcatcatccagagagccatcaccagcatcatcaacagaacccccagcagactgctgaaggagatcatcctggtggacgacttcagcagcaacggcgagctgaaggtgcacctggacgagaagatcaagctgtacaaccagaagtaccccggcctgctgaagatcatcagacaccccgagagaaagggcctggcccaggccagaaacaccggctgggaggccgccaccgccgacgtggtggccatcctggacgcccacatcgaggtgaacgtgggctgggccgagcccatcctggccagaatccaggaggacagaaccgtgatcgtgagccccgtgttcgacaacatcagattcgacaccttcaagctggacaagtacgagctggccgtggacggcttcaactgggagctgtggtgcagatacgacgccctgccccaggcctggatcgacctgcacgacgtgaccgcccccgtgaagagccccagcatcatgggcatcctggccgccaacagacacttcctgggcgagatcggcagcctggacggcggcatgctgatctacggcggcgagaacgtggagctgagcctgagagtgtggcagtgcggcggcaaggtggagatcctgccctgcagcagaatcgcccacctggagagacaccacaagccctacgccctggacctgaccgccgccctgaagagaaacgccctgagagtggccgagatctggatggacgagcacaagcacatggtgtacctggcctggaacatccccctgcagaacagcggcatcgacttcggcgacgtgagcagcagaatggccctgagagagaagctgaagtgcaagaccttcgactggtacctgaagaacgtgtaccccctgctgaagcccctgcacaccatcgtgggctacggcagaatgaagaacctgctggacgagaacgtgtgcctggaccagggccccgtgcccggcaacacccccatcatgtactactgccacgagttcagcagccagaacgtgtactaccacctgaccggcgagctgtacgtgggccagctgatcgccgaggccagcgccagcgacagatgcctgaccgaccccggcaaggccgagaagcccaccctggagccctgcagcaaggccgccaagaacagactgcacatctactgggacttcaagcccggcggcgccgtgatcaacagagacaccaagagatgcctggagatgaagaaggacctgctgggcagccacgtgctggtgctgcagacctgcagcacccaggtgtgggagatccagcacaccgtgagagactggggccagaccaacagccagtag

SEQ ID NO: 104659 - DNA, 648 bp, Artificial Sequence
  Description of Artificial Sequence: Synthetic coding sequence
atggagttcgactgcgagggcctgagaagactgctgggcaagtacaagttcagagacctgaccgtggaggagctgagaaacgtgaacgtgttcttcccccacttcaagtacagcatggacacctacgtgttcaaggacagcagccagaaggacctgctgaacttcaccggcaccatccccgtgatgtaccagggcaacacctacaacatccccatcagattctggatcctggacagccaccccttcgccccccccatctgcttcctgaagcccaccgccaacatgggcatcctggtgggcaagcacgtggacgcccagggcagaatctacctgccctacctgcagaactggagccaccccaagagcgtgatcgtgggcctgatcaaggagatgatcgccaagttccaggaggagctgcccatgtacagcctgagcagcagcgacgaggccagacaggtggacctgctggcctacatcgccaagatcaccgagggcgtgagcgacaccaacagcaagagctgggccaaccacgagaacaagaccgtgaacaagatcaccgtggtgggcggcggcgagctgggcatcgcctgcaccctggccatcagcgccaaggtggagagcagaagcgtgacccaggccggcgtgtag

SEQ ID NO: 104660 - DNA, 1416 bp, Artificial Sequence
  Description of Artificial Sequence: Synthetic coding sequence
atggagttcgactgcgagggcctgagaagactgctgggcaagtacaagttcagagacctgaccgtggaggagctgagaaacgtgaacgtgttcttcccccacttcaagtacagcatggacacctacgtgttcaaggacagcagccagaaggacctgctgaacttcaccggcaccatccccgtgatgtaccagggcaacacctacaacatccccatcagattctggatcctggacagccaccccttcgccccccccatctgcttcctgaagcccaccgccaacatgggcatcctggtgggcaagcacgtggacgcccagggcagaatctacctgccctacctgcagaactggagccaccccaagagcgtgatcgtgggcctgatcaaggagatgatcgccaagttccaggaggagctgcccatgtacagcctgagcagcagcgacgaggccagacaggtggacctgctggcctacatcgccaagatcaccgagggcgtgagcgacaccaacagcaagagctgggccaaccacgagaacaagaccgtgaacaagatcaccgtggtgggcggcggcgagctgggcatcgcctgcaccctggccatcagcgccaagggcatcgccgacagactggtgctgctggacctgagcgagggcaccaagggcgccaccatggacctggagatcttcaacctgcccaacgtggagatcagcaaggacctgagcgccagcgcccacagcaaggtggtgatcttcaccgtgaacagcctgggcagcagccagagctacctggacgtggtgcagagcaacgtggacatgttcagagccctggtgcccgccctgggccactacagccagcacagcgtgctgctggtggccagccagcccgtggagatcatgacctacgtgacctggaagctgagcaccttccccgccaacagagtgatcggcatcggctgcaacctggacagccagagactgcagtacatcatcaccaacgtgctgaaggcccagaccagcggcaaggaggtgtgggtgatcggcgagcagggcgaggacaaggtgctgacctggagcggccaggaggaggtggtgagccacaccagccaggtgcagctgagcaacagagccatggagctgctgagagtgaagggccagagaagctggagcgtgggcctgagcgtggccgacatggtggacagcatcgtgaacaacaagaagaaggtgcacagcgtgagcgccctggccaagggctactacgacatcaacagcgaggtgttcctgagcctgccctgcatcctgggcaccaacggcgtgagcgaggtgatcaagaccaccctgaaggaggacaccgtgaccgagaagctgcagagcagcgccagcagcatccacagcctgcagcagcagctgaagctgtag

SEQ ID NO: 104661 - DNA, 747 bp, Artificial Sequence
  Description of Artificial Sequence: Synthetic coding sequence
atggacctggagatcttcaacctgcccaacgtggagatcagcaaggacctgagcgccagcgcccacagcaaggtggtgatcttcaccgtgaacagcctgggcagcagccagagctacctggacgtggtgcagagcaacgtggacatgttcagagccctggtgcccgccctgggccactacagccagcacagcgtgctgctggtggccagccagcccgtggagatcatgacctacgtgacctggaagctgagcaccttccccgccaacagagtgatcggcatcggctgcaacctggacagccagagactgcagtacatcatcaccaacgtgctgaaggcccagaccagcggcaaggaggtgtgggtgatcggcgagcagggcgaggacaaggtgctgacctggagcggccaggaggaggtggtgagccacaccagccaggtgcagctgagcaacagagccatggagctgctgagagtgaagggccagagaagctggagcgtgggcctgagcgtggccgacatggtggacagcatcgtgaacaacaagaagaaggtgcacagcgtgagcgccctggccaagggctactacgacatcaacagcgaggtgttcctgagcctgccctgcatcctgggcaccaacggcgtgagcgaggtgatcaagaccaccctgaaggaggacaccgtgaccgagaagctgcagagcagcgccagcagcatccacagcctgcagcagcagctgaagctgtag

SEQ ID NO: 104662 - DNA, 1140 bp, Artificial Sequence
  Description of Artificial Sequence: Synthetic coding sequence
atggagttcgactgcgagggcctgagaagactgctgggcaagtacaagttcagagacctgaccgtggaggagctgagaaacgtgaacgtgttcttcccccacttcaagtacagcatggacacctacgtgttcaaggacagcagccagaaggacctgctgaacttcaccggcaccatccccgtgatgtaccagggcaacacctacaacatccccatcagattctggatcctggacagccaccccttcgccccccccatctgcttcctgaagcccaccgccaacatgggcatcctggtgggcaagcacgtggacgcccagggcagaatctacctgccctacctgcagaactggagccaccccaagagcgtgatcgtgggcctgatcaaggagatgatcgccaagttccaggaggagctgcccatgtacagcctgagcagcagcgacgaggccagacaggtggacctgctggcctacatcgccaagatcaccgagggcgtgagcgacaccaacagcaagagctgggccaaccacgagaacaagaccgtgaacaagatcaccgtggtgggcggcggcgagctgggcatcgcctgcaccctggccatcagcgccaagggcatcgccgacagactggtgctgctggacctgagcgagggcaccaagggcgccaccatggacctggagatcttcaacctgcccaacgtggagatcagcaaggacctgagcgccagcgcccacagcaaggtggtgatcttcaccgtgaacagcctgggcagcagccagagctacctggacgtggtgcagagcaacgtggacatgttcagagccctggtgcccgccctgggccactacagccagcacagcgtgctgctggtggccagccagcccgtggagatcatgacctacgtgacctggaagctgagcaccttccccgccaacagagtgatcggcatcggctgcaacctggacagccagagactgcagtacatcatcaccaacgtgctgaaggcccagaccagcggcaaggaggtgtgggtgatcggcgagcagggcgaggacaaggtgctgacctggagcggccaggaggaggtggtgagccacaccagccaggtgcagctgagcaacagagacatcatgatctag

SEQ ID NO: 104663 - DNA, 1350 bp, Artificial Sequence
  Description of Artificial Sequence: Synthetic coding sequence
atggagttcgactgcgagggcctgagaagactgctgggcaagtacaagttcagagacctgaccgtggaggagctgagaaacgtgaacgtgttcttcccccacttcaagtacagcatggacacctacggcaacacctacaacatccccatcagattctggatcctggacagccaccccttcgccccccccatctgcttcctgaagcccaccgccaacatgggcatcctggtgggcaagcacgtggacgcccagggcagaatctacctgccctacctgcagaactggagccaccccaagagcgtgatcgtgggcctgatcaaggagatgatcgccaagttccaggaggagctgcccatgtacagcctgagcagcagcgacgaggccagacaggtggacctgctggcctacatcgccaagatcaccgagggcgtgagcgacaccaacagcaagagctgggccaaccacgagaacaagaccgtgaacaagatcaccgtggtgggcggcggcgagctgggcatcgcctgcaccctggccatcagcgccaagggcatcgccgacagactggtgctgctggacctgagcgagggcaccaagggcgccaccatggacctggagatcttcaacctgcccaacgtggagatcagcaaggacctgagcgccagcgcccacagcaaggtggtgatcttcaccgtgaacagcctgggcagcagccagagctacctggacgtggtgcagagcaacgtggacatgttcagagccctggtgcccgccctgggccactacagccagcacagcgtgctgctggtggccagccagcccgtggagatcatgacctacgtgacctggaagctgagcaccttccccgccaacagagtgatcggcatcggctgcaacctggacagccagagactgcagtacatcatcaccaacgtgctgaaggcccagaccagcggcaaggaggtgtgggtgatcggcgagcagggcgaggacaaggtgctgacctggagcggccaggaggaggtggtgagccacaccagccaggtgcagctgagcaacagagccatggagctgctgagagtgaagggccagagaagctggagcgtgggcctgagcgtggccgacatggtggacagcatcgtgaacaacaagaagaaggtgcacagcgtgagcgccctggccaagggctactacgacatcaacagcgaggtgttcctgagcctgccctgcatcctgggcaccaacggcgtgagcgaggtgatcaagaccaccctgaaggaggacaccgtgaccgagaagctgcagagcagcgccagcagcatccacagcctgcagcagcagctgaagctgtag

SEQ ID NO: 104664 - DNA, 429 bp, Artificial Sequence
  Description of Artificial Sequence: Synthetic coding sequence
atgggcgacaagccccccggcttcagaggcagcagagactggatcggctgcgtggaggccagcctgtgcctggcccacttcggcggcccccagggcagactgtgccacgtgcccagaggcgtgggcctgcacggcgagctggagagactgtacagccacttcgccggcggcggcggccccgtgatggtgggcggcgacgccgacgccagaagcaaggccctgctgggcgtgtgcgtgggcagcggcaccgaggcctacgtgctggtgctggacccccactactggggcacccccaagagccccagcgagctgcaggccgccggctgggtgggctggcaggaggtgagcgccgccttcgaccccaacagcttctacaacctgtgcctgaccagcctgagcagccagcagcagcagagaaccctggactag

SEQ ID NO: 104665 - DNA, 1410 bp, Artificial Sequence
  Description of Artificial Sequence: Synthetic coding sequence
atggtgatcagcgagagcatggacatcctgttcagaatcagaggcggcctggacctggccttccagctggccacccccaacgagatcttcctgaagaaggccctgaagcacgtgctgagcgacctgagcaccaagctgagcagcaacgccctggtgttcagaatctgccacagcagcgtgtacatctggcccagcagcgacatcaacaccatccccggcgagctgaccgacgccagcgcctgcaagaacatcctgagattcatccagttcgagcccgaggaggacatcaagagaaagttcatgagaaagaaggacaagaagctgagcgacatgcaccagatcgtgaacatcgacctgatgctggagatgagcaccagcctggccgccgtgacccccatcatcgagagagagagcggcggccaccactacgtgaacatgaccctgcccgtggacgccgtgatcagcgtggcccccgaggagacctggggcaaggtgagaaagctgctggtggacgccatccacaaccagctgaccgacatggagaagtgcatcctgaagtacatgaagggcaccagcatcgtggtgcccgagcccctgcacttcctgctgcccggcaagaagaacctggtgaccatcagctaccccagcggcatccccgacggccagctgcaggcctacagaaaggagctgcacgacctgttcaacctgccccacgacagaccctacttcaagagaagcaacgcctaccacttccccgacgagccctacaaggacggctacatcagaaacccccacacctacctgaacccccccaacatggagaccggcatgatctacgtggtgcagggcatctacggctaccaccactacatgcaggacagaatcgacgacaacggctggggctgcgcctacagaagcctgcagaccatctgcagctggttcaagcaccagggctacaccgagagaagcatccccacccacagagagatccagcaggccctggtggacgccggcgacaagcccgccaccttcgtgggcagcagacagtggatcggcagcatcgaggtgcagctggtgctgaaccagctgatcggcatcaccagcaagatcctgttcgtgagccagggcagcgagatcgccagccagggcagagagctggccaaccacttccagagcgagggcacccccgtgatgatcggcggcggcgtgctggcccacaccatcctgggcgtggcctggaacgagatcaccggccagatcaagttcctgatcctggacccccactacaccggcgccgaggacctgcaggtgatcctggagaagggctggtgcggctggaagggccccgacttctggaacaaggacgcctactacaacctgtgcctgccccagagacccaacatgatctag

SEQ ID NO: 104666 - DNA, 2484 bp, Artificial Sequence
  Description of Artificial Sequence: Synthetic coding sequence
atggtggtgcagaagccccacggcaccatggagtacaccgccggcaaccaggacaccctgaacagcatcgccctgaagttcaacatcacccccaacaagctggtggagctgaacaagctgttcacccacaccatcgtgcccggccaggtgctgttcgtgcccgacgccaacagccccagcagcaccctgagactgagcagcagcagccccggcgccaccgtgagccccagcagcagcgacgccgagtacgacaagctgcccgacgccgacctggccagaaaggccctgaagcccatcgagagagtgctgagcagcaccagcgaggaggacgagcccggcgtggtgaagttcctgaagatgaactgcagatacttcaccgacggcaagggcgtggtgggcggcgtgatgatcgtgacccccaacaacatcatgttcgacccccacaagagcgaccccctggtgatcgagaacggctgcgaggagtacggcctgatctgccccatggaggaggtggtgagcatcgccctgtacaacgacatcagccacatgaagatcaaggacgccctgcccagccccggcgagtgggaggacctggccagcgagaaggacatcaaccccttcagcaagttcaagagcatcaacaaggagaagagacagcagaacggcgagaagatcatgaccagcgacagcagacccatcgtgcccctggagaagagcaccggccacacccccaccaagcccagcggcagcagcgtgagcgagaagctgaagaagctggacagcagcagagagaccagccacggcagccccaccgtgaccaagctgagcaaggagcccagcgacaccagcagcgccttcgagagcaccgccaaggagaacttcctgggcgaggacgacgacttcgtggacctggaggagctgagcagccagaccggcggcggcatgcacaagaaggacaccctgaaggagtgcctgagcctggaccccgaggagagaaagaaggccgagagccagatcaacaacagcgccgtggagatgcaggtgcagagcgccctggccttcctgggcaccgagaacgacgtggagctgaagggcgccctggacctggagacctgcgagaagcaggacatcatgcccgaggtggacaagcagagcggcagccccgagagcagagtggagaacaccctgaacatccacgaggacctggacaaggtgaagctgatcgagtactacctgaccaagaacaaggagggcccccaggtgagcgagaacctgcagaagaccgagctgagcgacggcaagagcatcgagcccggcggcatcgacatcaccctgagcagcagcctgagccaggccggcgaccccatcaccgagggcaacaaggagcccgacaagacctgggtgaagaagggcgagcccctgcccgtgaagctgaacagcagcaccgaggccaacgtgatcaaggaggccctggacagcagcctggagagcaccctggacaacagctgccagggcgcccagatggacaacaagagcgaggtgcagctgtggctgctgaagagaatccaggtgcccatcgaggacatcctgcccagcaaggaggagaagagcaagaccccccccatgttcctgtgcatcaaggtgggcaagcccatgagaaagagcttcgccacccacaccgccgccatggtgcagcagtacggcaagagaagaaagcagcccgagtactggttcgccgtgcccagagagagagtggaccacctgtacaccttcttcgtgcagtggagccccgacgtgtacggcaaggacgccaaggagcagggcttcgtggtggtggagaaggaggagctgaacatgatcgacaacttcttcagcgagcccaccaccaagagctgggagatcatcaccgtggaggaggccaagagaagaaagagcacctgcagctactacgaggacgaggacgaggaggtgctgcccgtgctgagaccccacagcgccctgctggagaacatgcacatcgagcagctggccagaagactgcccgccagagtgcagggctacccctggagactggcctacagcaccctggagcacggcaccagcctgaagaccctgtacagaaagagcgccagcctggacagccccgtgctgctggtgatcaaggacatggacaaccagatcttcggcgcctacgccacccaccccttcaagttcagcgaccactactacggcaccggcgagaccttcctgtacaccttcagcccccacttcaaggtgttcaagtggagcggcgagaacagctacttcatcaacggcgacatcagcagcctggagctgggcggcggcggcggcagattcggcctgtggctggacgccgacctgtaccacggcagaagcaacagctgcagcaccttcaacaacgacatcctgagcaagaaggaggacttcatcgtgcaggacctggaggtgtgggccttcgactag

SEQ ID NO: 104667 - DNA, 735 bp, Artificial Sequence; identical to SEQ ID NO: 98916
  Description of Artificial Sequence: Synthetic coding sequence

SEQ ID NO: 104668 - DNA, 741 bp, Artificial Sequence
  Description of Artificial Sequence: Synthetic coding sequence
atggccgccgccgccgccaccaagatcctgctgtgcctgcccctgctgctgctgctgagcggctggagcagagccggcagagccgacccccacagcctgtgctacgacatcaccgtgatccccaagttcagacccggccccagatggtgcgccgtgcagggccaggtggacgagaagaccttcctgcactacgactgcggcaacaagaccgtgacccccgtgagccccctgggcaagaagctgaacgtgaccaccgcctggaaggcccagaaccccgtgctgagagaggtggtggacatcctgaccgagcagctgagagacatccagctggagaactacacccccaaggagcccctgaccctgcaggccagaatgagctgcgagcagaaggccgagggccacagcagcggcagctggcagttcagcttcgacggccagatcttcctgctgttcgacagcgagaagagaatgtggaccaccgtgcaccccggcgccagaaagatgaaggagaagtgggagaacgacaaggtggtggccatgagcttccactacttcagcatgggcgactgcatcggctggctggaggacttcctgatgggcatggacagcaccctggagcccagcgccggcgcccccctggccatgagcagcggcaccacccagctgagagccaccgccaccaccctgatcctgtgctgcctgctgatcatcctgccctgcttcatcctgcccggcatctag

SEQ ID NO: 104669 - DNA, 510 bp, Artificial Sequence
  Description of Artificial Sequence: Synthetic coding sequence
atggccgccgccgccagccccgccatcctgcccagactggccatcctgccctacctgctgttcgactggagcggcaccggcagagccgacgcccacagcctgtggtacaacttcaccatcatccacctgcccagacacggccagcagtggtgcgaggtgcagagccaggtggaccagaagaacttcctgagctacgactgcggcagcgacaaggtgctgagcatgggccacctggaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcctgggcaccagctag

SEQ ID NO: 104670 - DNA, 735 bp, Artificial Sequence
  Description of Artificial Sequence: Synthetic coding sequence
atggccgccgccgccagccccgccatcctgcccagactggccatcctgccctacctgctgttcgactggagcggcaccggcagagccgacgcccacagcctgtggtacaacttcaccatcatccacctgcccagacacggccagcagtggtgcgaggtgcagagccaggtggaccagaagaacttcctgagctacgactgcggcagcgacaaggtgctgagcatgggccacctggaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcgccagaagaatgaaggagaagtgggagaaggacagcggcctgaccaccttcttcaagatggtgagcatgagagactgcaagagctggctgagagacttcctgatgcacagaaagaagagactggagcccaccgccccccccaccatggcccccggcctggcccagcccaaggccatcgccaccaccctgagcccctggagcttcctgatcatcctgtgcttcatcctgcccggcatctag

SEQ ID NO: 104671 - DNA, 393 bp, Artificial Sequence
  Description of Artificial Sequence: Synthetic coding sequence
atggccgccgccgccagccccgccatcctgcccagactggccatcctgccctacctgctgttcgactggagcggcaccggcagagccgaggagcagctgtacgccaccgacgcctggggcaagcagctggagatgctgagagaggtgggccagagactgagactggagctggccgacaccgagctggaggacttcacccccagcggccccctgaccctgcaggtgagaatgagctgcgagtgcgaggccgacggctacatcagaggcagctggcagttcagcttcgacggcagaaagttcctgctgttcgacagcaacaacagaaagtggaccgtggtgcacgccggcgccagaagaatgaaggagaagtgggagaagagccacctggagtag

SEQ ID NO: 104672 - DNA, 735 bp, Artificial Sequence; identical to SEQ ID NO: 104670
  Description of Artificial Sequence: Synthetic coding sequence

SEQ ID NO: 104673 - DNA, 663 bp, Artificial Sequence
  Description of Artificial Sequence: Synthetic coding sequence
atgaaggtgaagaagggcggcggcggcgccggcaccgccaccgagagcgcccccggccccagcggccagagcgtggcccccatcccccagccccccgccgagagcgagagcggcagcgagagcgagcccgacgccggccccggccccagacccggccccctgcagagaaagcagcccatcggccccgaggacgtgctgggcctgcagagaatcaccggcgactacctgtgcagccccgaggagaacatctacaagatcgacttcgtgagattcaagatcagagacatggacagcggcaccgtgctgttcgagatcaagaagccccccgtgagcgagagactgcccatcaacagaagagacctggaccccaacgccggcagattcgtgagataccagttcacccccgccttcctgagactgagacaggtgggcgccaccgtggagttcaccgtgggcgacaagcccgtgaacaacttcagaatgatcgagagacactacttcagaaaccagctgctgaagagcttcgacttccacttcggcttctgcatccccagcagcaagaacacctgcgagcacatctacgacttcccccccctgagcgaggagctgagcgccagagccggcagcagcggcagcggcgaggtgggcgccagcagagactag

SEQ ID NO: 104674 - DNA, 723 bp, Artificial Sequence
  Description of Artificial Sequence: Synthetic coding sequence
atgaaggtgaagaagggcggcggcggcgccggcaccgccaccgagagcgcccccggccccagcggccagagcgtggcccccatcccccagccccccgccgagagcgagagcggcagcgagagcgagcccgacgccggccccggccccagacccggccccctgcagagaaagcagcccatcggccccgaggacgtgctgggcctgcagagaatcaccggcgactacctgtgcagccccgaggagaacatctacaagatcgacttcgtgagattcaagatcagagacatggacagcggcaccgtgctgttcgagatcaagaagccccccgtgagcgagagactgcccatcaacagaagagacctggaccccaacgccggcagattcgtgagataccagttcacccccgccttcctgagactgagacaggtgggcgccaccgtggagttcaccgtgggcgacaagcccgtgaacaacttcagaatgatcgagagacactacttcagaaaccagctgctgaagagcttcgacttccacttcggcttctgcatccccagcagcaagaacacctgcgagcacatctacgacttcccccccctgagcgaggagctgatcagcgagatgatcagacacccctacgagacccagagcgacagcttctacttcgtggacgacagactggtgatgcacaacaaggccgactacagctacagcggcaccccctag

SEQ ID NO: 104675 - DNA, 627 bp, Artificial Sequence
  Description of Artificial Sequence: Synthetic coding sequence
atgaaggtgaagaagggcggcggcggcgccggcaccgccaccgagagcgcccccggccccagcggccagagcgtggcccccatcccccagccccccgccgagagcgagagcggcagcgagagcgagcccgacgccggccccggccccagacccggccccctgcagagaaagcagcccatcggccccgaggacgtgctgggcctgcagagaatcaccggcggcgccagacccctgttccccgcctggagattcaagatcagagacatggacagcggcaccgtgctgttcgagatcaagaagccccccgtgagcgagagactgcccatcaacagaagagacctggaccccaacgccggcagattcgtgagataccagttcacccccgccttcctgagactgagacaggtgggcgccaccgtggagttcaccgtgggcgacaagcccgtgaacaacttcagaatgatcgagagacactacttcagaaaccagctgctgaagagcttcgacttccacttcggcttctgcatccccagcagcaagaacacctgcgagcacatctacgacttcccccccctgagcgaggagctgagcgccagagccggcagcagcggcagcggcgaggtgtag

SEQ ID NO: 104676 - DNA, 5112 bp, Artificial Sequence
  Description of Artificial Sequence: Synthetic coding sequence
ctgagcctgctgtgcgtgagcctgaagaaggccaagttcgacggcgcccaggagaagttcaacacctacgtgaccctgaaggtgcagaacgtgaagagcaccaccatcgccgtgagaggcagccagcccagctgggagcaggacttcatgttcgagatcaacagactggacctgggcctgaccgtggaggtgtggaacaagggcctgatctgggacaccatggtgggcaccgtgtggatccccctgagaaccatcagacagagcaacgaggagggccccggcgagtggctgaccctggacagccaggtgatcatggccgacagcgagatctgcggcaccaaggaccccaccttccacagaatcctgctggacaccagattcgagctgcccctggacatccccgaggaggaggccagatactgggccaagaagctggagcagctgaacgccatgagagaccaggacgagtacagcttccaggacgagcaggacaagcccctgcccgtgcccagcaaccagtgctgcaactggaactacttcggctggggcgagcagcacaacgacgaccccgacagcgccgtggacgacagagacagcgactacagaagcgagaccagcaacagcatcccccccccctactacaccaccagccagcccaacgccagcgtgcaccagtacagcgtgagacccccccccctgggcagcagagagagctacagcgacagcatgcacagctacgaggagttcagcgagccccaggccctgagccccaccggcagcagcagatacgccagcagcggcgagctgagccagggcagcagccagctgagcgaggacttcgaccccgacgagcacagcctgcagggcagcgacatggaggacgagagagacagagacagctaccacagctgccacagcagcgtgagctaccacaaggacagccccagatgggaccaggacgaggaggagctggaggaggacctggaggacttcctggaggaggaggagctgcccgaggacgaggaggagctggaggaggaggaggaggaggtgcccgacgacctgggcagctacgcccagagagaggacgtggccgtggccgagcccaaggacttcaagagaatcagcctgccccccgccgcccccggcaaggaggacaaggcccccgtggcccccaccgaggcccccgacatggccaaggtggcccccaagcccgccacccccgacaaggtgcccgccgccgagcagatccccgaggccgagccccccaaggacgaggagagcttcagacccagagaggacgaggagggccaggagggccaggacagcatgagcagagccaaggccaactggctgagagccttcaacaaggtgagaatgcagctgcaggaggccagaggcgagggcgagatgagcaagagcctgtggttcaagggcggccccggcggcggcctgatcatcatcgacagcatgcccgacatcagaaagagaaagcccatccccctggtgagcgacctggccatgagcctggtgcagagcagaaaggccggcatcaccagcgccctggccagcagcaccctgaacaacgaggagctgaagaaccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcaccgagtgcggcgtgaagtgccacgagaagtgccaggacctgctgaacgccgactgcctgcagagagccgccgagaagagcagcaagcacggcgccgaggacagaacccagaacatcatcatggtgctgaaggacagaatgaagatcagagagagaaacaagcccgagatcttcgagctgatccaggagatcttcgccgtgaccaagaccgcccacacccagcagatgaaggccgtgaagcagagcgtgctggacggcaccagcaagtggagcgccaagatcagcatcaccgtggtgtgcgcccagggcctgcaggccaaggacaagaccggcagcagcgacccctacgtgaccgtgcaggtgggcaagaccaagaagagaaccaagaccatctacggcaacctgaaccccgtgtgggaggagaacttccacttcgagtgccacaacagcagcgacagaatcaaggtgagagtgtgggacgaggacgacgacatcaagagcagagtgaagcagagattcaagagagagagcgacgacttcctgggccagaccatcatcgaggtgagaaccctgagcggcgagatggacgtgtggtacaacctggacaagagaaccgacaagagcgccgtgagcggcgccatcagactgcacatcagcgtggagatcaagggcgaggagaaggtggccccctaccacgtgcagtacacctgcctgcacgagaacctgttccacttcgtgaccgacgtgcagaacaacggcgtggtgaagatccccgacgccaagggcgacgacgcctggaaggtgtactacgacgagaccgcccaggagatcgtggacgagttcgccatgagatacggcgtggagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcatgtacagaaacaacttccccgccagcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgagctgtacagcagagagtaccagaccgaccccgccaagaagggcgaggtgctgcccgaggagcagggccccagcatcaagaacctggacttctggagcaagctgatcaccctgatcgtgagcatcatcgaggaggacaagaacagctacaccccctgcctgaaccagttcccccaggagctgaacgtgggcaagatcagcgccgaggtgatgtggaacctgttcgcccaggacatgaagtacgccatggaggagcacgacaagcacagactgtgcaagagcgccgactacatgaacctgcacttcaaggtgaagtggctgtacaacgagtacgtgaccgagctgcccgccttcaaggacagagtgcccgagtaccccgcctggttcgagcccttcgtgatccagtggctggacgagaacgaggaggtgagcagagacttcctgcacggcgccctggagagagacaagaaggacggcttccagcagaccagcgagcacgccctgttcagctgcagcgtggtggacgtgttcagccagctgaaccagagcttcgagatcatcaagaagctggagtgccccgacccccagatcgtgggccactacatgagaagattcgccaagaccatcagcaacgtgctgctgcagtacgccgacatcatcagcaaggacttcgccagctactgcagcaaggagaaggagaaggtgccctgcatcctgatgaacaacacccagcagctgagagtgcagctggagaagatgttcgaggccatgggcggcaaggagctggacgccgaggccagcgacatcctgaaggagctgcaggtgaagctgaacaacgtgctggacgagctgagcagagtgttcgccaccagcttccagccccacatcgaggagtgcgtgaagcagatgggcgacatcctgagccaggtgaagggcaccggcaacgtgcccgccagcgcctgcagcagcgtggcccaggacgccgacaacgtgctgcagcccatcatggacctgctggacagcaacctgaccctgttcgccaagatctgcgagaagaccgtgctgaagagagtgctgaaggagctgtggaagctggtgatgaacaccatggagaagaccatcgtgctgccccccctgaccgaccagaccctgcagggcaacctgctgagaaagcacggcaagggcctggagaagggcagagtgaagctgcccagccacagcgacggcacccagatgatcttcaacgccgccaaggagctgggccagctgagcaagctgaaggaccacatggtgagagaggaggccaagagcctgacccccaagcagtgcgccgtggtggagctggccctggacaccatcaagcagtacttccacgccggcggcgtgggcctgaagaagaccttcctggagaagagccccgacctgcagagcctgagatacgccctgagcctgtacacccaggccaccgacctgctgatcaagaccttcgtgcagacccagagcgcccagggcctgggcgtggaggaccccgtgggcgaggtgagcgtgcacgtggagctgttcacccaccccggcaccggcgagcacaaggtgaccgtgaaggtggtggccgccaacgacctgaagtggcagaccagcggcatcttcagacccttcatcgaggtgaacatcatcggcccccagctgagcgacaagaagagaaagttcgccaccaagagcaagaacaacagctgggcccccaagtacaacgagagcttccagttcaccctgagcgccgacgccggccccgagtgctacgagctgcaggtgtgcgtgaaggactactgcttcgccagagaggacagaaccgtgggcctggccgtgctgcagctgagagagctggcccagagaggcagcgccgcctgctggctgcccctgggcagaagaatccacatggacgacaccggcctgaccgtgctgagaatcctgagccagagaagcaacgacgaggtggccaaggagttcgtgaagctgaagagcgacaccagaagcgccgaggagggcggcgccgcccccgccccctag

SEQ ID NO: 104677 - DNA, 5376 bp, Artificial Sequence
  Description of Artificial Sequence: Synthetic coding sequence
atgggcggcggcggcacctgcaccatcagcgtgcaggtgagagtgtgcaccggcggcaacctgctgggcggcagaagaagacccctgagcccctgcaacgaggaggtgtggggcgaggcccccctgcccggcgccagacccttcaacgccccccccgccagaagcgcccccgcccccagcggcgtgcccggcctgagactgcccgccccccaccagagacacagcagacccggcagactgagacccacctgcgagctgggcgacatgagcctgctgtgcgtgggcgtgaagaaggccaagttcgacggcgcccaggagaagttcaacacctacgtgaccctgaaggtgcagaacgtgaagagcaccaccatcgccgtgagaggcagccagcccagctgggagcaggacttcatgttcgagatcaacagactggacctgggcctgaccgtggaggtgtggaacaagggcctgatctgggacaccatggtgggcaccgtgtggatccccctgagaaccatcagacagagcaacgaggagggccccggcgagtggctgaccctggacagccaggtgatcatggccgacagcgagatctgcggcaccaaggaccccaccttccacagaatcctgctggacaccagattcgagctgcccctggacatccccgaggaggaggccagatactgggccaagaagctggagcagctgaacgccatgagagaccaggacgagtacagcttccaggacgagcaggacaagcccctgcccgtgcccagcaaccagtgctgcaactggaactacttcggctggggcgagcagcacaacgacgaccccgacagcgccgtggacgacagagacagcgactacagaagcgagaccagcaacagcatcccccccccctactacaccaccagccagcccaacgccagcgtgcaccagtacagcgtgagacccccccccctgggcagcagagagagctacagcgacagcatgcacagctacgaggagttcagcgagccccaggccctgagccccaccggcagcagcagatacgccagcagcggcgagctgagccagggcagcagccagctgagcgaggacttcgaccccgacgagcacagcctgcagggcagcgacatggaggacgagagagacagagacagctaccacagctgccacagcagcgtgagctaccacaaggacagccccagatgggaccaggacgaggaggagctggaggaggacctggaggacttcctggaggaggaggagctgcccgaggacgaggaggagctggaggaggaggaggaggaggtgcccgacgacctgggcagctacgcccagagagaggacgtggccgtggccgagcccaaggacttcaagagaatcagcctgccccccgccgcccccggcaaggaggacaaggcccccgtggcccccaccgaggcccccgacatggccaaggtggcccccaagcccgccacccccgacaaggtgcccgccgccgagcagatccccgaggccgagccccccaaggacgaggagagcttcagacccagagaggacgaggagggccaggagggccaggacagcatgagcagagccaaggccaactggctgagagccttcaacaaggtgagaatgcagctgcaggaggccagaggcgagggcgagatgagcaagagcctgtggttcaagggcggccccggcggcggcctgatcatcatcgacagcatgcccgacatcagaaagagaaagcccatccccctggtgagcgacctggccatgagcctggtgcagagcagaaaggccggcatcaccagcgccctggccagcagcaccctgaacaacgaggagctgaagaaccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcaccgagtgcggcgtgaagtgccacgagaagtgccaggacctgctgaacgccgactgcctgcagagagccgccgagaagagcagcaagcacggcgccgaggacagaacccagaacatcatcatggtgctgaaggacagaatgaagatcagagagagaaacaagcccgagatcttcgagctgatccaggagatcttcgccgtgaccaagaccgcccacacccagcagatgaaggccgtgaagcagagcgtgctggacggcaccagcaagtggagcgccaagatcagcatcaccgtggtgtgcgcccagggcctgcaggccaaggacaagaccggcagcagcgacccctacgtgaccgtgcaggtgggcaagaccaagaagagaaccaagaccatctacggcaacctgaaccccgtgtgggaggagaacttccacttcgagtgccacaacagcagcgacagaatcaaggtgagagtgtgggacgaggacgacgacatcaagagcagagtgaagcagagattcaagagagagagcgacgacttcctgggccagaccatcatcgaggtgagaaccctgagcggcgagatggacgtgtggtacaacctggacaagagaaccgacaagagcgccgtgagcggcgccatcagactgcacatcagcgtggagatcaagggcgaggagaaggtggccccctaccacgtgcagtacacctgcctgcacgagaacctgttccacttcgtgaccgacgtgcagaacaacggcgtggtgaagatccccgacgccaagggcgacgacgcctggaaggtgtactacgacgagaccgcccaggagatcgtggacgagttcgccatgagatacggcgtggagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcatgtacagaaacaacttccccgccagcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgagctgtacagcagagagtaccagaccgaccccgccaagaagggcgaggtgctgcccgaggagcagggccccagcatcaagaacctggacttctggagcaagctgatcaccctgatcgtgagcatcatcgaggaggacaagaacagctacaccccctgcctgaaccagttcccccaggagctgaacgtgggcaagatcagcgccgaggtgatgtggaacctgttcgcccaggacatgaagtacgccatggaggagcacgacaagcacagactgtgcaagagcgccgactacatgaacctgcacttcaaggtgaagtggctgtacaacgagtacgtgaccgagctgcccgccttcaaggacagagtgcccgagtaccccgcctggttcgagcccttcgtgatccagtggctggacgagaacgaggaggtgagcagagacttcctgcacggcgccctggagagagacaagaaggacggcttccagcagaccagcgagcacgccctgttcagctgcagcgtggtggacgtgttcagccagctgaaccagagcttcgagatcatcaagaagctggagtgccccgacccccagatcgtgggccactacatgagaagattcgccaagaccatcagcaacgtgctgctgcagtacgccgacatcatcagcaaggacttcgccagctactgcagcaaggagaaggagaaggtgccctgcatcctgatgaacaacacccagcagctgagagtgcagctggagaagatgttcgaggccatgggcggcaaggagctggacgccgaggccagcgacatcctgaaggagctgcaggtgaagctgaacaacgtgctggacgagctgagcagagtgttcgccaccagcttccagccccacatcgaggagtgcgtgaagcagatgggcgacatcctgagccaggtgaagggcaccggcaacgtgcccgccagcgcctgcagcagcgtggcccaggacgccgacaacgtgctgcagcccatcatggacctgctggacagcaacctgaccctgttcgccaagatctgcgagaagaccgtgctgaagagagtgctgaaggagctgtggaagctggtgatgaacaccatggagaagaccatcgtgctgccccccctgaccgaccagaccatgatcggcaacctgctgagaaagcacggcaagggcctggagaagggcagagtgaagctgcccagccacagcgacggcacccagatgatcttcaacgccgccaaggagctgggccagctgagcaagctgaaggaccacatggtgagagaggaggccaagagcctgacccccaagcagtgcgccgtggtggagctggccctggacaccatcaagcagtacttccacgccggcggcgtgggcctgaagaagaccttcctggagaagagccccgacctgcagagcctgagatacgccctgagcctgtacacccaggccaccgacctgctgatcaagaccttcgtgcagacccagagcgcccagggcctgggcgtggaggaccccgtgggcgaggtgagcgtgcacgtggagctgttcacccaccccggcaccggcgagcacaaggtgaccgtgaaggtggtggccgccaacgacctgaagtggcagaccagcggcatcttcagacccttcatcgaggtgaacatcatcggcccccagctgagcgacaagaagagaaagttcgccaccaagagcaagaacaacagctgggcccccaagtacaacgagagcttccagttcaccctgagcgccgacgccggccccgagtgctacgagctgcaggtgtgcgtgaaggactactgcttcgccagagaggacagaaccgtgggcctggccgtgctgcagctgagagagctggcccagagaggcagcgccgcctgctggctgcccctgggcagaagaatccacatggacgacaccggcctgaccgtgctgagaatcctgagccagagaagcaacgacgaggtggccaaggagttcgtgaagctgaagagcgacaccagaagcgccgaggagggcggcgccgcccccgccccctag

SEQ ID NO: 104678 - DNA, 5112 bp, Artificial Sequence
  Description of Artificial Sequence: Synthetic coding sequence
atgagcctgctgtgcgtgggcgtgaagaaggccaagttcgacggcgcccaggagaagttcaacacctacgtgaccctgaaggtgcagaacgtgaagagcaccaccatcgccgtgagaggcagccagcccagctgggagcaggacttcatgttcgagatcaacagactggacctgggcctgaccgtggaggtgtggaacaagggcctgatctgggacaccatggtgggcaccgtgtggatccccctgagaaccatcagacagagcaacgaggagggccccggcgagtggctgaccctggacagccaggtgatcatggccgacagcgagatctgcggcaccaaggaccccaccttccacagaatcctgctggacaccagattcgagctgcccctggacatccccgaggaggaggccagatactgggccaagaagctggagcagctgaacgccatgagagaccaggacgagtacagcttccaggacgagcaggacaagcccctgcccgtgcccagcaaccagtgctgcaactggaactacttcggctggggcgagcagcacaacgacgaccccgacagcgccgtggacgacagagacagcgactacagaagcgagaccagcaacagcatcccccccccctactacaccaccagccagcccaacgccagcgtgcaccagtacagcgtgagacccccccccctgggcagcagagagagctacagcgacagcatgcacagctacgaggagttcagcgagccccaggccctgagccccaccggcagcagcagatacgccagcagcggcgagctgagccagggcagcagccagctgagcgaggacttcgaccccgacgagcacagcctgcagggcagcgacatggaggacgagagagacagagacagctaccacagctgccacagcagcgtgagctaccacaaggacagccccagatgggaccaggacgaggaggagctggaggaggacctggaggacttcctggaggaggaggagctgcccgaggacgaggaggagctggaggaggaggaggaggaggtgcccgacgacctgggcagctacgcccagagagaggacgtggccgtggccgagcccaaggacttcaagagaatcagcctgccccccgccgcccccggcaaggaggacaaggcccccgtggcccccaccgaggcccccgacatggccaaggtggcccccaagcccgccacccccgacaaggtgcccgccgccgagcagatccccgaggccgagccccccaaggacgaggagagcttcagacccagagaggacgaggagggccaggagggccaggacagcatgagcagagccaaggccaactggctgagagccttcaacaaggtgagaatgcagctgcaggaggccagaggcgagggcgagatgagcaagagcctgtggttcaagggcggccccggcggcggcctgatcatcatcgacagcatgcccgacatcagaaagagaaagcccatccccctggtgagcgacctggccatgagcctggtgcagagcagaaaggccggcatcaccagcgccctggccagcagcaccctgaacaacgaggagctgaagaaccacgtgtacaagaagaccctgcaggccctgatctaccccatcagctgcaccaccccccacaacttcgaggtgtggaccgccaccacccccacctactgctacgagtgcgagggcctgctgtggggcatcgccagacagggcatgagatgcaccgagtgcggcgtgaagtgccacgagaagtgccaggacctgctgaacgccgactgcctgcagagagccgccgagaagagcagcaagcacggcgccgaggacagaacccagaacatcatcatggtgctgaaggacagaatgaagatcagagagagaaacaagcccgagatcttcgagctgatccaggagatcttcgccgtgaccaagaccgcccacacccagcagatgaaggccgtgaagcagagcgtgctggacggcaccagcaagtggagcgccaagatcagcatcaccgtggtgtgcgcccagggcctgcaggccaaggacaagaccggcagcagcgacccctacgtgaccgtgcaggtgggcaagaccaagaagagaaccaagaccatctacggcaacctgaaccccgtgtgggaggagaacttccacttcgagtgccacaacagcagcgacagaatcaaggtgagagtgtgggacgaggacgacgacatcaagagcagagtgaagcagagattcaagagagagagcgacgacttcctgggccagaccatcatcgaggtgagaaccctgagcggcgagatggacgtgtggtacaacctggacaagagaaccgacaagagcgccgtgagcggcgccatcagactgcacatcagcgtggagatcaagggcgaggagaaggtggccccctaccacgtgcagtacacctgcctgcacgagaacctgttccacttcgtgaccgacgtgcagaacaacggcgtggtgaagatccccgacgccaagggcgacgacgcctggaaggtgtactacgacgagaccgcccaggagatcgtggacgagttcgccatgagatacggcgtggagagcatctaccaggccatgacccacttcgcctgcctgagcagcaagtacatgtgccccggcgtgcccgccgtgatgagcaccctgctggccaacatcaacgcctactacgcccacaccaccgccagcaccaacgtgagcgccagcgacagattcgccgccagcaacttcggcaaggagagattcgtgaagctgctggaccagctgcacaacagcctgagaatcgacctgagcatgtacagaaacaacttccccgccagcagccccgagagactgcaggacctgaagagcaccgtggacctgctgaccagcatcaccttcttcagaatgaaggtgcaggagctgcagagcccccccagagccagccaggtggtgaaggactgcgtgaaggcctgcctgaacagcacctacgagtacatcttcaacaactgccacgagctgtacagcagagagtaccagaccgaccccgccaagaagggcgaggtgctgcccgaggagcagggccccagcatcaagaacctggacttctggagcaagctgatcaccctgatcgtgagcatcatcgaggaggacaagaacagctacaccccctgcctgaaccagttcccccaggagctgaacgtgggcaagatcagcgccgaggtgatgtggaacctgttcgcccaggacatgaagtacgccatggaggagcacgacaagcacagactgtgcaagagcgccgactacatgaacctgcacttcaaggtgaagtggctgtacaacgagtacgtgaccgagctgcccgccttcaaggacagagtgcccgagtaccccgcctggttcgagcccttcgtgatccagtggctggacgagaacgaggaggtgagcagagacttcctgcacggcgccctggagagagacaagaaggacggcttccagcagaccagcgagcacgccctgttcagctgcagcgtggtggacgtgttcagccagctgaaccagagcttcgagatcatcaagaagctggagtgccccgacccccagatcgtgggccactacatgagaagattcgccaagaccatcagcaacgtgctgctgcagtacgccgacatcatcagcaaggacttcgccagctactgcagcaaggagaaggagaaggtgccctgcatcctgatgaacaacacccagcagctgagagtgcagctggagaagatgttcgaggccatgggcggcaaggagctggacgccgaggccagcgacatcctgaaggagctgcaggtgaagctgaacaacgtgctggacgagctgagcagagtgttcgccaccagcttccagccccacatcgaggagtgcgtgaagcagatgggcgacatcctgagccaggtgaagggcaccggcaacgtgcccgccagcgcctgcagcagcgtggcccaggacgccgacaacgtgctgcagcccatcatggacctgctggacagcaacctgaccctgttcgccaagatctgcgagaagaccgtgctgaagagagtgctgaaggagctgtggaagctggtgatgaacaccatggagaagaccatcgtgctgccccccctgaccgaccagaccatgatcggcaacctgctgagaaagcacggcaagggcctggagaagggcagagtgaagctgcccagccacagcgacggcacccagatgatcttcaacgccgccaaggagctgggccagctgagcaagctgaaggaccacatggtgagagaggaggccaagagcctgacccccaagcagtgcgccgtggtggagctggccctggacaccatcaagcagtacttccacgccggcggcgtgggcctgaagaagaccttcctggagaagagccccgacctgcagagcctgagatacgccctgagcctgtacacccaggccaccgacctgctgatcaagaccttcgtgcagacccagagcgcccagggcctgggcgtggaggaccccgtgggcgaggtgagcgtgcacgtggagctgttcacccaccccggcaccggcgagcacaaggtgaccgtgaaggtggtggccgccaacgacctgaagtggcagaccagcggcatcttcagacccttcatcgaggtgaacatcatcggcccccagctgagcgacaagaagagaaagttcgccaccaagagcaagaacaacagctgggcccccaagtacaacgagagcttccagttcaccctgagcgccgacgccggccccgagtgctacgagctgcaggtgtgcgtgaaggactactgcttcgccagagaggacagaaccgtgggcctggccgtgctgcagctgagagagctggcccagagaggcagcgccgcctgctggctgcccctgggcagaagaatccacatggacgacaccggcctgaccgtgctgagaatcctgagccagagaagcaacgacgaggtggccaaggagttcgtgaagctgaagagcgacaccagaagcgccgaggagggcggcgccgcccccgccccctag

SEQ ID NO: 104679 - DNA, 1293 bp, Artificial Sequence
  Description of Artificial Sequence: Synthetic coding sequence
atggccaccctgagcgtgaagcccagcagaagattccagctgcccgactggcacaccaacagctacctgctgagcaccaacgcccagctgcagagagacgccagccaccagatcagacaggaggccagagtgctgagaaacgagaccaacaaccagaccatctgggacgagcacgacaacagaaccagactggtggagagaatcgacaccgtgaacagatggaaggagatgctggacaagtgcctgaccgacctggacgccgagatcgacgccctgacccagatgaaggagagcgccgagcagaacctgcaggccaagaacctgcccctggacgtggccatcgagtgcctgaccctgagagagagcagaagagacatcgacgtggtgaaggaccccgtggaggacgagctgcacaaggaggtggaggtgatcgaggccaccaagaaggccctgcagcagaaggtgagccaggccttcgagcagctgtgcctgctgcaggaggtgcagcagcagctgaacagcgaccacagaggcaagatggagaccctggagatcgacagaggctgcctgagcctgaacctgagaagccccaacatcagcctgaaggtggaccccaccagagtgcccgacggcagcaccaccctgcagcagtgggacgacttcagcagattcaacaaggacagagccgaggccgagatgaaggccgccaccgagctgagagaggccaccgccctgaccatcgccgagaccaacaacgagctggaggcccagagagtggccaccgagttcgccttcagaaagagactgagagagatggagaaggtgtacagcgagctgaagtggcaggagaagaacaccctggaggagatcgccgagctgcaggaggacatcagacacctggaggaggacctgagaaccaagctgctgagcctgaagctgagccacaccagactggaggccagaacctacagacccaacgtggagctgtgcagagaccaggcccagtacggcctgaccgacgaggtgcaccagctggaggccaccatcgccgccctgaagcagaagctggcccaggcccaggacgccctggacgccctgtgcaagcacctggccagactgcaggccgacatcgcctgcaaggccaacagcatgctgctggacaccaagtgcatggacaccagaagaaagctgaccgtgcccgccgagagattcgtgcccgaggtggacaccttcaccagaaccaccaacagcaccctgagccccctgaagagctgccagctggagctggcctag

SEQ ID NO: 104680 - DNA, 3429 bp, Artificial Sequence
  Description of Artificial Sequence: Synthetic coding sequence
atggccaccctgctgagccacccccagcagagaccccccttcctgagacaggccatcaagatcagaagaagaagagtgagagacctgcaggacccccccccccagatggcccccgagatccagccccccagccaccacttcagccccgagcagagagccctgctgtacgaggacgccctgtacaccgtgctgcacagactgggccaccccgagcccaaccacgtgaccgaggccagcgagctgctgagatacctgcaggaggccttccacgtggagcccgaggagcaccagcagaccctgcagagagtgagagagctggagaagcccatcttctgcctgaaggccaccgtgaagcaggccaagggcatcctgggcaaggacgtgagcggcttcagcgacccctactgcctgctgggcatcgagcagggcgtgggcgtgcccggcggcagccccggcagcagacacagacagaaggccgtggtgagacacaccatccccgaggaggagacccacagaacccaggtgatcacccagaccctgaaccccgtgtgggacgagaccttcatcctggagttcgaggacatcaccaacgccagcttccacctggacatgtgggacctggacaccgtggagagcgtgagacagaagctgggcgagctgaccgacctgcacggcctgagaagaatcttcaaggaggccagaaaggacaagggccaggacgacttcctgggcaacgtggtgctgagactgcaggacctgagatgcagagaggaccagtggtaccccctggagcccagaaccgagacctaccccgacagaggccagtgccacctgcagttccagctgatccacaagagaagagccaccagcgccagcagaagccagcccagctacaccgtgcacctgcacctgctgcagcagctggtgagccacgaggtgacccagcacgaggccggcagcaccagctgggacggcagcctgagcccccaggccgccaccgtgctgttcctgcacgccacccagaaggacctgagcgacttccaccagagcatggcccagtggctggcctacagcagactgtaccagagcctggagttccccagcagctgcctgctgcaccccatcaccagcatcgagtaccagtggatccagggcagactgaaggccgagcagcaggaggagctggccgccagcttcagcagcctgctgacctacggcctgagcctgatcagaagattcagaagcgtgttccccctgagcgtgagcgacagccccgccagactgcagagcctgctgagagtgctggtgcagatgtgcaagatgaaggccttcggcgagctgtgccccaacaccgcccccctgccccagctggtgaccgaggccctgcagaccggcaccaccgagtggttccacctgaagcagcagcaccaccagcccatggtgcagggcatccccgaggccggcaaggccctgctgggcctggtgcaggacgtgatcggcgacctgcaccagtgccagagaacctgggacaagatcttccacaacaccctgaagatccacctgttcagcatggccttcagagagctgcagtggctggtggccaagagagtgcaggaccacaccaccgtggtgggcgacgtggtgagccccgagatgggcgagagcctgttccagctgtacatcagcctgaaggagctgtgccagctgagaatgagcagcagcgagagagacggcgtgctggccctggacaacttccacagatggttccagcccgccatccccagctggctgcagaagacctacaacgaggccctggccagagtgcagagagccgtgcagatggacgagctggtgcccctgggcgagctgaccaagcacagcaccagcgccgtggacctgagcacctgcttcgcccagatcagccacaccgccagacagctggactggcccgaccccgaggaggccttcatgatcaccgtgaagttcgtggaggacacctgcagactggccctggtgtactgcagcctgatcaaggccagagccagagagctgagcagcggccagaaggaccagggccaggccgccaacatgctgtgcgtggtggtgaacgacatggagcagctgagactggtgatcggcaagctgcccgcccagctggcctgggaggccctggagcagagagtgggcgccgtgctggagcagggccagctgcagaacaccctgcacgcccagctgcagagcgccctggccggcctgggccacgagatcagaaccggcgtgagaaccctggccgagcagctggaggtgggcatcgccaagcacatccagaagctggtgggcgtgagagagagcgtgctgcccgaggacgccatcctgcccctgatgaagttcctggaggtggagctgtgctacatgaacaccaacctggtgcaggagaacttcagcagcctgctgaccctgctgtggacccacaccctgaccgtgctggtggaggccgccgccagccagagaagcagcagcctggccagcaacagactgaagatcgccctgcagaacctggagatctgcttccacgccgagggctgcggcctgccccccaaggccctgcacaccgccaccttccaggccctgcagagagacctggagctgcaggccgccagcagcagagagctgatcagaaagtacttctgcagcagaatccagcagcaggccgagaccaccagcgaggagctgggcgccgtgaccgtgaaggccagctacagagccagcgagcagaagctgagagtggagctgctgagcgccagcagcctgctgcccctggacagcaacggcagcagcgaccccttcgtgcagctgaccctggagcccagacacgagttccccgagctggccgccagagagacccagaagcacaagaaggacctgcaccccctgttcgacgagaccttcgagttcctggtgcccgccgagccctgcagaaaggccggcgcctgcctgctgctgaccgtgctggactacgacaccctgggcgccgacgacctggagggcgaggccttcctgcccctgagagaggtgcccggcctgagcggcagcgaggagcccggcgaggtgccccagaccagactgcccctgacctaccccgcccccaacggcgaccccatcctgcagctgctggagggcagaaagggcgacagagaggcccaggtgttcgtgagactgagaagacacagagccaagcagggcatcggccccagcgtgagctggccctggcccatctgcctgctggccttcctgttccagcccctgggctggggccccggcagcctgggccccggcctgcaggcccagagcctgctggagaagggcgagggcaccctgcccaagatgagactgcagctgccctggggcgagggcggcggccactactag

SEQ ID NO: 104681 - DNA, 2835 bp, Artificial Sequence
  Description of Artificial Sequence: Synthetic coding sequence
atggccaccctgctgagccacccccagcagagaccccccttcctgagacaggccatcaagatcagaagaagaagagtgagagacctgcaggacccccccccccagatggcccccgagatccagccccccagccaccacttcagccccgagcagagagccctgctgtacgaggacgccctgtacaccgtgctgcacagactgggccaccccgagcccaaccacgtgaccgaggccagcgagctgctgagatacctgcaggaggccttccacgtggagcccgaggagcaccagcagaccctgcagagagtgagagagctggagaagcccatcttctgcctgaaggccaccgtgaagcaggccaagggcatcctgggcaaggacgtgagcggcttcagcgacccctactgcctgctgggcatcgagcagggcgtgggcgtgcccggcggcagccccggcagcagacacagacagaaggccgtggtgagacacaccatccccgaggaggagacccacagaacccaggtgatcacccagaccctgaaccccgtgtgggacgagaccttcatcctggagttcgaggacatcaccaacgccagcttccacctggacatgtgggacctggacaccgtggagagcgtgagacagaagctgggcgagctgaccgacctgcacggcctgagaagaatcttcaaggaggccagaaaggacaagggccaggacgacttcctgggcaacgtggtgctgagactgcaggacctgagatgcagagaggaccagtggtaccccctggagcccagaaccgagacctaccccgacagaggccagtgccacctgcagttccagctgatccacaagagaagagccaccagcgccagcagaagccagcccagctacaccgtgcacctgcacctgctgcagcagctggtgagccacgaggtgacccagcacgaggccggcagcaccagctgggacggcagcctgagcccccaggccgccaccgtgctgttcctgcacgccacccagaaggacctgagcgacttccaccagagcatggcccagtggctggcctacagcagactgtaccagagcctggagttccccagcagctgcctgctgcaccccatcaccagcatcgagtaccagtggatccagggcagactgaaggccgagcagcaggaggagctggccgccagcttcagcagcctgctgacctacggcctgagcctgatcagaagattcagaagcgtgttccccctgagcgtgagcgacagccccgccagactgcagagcctgctgagagtgctggtgcagatgtgcaagatgaaggccttcggcgagctgtgccccaacaccgcccccctgccccagctggtgaccgaggccctgcagaccggcaccaccgagtggttccacctgaagcagcagcaccaccagcccatggtgcagggcatccccgaggccggcaaggccctgctgggcctggtgcaggacgtgatcggcgacctgcaccagtgccagagaacctgggacaagatcttccacaacaccctgaagatccacctgttcagcatggccttcagagagctgcagtggctggtggccaagagagtgcaggaccacaccaccgtggtgggcgacgtggtgagccccgagatgggcgagagcctgttccagctgtacatcagcctgaaggagctgtgccagctgagaatgagcagcagcgagagagacggcgtgctggccctggacaacttccacagatggttccagcccgccatccccagctggctgcagaagacctacaacgaggccctggccagagtgcagagagccgtgcagatggacgagctggtgcccctgggcgagctgaccaagcacagcaccagcgccgtggacctgagcacctgcttcgcccagatcagccacaccgccagacagctggactggcccgaccccgaggaggccttcatgatcaccgtgaagttcgtggaggacacctgcagactggccctggtgtactgcagcctgatcaaggccagagccagagagctgagcagcggccagaaggaccagggccaggccgccaacatgctgtgcgtggtggtgaacgacatggagcagctgagactggtgatcggcaagctgcccgcccagctggcctgggaggccctggagcagagagtgggcgccgtgctggagcagggccagctgcagaacaccctgcacgcccagctgcagagcgccctggccggcctgggccacgagatcagaaccggcgtgagaaccctggccgagcagctggaggtgggcatcgccaagcacatccagaagctggtgggcgtgagagagagcgtgctgcccgaggacgccatcctgcccctgatgaagttcctggaggtggagctgtgctacatgaacaccaacctggtgcaggagaacttcagcagcctgctgaccctgctgtggacccacaccctgaccgtgctggtggaggccgccgccagccagagaagcagcagcctggccagcaacagactgaagatcgccctgcagaacctggagatctgcttccacgccgagggctgcggcctgccccccaagaccctgcccctgcccgccagccagaagagctgctgcggcggccagggcatcggccccagcgtgagctggccctggcccatctgcctgctggccttcctgttccagcccctgggctggggccccggcagcctgggccccggcctgcaggcccagagcctgctggagaagggcgagggcaccctgcccaagatgagactgcagctgccctggggcgagggcggcggccactactag

SEQ ID NO: 104682 - DNA, 2790 bp, Artificial Sequence
  Description of Artificial Sequence: Synthetic coding sequence
atgaccgccagcagcgtggagcagctgagaaaggagggcaacgagctgttcaagtgcggcgactacggcggcgccctggccgcctacacccaggccctgggcctggacgccaccccccaggaccaggccgtgctgcacagaaacagagccgcctgccacctgaagctggaggactacgacaaggccgagaccgaggccagcaaggccatcgagaaggacggcggcgacgtgaaggccctgtacagaagaagccaggccctggagaagctgggcagactggaccaggccgtgctggacctgcagagatgcgtgagcctggagcccaagaacaaggtgttccaggaggccctgagaaacatcggcggccagatccaggagaaggtgagatacatgagcagcaccgacgccaaggtggagcagatgttccagatcctgctggaccccgaggagaagggcaccgagaagaagcagaaggccagccagaacctggtggtgctggccagagaggacgccggcgccgagaagatcttcagaagcaacggcgtgcagctgctgcagagactgctggacatgggcgagaccgacctgatgctggccgccctgagaaccctggtgggcatctgcagcgagcaccagagcagaaccgtggccaccctgagcatcctgggcaccagaagagtggtgagcatcctgggcgtggagagccaggccgtgagcctggccgcctgccacctgctgcaggtgatgttcgacgccctgaaggagggcgtgaagaagggcttcagaggcaaggagggcgccatcatcgtggaccccgccagagagctgaaggtgctgatcagcaacctgctggacctgctgaccgaggtgggcgtgagcggccagggcagagacaacgccctgaccctgctgatcaaggccgtgcccagaaagagcctgaaggaccccaacaacagcctgaccctgtgggtgatcgaccagggcctgaagaagatcctggaggtgggcggcagcctgcaggacccccccggcgagctggccgtgaccgccaacagcagaatgagcgccagcatcctgctgagcaagctgttcgacgacctgaagtgcgacgccgagagagagaacttccacagactgtgcgagaactacatcaagagctggttcgagggccagggcctggccggcaagctgagagccatccagaccgtgagctgcctgctgcagggcccctgcgacgccggcaacagagccctggagctgagcggcgtgatggagagcgtgatcgccctgtgcgccagcgagcaggaggaggagcagctggtggccgtggaggccctgatccacgccgccggcaaggccaagagagccagcttcatcaccgccaacggcgtgagcctgctgaaggacctgtacaagtgcagcgagaaggacagcatcagaatcagagccctggtgggcctgtgcaagctgggcagcgccggcggcaccgacttcagcatgaagcagttcgccgagggcagcaccctgaagctggccaagcagtgcagaaagtggctgtgcaacgaccagatcgacgccggcaccagaagatgggccgtggagggcctggcctacctgaccttcgacgccgacgtgaaggaggagttcgtggaggacgccgccgccctgaaggccctgttccagctgagcagactggaggagagaagcgtgctgttcgccgtggccagcgccctggtgaactgcaccaacagctacgactacgaggagcccgaccccaagatggtggagctggccaagtacgccaagcagcacgtgcccgagcagcaccccaaggacaagcccagcttcgtgagagccagagtgaagaagctgctggccgccggcgtggtgagcgccatggtgtgcatggtgaagaccgagagccccgtgctgaccagcagctgcagagagctgctgagcagagtgttcctggccctggtggaggaggtggaggacagaggcaccgtggtggcccagggcggcggcagagccctgatccccctggccctggagggcaccgacgtgggccagaccaaggccgcccaggccctggccaagctgaccatcaccagcaaccccgagatgaccttccccggcgagagaatctacgaggtggtgagacccctggtgagcctgctgcacctgaactgcagcggcctgcagaacttcgaggccctgatggccctgaccaacctggccggcatcagcgagagactgagacagaagatcctgaaggagaaggccgtgcccatgatcgagggctacatgttcgaggagcacgagatgatcagaagagccgccaccgagtgcatgtgcaacctggccatgagcaaggaggtgcaggacctgttcgaggcccagggcaacgacagactgaagctgctggtgctgtacagcggcgaggacgacgagctgctgcagagagccgccgccggcggcctggccatgctgaccagcatgagacccaccctgtgcagcagaatcccccaggtgaccacccactggctggagatcctgcaggccctgctgctgagcagcaaccaggagctgcagcacagaggcgccgtggtggtgctgaacatggtggaggccagcagagagatcgccagcaccctgatggagagcgagatgatggagatcctgagcgtgctggccaagggcgaccacagccccgtgaccagagccgccgccgcctgcctggacaaggccgtggagtacggcctgatccagcccaaccaggacggcgagtag

SEQ ID NO: 104683 - DNA, 2835 bp, Artificial Sequence
  Description of Artificial Sequence: Synthetic coding sequence
atgaccgtgagcggccccggcacccccgagcccagacccgccacccccggcgccagcagcgtggagcagctgagaaaggagggcaacgagctgttcaagtgcggcgactacggcggcgccctggccgcctacacccaggccctgggcctggacgccaccccccaggaccaggccgtgctgcacagaaacagagccgcctgccacctgaagctggaggactacgacaaggccgagaccgaggccagcaaggccatcgagaaggacggcggcgacgtgaaggccctgtacagaagaagccaggccctggagaagctgggcagactggaccaggccgtgctggacctgcagagatgcgtgagcctggagcccaagaacaaggtgttccaggaggccctgagaaacatcggcggccagatccaggagaaggtgagatacatgagcagcaccgacgccaaggtggagcagatgttccagatcctgctggaccccgaggagaagggcaccgagaagaagcagaaggccagccagaacctggtggtgctggccagagaggacgccggcgccgagaagatcttcagaagcaacggcgtgcagctgctgcagagactgctggacatgggcgagaccgacctgatgctggccgccctgagaaccctggtgggcatctgcagcgagcaccagagcagaaccgtggccaccctgagcatcctgggcaccagaagagtggtgagcatcctgggcgtggagagccaggccgtgagcctggccgcctgccacctgctgcaggtgatgttcgacgccctgaaggagggcgtgaagaagggcttcagaggcaaggagggcgccatcatcgtggaccccgccagagagctgaaggtgctgatcagcaacctgctggacctgctgaccgaggtgggcgtgagcggccagggcagagacaacgccctgaccctgctgatcaaggccgtgcccagaaagagcctgaaggaccccaacaacagcctgaccctgtgggtgatcgaccagggcctgaagaagatcctggaggtgggcggcagcctgcaggacccccccggcgagctggccgtgaccgccaacagcagaatgagcgccagcatcctgctgagcaagctgttcgacgacctgaagtgcgacgccgagagagagaacttccacagactgtgcgagaactacatcaagagctggttcgagggccagggcctggccggcaagctgagagccatccagaccgtgagctgcctgctgcagggcccctgcgacgccggcaacagagccctggagctgagcggcgtgatggagagcgtgatcgccctgtgcgccagcgagcaggaggaggagcagctggtggccgtggaggccctgatccacgccgccggcaaggccaagagagccagcttcatcaccgccaacggcgtgagcctgctgaaggacctgtacaagtgcagcgagaaggacagcatcagaatcagagccctggtgggcctgtgcaagctgggcagcgccggcggcaccgacttcagcatgaagcagttcgccgagggcagcaccctgaagctggccaagcagtgcagaaagtggctgtgcaacgaccagatcgacgccggcaccagaagatgggccgtggagggcctggcctacctgaccttcgacgccgacgtgaaggaggagttcgtggaggacgccgccgccctgaaggccctgttccagctgagcagactggaggagagaagcgtgctgttcgccgtggccagcgccctggtgaactgcaccaacagctacgactacgaggagcccgaccccaagatggtggagctggccaagtacgccaagcagcacgtgcccgagcagcaccccaaggacaagcccagcttcgtgagagccagagtgaagaagctgctggccgccggcgtggtgagcgccatggtgtgcatggtgaagaccgagagccccgtgctgaccagcagctgcagagagctgctgagcagagtgttcctggccctggtggaggaggtggaggacagaggcaccgtggtggcccagggcggcggcagagccctgatccccctggccctggagggcaccgacgtgggccagaccaaggccgcccaggccctggccaagctgaccatcaccagcaaccccgagatgaccttccccggcgagagaatctacgaggtggtgagacccctggtgagcctgctgcacctgaactgcagcggcctgcagaacttcgaggccctgatggccctgaccaacctggccggcatcagcgagagactgagacagaagatcctgaaggagaaggccgtgcccatgatcgagggctacatgttcgaggagcacgagatgatcagaagagccgccaccgagtgcatgtgcaacctggccatgagcaaggaggtgcaggacctgttcgaggcccagggcaacgacagactgaagctgctggtgctgtacagcggcgaggacgacgagctgctgcagagagccgccgccggcggcctggccatgctgaccagcatgagacccaccctgtgcagcagaatcccccaggtgaccacccactggctggagatcctgcaggccctgctgctgagcagcaaccaggagctgcagcacagaggcgccgtggtggtgctgaacatggtggaggccagcagagagatcgccagcaccctgatggagagcgagatgatggagatcctgagcgtgctggccaagggcgaccacagccccgtgaccagagccgccgccgcctgcctggacaaggccgtggagtacggcctgatccagcccaaccaggacggcgagtag

SEQ ID NO: 104684 - DNA, 2409 bp, Artificial Sequence
  Description of Artificial Sequence: Synthetic coding sequence
atggccggcaccagcgagagaagcctgatcagcagcatcagccagcccaaggccatcgagtgcttcgaggtgaagaagaaggccttcctgacccacggcagataccacggcagcggcgccaccccccccaagaccaaggaccccaagcccgagaccttctgcggccagaccggcctgcccaccatggaggtgagaatcaacgtgagcagacagcaggtggagaaggtgttcggcctggaggagtactggtgccagtgcgtggcctggagcagcagcggcaccaccaagagccagaaggcctacatcagaatcgcctacctgagaaagaacttcgagcaggagcccctggccaaggaggtgagcctggagcagggcatcgtgctgccctgcagaccccccgagggcatcccccccgccgaggtggagtggctgagaaacgaggacctggtggaccccagcctggaccccaacgtgtacatcaccagagagcacagcctggtggtgagacaggccagactggccgacaccgccaactacacctgcgtggccaagaacatcgtggccagaagaagaagcgccagcgccgccgtgatcgtgtacgtggacggcagctggagcccctggagcaagtggagcgcctgcggcctggactgcacccactggagaagcagagagtgcagcgaccccgcccccagaaacggcggcgaggagtgccagggcaccgacctggacaccagaaactgcaccagcgacctgtgcgtgcacaccgccagcggccccgaggacgtggccctgtacgtgggcctgatcgccgtggccgtgtgcctggtgctgctgctgctggtgctgatcctggtgtactgcagaaagaaggagggcctggacagcgacgtggccgacagcagcatcctgaccagcggcttccagcccgtgagcatcaagcccagcaaggccgacaacccccacctgctgaccatccagcccgacctgagcaccaccaccaccacctaccagggcagcctgtgccccagacaggacggccccagccccaagttccagctgaccaacggccacctgctgagccccctgggcggcggcagacacaccctgcaccacagcagccccaccagcgaggccgaggagttcgtgagcagactgagcacccagaactacttcagaagcctgcccagaggcaccagcaacatgacctacggcaccttcaacttcctgggcggcagactgatgatccccaacaccggcatcagcctgctgatcccccccgacgccatccccagaggcaagatctacgagatctacctgaccctgcacaagcccgaggacgtgagactgcccctggccggctgccagaccctgctgagccccatcgtgagctgcggcccccccggcgtgctgctgaccagacccgtgatcctggccatggaccactgcggcgagcccagccccgacagctggagcctgagactgaagaagcagagctgcgagggcagctgggaggacgtgctgcacctgggcgaggaggcccccagccacctgtactactgccagctggaggccagcgcctgctacgtgttcaccgagcagctgggcagattcgccctggtgggcgaggccctgagcgtggccgccgccaagagactgaagctgctgctgttcgcccccgtggcctgcaccagcctggagtacaacatcagagtgtactgcctgcacgacacccacgacgccctgaaggaggtggtgcagctggagaagcagctgggcggccagctgatccaggagcccagagtgctgcacttcaaggacagctaccacaacctgagactgagcatccacgacgtgcccagcagcctgtggaagagcaagctgctggtgagctaccaggagatccccttctaccacatctggaacggcacccagagatacctgcactgcaccttcaccctggagagagtgagccccagcaccagcgacctggcctgcaagctgtgggtgtggcaggtggagggcgacggccagagcttcagcatcaacttcaacatcaccaaggacaccagattcgccgagctgctggccctggagagcgaggccggcgtgcccgccctggtgggccccagcgccttcaagatccccttcctgatcagacagaagatcatcagcagcctggaccccccctgcagaagaggcgccgactggagaaccctggcccagaagctgcacctggacagccacctgagcttcttcgccagcaagcccagccccaccgccatgatcctgaacctgtgggaggccagacacttccccaacggcaacctgagccagctggccgccgccgtggccggcctgggccagcccgacgccggcctgttcaccgtgagcgaggccgagtgctag

SEQ ID NO: 104685 - DNA, 2529 bp, Artificial Sequence
  Description of Artificial Sequence: Synthetic coding sequence
atggccgtgagacccggcctgtggcccgccctgctgggcatcgtgctggccgcctggctgagaggcagcggcgcccagcagagcgccaccgtggccaaccccgtgcccggcgccaaccccgacctgctgccccacttcctggtggagcccgaggacgtgtacatcgtgaagaacaagcccgtgctgctggtgtgcaaggccgtgcccgccacccagatcttcttcaagtgcaacggcgagtgggtgagacaggtggaccacgtgatcgagagaagcaccgacggcagcagcggcctgcccaccatggaggtgagaatcaacgtgagcagacagcaggtggagaaggtgttcggcctggaggagtactggtgccagtgcgtggcctggagcagcagcggcaccaccaagagccagaaggcctacatcagaatcgcctacctgagaaagaacttcgagcaggagcccctggccaaggaggtgagcctggagcagggcatcgtgctgccctgcagaccccccgagggcatcccccccgccgaggtggagtggctgagaaacgaggacctggtggaccccagcctggaccccaacgtgtacatcaccagagagcacagcctggtggtgagacaggccagactggccgacaccgccaactacacctgcgtggccaagaacatcgtggccagaagaagaagcgccagcgccgccgtgatcgtgtacgtggacggcagctggagcccctggagcaagtggagcgcctgcggcctggactgcacccactggagaagcagagagtgcagcgaccccgcccccagaaacggcggcgaggagtgccagggcaccgacctggacaccagaaactgcaccagcgacctgtgcgtgcacaccgccagcggccccgaggacgtggccctgtacgtgggcctgatcgccgtggccgtgtgcctggtgctgctgctgctggtgctgatcctggtgtactgcagaaagaaggagggcctggacagcgacgtggccgacagcagcatcctgaccagcggcttccagcccgtgagcatcaagcccagcaaggccgacaacccccacctgctgaccatccagcccgacctgagcaccaccaccaccacctaccagggcagcctgtgccccagacaggacggccccagccccaagttccagctgaccaacggccacctgctgagccccctgggcggcggcagacacaccctgcaccacagcagccccaccagcgaggccgaggagttcgtgagcagactgagcacccagaactacttcagaagcctgcccagaggcaccagcaacatgacctacggcaccttcaacttcctgggcggcagactgatgatccccaacaccggcatcagcctgctgatcccccccgacgccatccccagaggcaagatctacgagatctacctgaccctgcacaagcccgaggacgtgagactgcccctggccggctgccagaccctgctgagccccatcgtgagctgcggcccccccggcgtgctgctgaccagacccgtgatcctggccatggaccactgcggcgagcccagccccgacagctggagcctgagactgaagaagcagagctgcgagggcagctgggaggacgtgctgcacctgggcgaggaggcccccagccacctgtactactgccagctggaggccagcgcctgctacgtgttcaccgagcagctgggcagattcgccctggtgggcgaggccctgagcgtggccgccgccaagagactgaagctgctgctgttcgcccccgtggcctgcaccagcctggagtacaacatcagagtgtactgcctgcacgacacccacgacgccctgaaggaggtggtgcagctggagaagcagctgggcggccagctgatccaggagcccagagtgctgcacttcaaggacagctaccacaacctgagactgagcatccacgacgtgcccagcagcctgtggaagagcaagctgctggtgagctaccaggagatccccttctaccacatctggaacggcacccagagatacctgcactgcaccttcaccctggagagagtgagccccagcaccagcgacctggcctgcaagctgtgggtgtggcaggtggagggcgacggccagagcttcagcatcaacttcaacatcaccaaggacaccagattcgccgagctgctggccctggagagcgaggccggcgtgcccgccctggtgggccccagcgccttcaagatccccttcctgatcagacagaagatcatcagcagcctggaccccccctgcagaagaggcgccgactggagaaccctggcccagaagctgcacctggacagccacctgagcttcttcgccagcaagcccagccccaccgccatgatcctgaacctgtgggaggccagacacttccccaacggcaacctgagccagctggccgccgccgtggccggcctgggccagcccgacgccggcctgttcaccgtgagcgaggccgagtgctag

SEQ ID NO: 104686 - DNA, 2838 bp, Artificial Sequence
  Description of Artificial Sequence: Synthetic coding sequence
atgggcgccagaagcggcgccagaggcgccctgctgctggccctgctgctgtgctgggaccccagactgagccaggccggcaccgacagcggcagcgaggtgctgcccgacagcttccccagcgcccccgccgagcccctgccctacttcctgcaggagccccaggacgcctacatcgtgaagaacaagcccgtggagctgagatgcagagccttccccgccacccagatctacttcaagtgcaacggcgagtgggtgagccagaacgaccacgtgacccaggagggcctggacgaggccaccggcctgagagtgagagaggtgcagatcgaggtgagcagacagcaggtggaggagctgttcggcctggaggactactggtgccagtgcgtggcctggagcagcgccggcaccaccaagagcagaagagcctacgtgagaatcgcctacctgagaaagaacttcgaccaggagcccctgggcaaggaggtgcccctggaccacgaggtgctgctgcagtgcagaccccccgagggcgtgcccgtggccgaggtggagtggctgaagaacgaggacgtgatcgaccccacccaggacaccaacttcctgctgaccatcgaccacaacctgatcatcagacaggccagactgagcgacaccgccaactacacctgcgtggccaagaacatcgtggccaagagaagaagcaccaccgccaccgtgatcgtgtacgtgaacggcggctggagcagctgggccgagtggagcccctgcagcaacagatgcggcagaggctggcagaagagaaccagaacctgcaccaaccccgcccccctgaacggcggcgccttctgcgagggccaggccttccagaagaccgcctgcaccaccatctgccccgtggacggcgcctggaccgagtggagcaagtggagcgcctgcagcaccgagtgcgcccactggagaagcagagagtgcatggccccccccccccagaacggcggcagagactgcagcggcaccctgctggacagcaagaactgcaccgacggcctgtgcatgcagaacaagaagaccctgagcgaccccaacagccacctgctggaggccagcggcgacgccgccctgtacgccggcctggtggtggccatcttcgtggtggtggccatcctgatggccgtgggcgtggtggtgtacagaagaaactgcagagacttcgacaccgacatcaccgacagcagcgccgccctgaccggcggcttccaccccgtgaacttcaagaccgccagacccagcaacccccagctgctgcaccccagcgtgccccccgacctgaccgccagcgccggcatctacagaggccccgtgtacgccctgcaggacagcaccgacaagatccccatgaccaacagccccctgctggaccccctgcccagcctgaaggtgaaggtgtacagcagcagcaccaccggcagcggccccggcctggccgacggcgccgacctgctgggcgtgctgccccccggcacctaccccagcgacttcgccagagacacccacttcctgcacctgagaagcgccagcctgggcagccagcagctgctgggcctgcccagagaccccggcagcagcgtgagcggcaccttcggctgcctgggcggcagactgagcatccccggcaccggcgtgagcctgctggtgcccaacggcgccatcccccagggcaagttctacgagatgtacctgctgatcaacaaggccgagagcaccctgcccctgagcgagggcacccagaccgtgctgagccccagcgtgacctgcggccccaccggcctgctgctgtgcagacccgtgatcctgaccatgccccactgcgccgaggtgagcgccagagactggatcttccagctgaagacccaggcccaccagggccactgggaggaggtggtgaccctggacgaggagaccctgaacaccccctgctactgccagctggagcccagagcctgccacatcctgctggaccagctgggcacctacgtgttcaccggcgagagctacagcagaagcgccgtgaagagactgcagctggccgtgttcgcccccgccctgtgcaccagcctggagtacagcctgagagtgtactgcctggaggacacccccgtggccctgaaggaggtgctggagctggagagaaccctgggcggctacctggtggaggagcccaagcccctgatgttcaaggacagctaccacaacctgagactgagcctgcacgacctgccccacgcccactggagaagcaagctgctggccaagtaccaggagatccccttctaccacatctggagcggcagccagaaggccctgcactgcaccttcaccctggagagacacagcctggccagcaccgagctgacctgcaagatctgcgtgagacaggtggagggcgagggccagatcttccagctgcacaccaccctggccgagacccccgccggcagcctggacaccctgtgcagcgcccccggcagcaccgtgaccacccagctgggcccctacgccttcaagatccccctgagcatcagacagaagatctgcaacagcctggacgcccccaacagcagaggcaacgactggagaatgctggcccagaagctgagcatggacagatacctgaactacttcgccaccaaggccagccccaccggcgtgatcctggacctgtgggaggccctgcagcaggacgacggcgacctgaacagcctggccagcgccctggaggagatgggcaagagcgagatgctggtggccgtggccaccgacggcgactgctag

SEQ ID NO: 104687 - DNA, 2805 bp, Artificial Sequence
  Description of Artificial Sequence: Synthetic coding sequence
atgggcgccagaagcggcgccagaggcgccctgctgctggccctgctgctgtgctgggaccccagactgagccaggccggcaccgacagcggcagcgaggtgctgcccgacagcttccccagcgcccccgccgagcccctgccctacttcctgcaggagccccaggacgcctacatcgtgaagaacaagcccgtggagctgagatgcagagccttccccgccacccagatctacttcaagtgcaacggcgagtgggtgagccagaacgaccacgtgacccaggagggcctggacgaggccaccggcctgagagtgagagaggtgcagatcgaggtgagcagacagcaggtggaggagctgttcggcctggaggactactggtgccagtgcgtggcctggagcagcgccggcaccaccaagagcagaagagcctacgtgagaatcgcctacctgagaaagaacttcgaccaggagcccctgggcaaggaggtgcccctggaccacgaggtgctgctgcagtgcagaccccccgagggcgtgcccgtggccgaggtggagtggctgaagaacgaggacgtgatcgaccccacccaggacaccaacttcctgctgaccatcgaccacaacctgatcatcagacaggccagactgagcgacaccgccaactacacctgcgtggccaagaacatcgtggccaagagaagaagcaccaccgccaccgtgatcgtgtacgtgaacggcggctggagcagctgggccgagtggagcccctgcagcaacagatgcggcagaggctggcagaagagaaccagaacctgcaccaaccccgcccccctgaacggcggcgccttctgcgagggccaggccttccagaagaccgcctgcaccaccatctgccccgtggacggcgcctggaccgagtggagcaagtggagcgcctgcagcaccgagtgcgcccactggagaagcagagagtgcatggccccccccccccagaacggcggcagagactgcagcggcaccctgctggacagcaagaactgcaccgacggcctgtgcatgcagatgctggaggccagcggcgacgccgccctgtacgccggcctggtggtggccatcttcgtggtggtggccatcctgatggccgtgggcgtggtggtgtacagaagaaactgcagagacttcgacaccgacatcaccgacagcagcgccgccctgaccggcggcttccaccccgtgaacttcaagaccgccagacccagcaacccccagctgctgcaccccagcgtgccccccgacctgaccgccagcgccggcatctacagaggccccgtgtacgccctgcaggacagcaccgacaagatccccatgaccaacagccccctgctggaccccctgcccagcctgaaggtgaaggtgtacagcagcagcaccaccggcagcggccccggcctggccgacggcgccgacctgctgggcgtgctgccccccggcacctaccccagcgacttcgccagagacacccacttcctgcacctgagaagcgccagcctgggcagccagcagctgctgggcctgcccagagaccccggcagcagcgtgagcggcaccttcggctgcctgggcggcagactgagcatccccggcaccggcgtgagcctgctggtgcccaacggcgccatcccccagggcaagttctacgagatgtacctgctgatcaacaaggccgagagcaccctgcccctgagcgagggcacccagaccgtgctgagccccagcgtgacctgcggccccaccggcctgctgctgtgcagacccgtgatcctgaccatgccccactgcgccgaggtgagcgccagagactggatcttccagctgaagacccaggcccaccagggccactgggaggaggtggtgaccctggacgaggagaccctgaacaccccctgctactgccagctggagcccagagcctgccacatcctgctggaccagctgggcacctacgtgttcaccggcgagagctacagcagaagcgccgtgaagagactgcagctggccgtgttcgcccccgccctgtgcaccagcctggagtacagcctgagagtgtactgcctggaggacacccccgtggccctgaaggaggtgctggagctggagagaaccctgggcggctacctggtggaggagcccaagcccctgatgttcaaggacagctaccacaacctgagactgagcctgcacgacctgccccacgcccactggagaagcaagctgctggccaagtaccaggagatccccttctaccacatctggagcggcagccagaaggccctgcactgcaccttcaccctggagagacacagcctggccagcaccgagctgacctgcaagatctgcgtgagacaggtggagggcgagggccagatcttccagctgcacaccaccctggccgagacccccgccggcagcctggacaccctgtgcagcgcccccggcagcaccgtgaccacccagctgggcccctacgccttcaagatccccctgagcatcagacagaagatctgcaacagcctggacgcccccaacagcagaggcaacgactggagaatgctggcccagaagctgagcatggacagatacctgaactacttcgccaccaaggccagccccaccggcgtgatcctggacctgtgggaggccctgcagcaggacgacggcgacctgaacagcctggccagcgccctggaggagatgggcaagagcgagatgctggtggccgtggccaccgacggcgactgctag

SEQ ID NO: 104688 - DNA, 2673 bp, Artificial Sequence
  Description of Artificial Sequence: Synthetic coding sequence
gacgacgacttcttccacgagctgcccgagaccttccccagcgacccccccgagcccctgccccacttcctgatcgagcccgaggaggcctacatcgtgaagaacaagcccgtgaacctgtactgcaaggccagccccgccacccagatctacttcaagtgcaacagcgagtgggtgcaccagaaggaccacatcgtggacgagagagtggacgagaccagcggcctgatcgtgagagaggtgagcatcgagatcagcagacagcaggtggaggagctgttcggccccgaggactactggtgccagtgcgtggcctggagcagcgccggcaccaccaagagcagaaaggcctacgtgagaatcgcctacctgagaaagaccttcgagcaggagcccctgggcaaggaggtgagcctggagcaggaggtgctgctgcagtgcagaccccccgagggcatccccgtggccgaggtggagtggctgaagaacgaggacatcatcgaccccgtggaggacagaaacttctacatcaccatcgaccacaacctgatcatcaagcaggccagactgagcgacaccgccaactacacctgcgtggccaagaacatcgtggccaagagaaagagcaccaccgccaccgtgatcgtgtacgtgaacggcggctggagcacctggaccgagtggagcgtgtgcaacagcagatgcggcagaggctaccagaagagaaccagaacctgcaccaaccccgcccccctgaacggcggcgccttctgcgagggccagagcgtgcagaagatcgcctgcaccaccctgtgccccgtggacggcagatggaccccctggagcaagtggagcacctgcggcaccgagtgcacccactggagaagaagagagtgcaccgcccccgcccccaagaacggcggcaaggactgcgacggcctggtgctgcagagcaagaactgcaccgacggcctgtgcatgcagaccgcccccgacagcgacgacgtggccctgtacgtgggcatcgtgatcgccgtgatcgtgtgcctggccatcagcgtggtggtggccctgttcgtgtacagaaagaaccacagagacttcgagagcgacatcatcgacagcagcgccctgaacggcggcttccagcccgtgaacatcaaggccgccagacaggacctgctggccgtgccccccgacctgaccagcgccgccgccatgtacagaggccccgtgtacgccctgcacgacgtgagcgacaagatccccatgaccaacagccccatcctggaccccctgcccaacctgaagatcaaggtgtacaacaccagcggcgccgtgaccccccaggacgacctgagcgagttcaccagcaagctgagcccccagatgacccagagcctgctggagaacgaggccctgagcctgaagaaccagagcctggccagacagaccgaccccagctgcaccgccttcggcagcttcaacagcctgggcggccacctgatcgtgcccaacagcggcgtgagcctgctgatccccgccggcgccatcccccagggcagagtgtacgagatgtacgtgaccgtgcacagaaaggagaccatgagaccccccatggacgacagccagaccctgctgacccccgtggtgagctgcggcccccccggcgccctgctgaccagacccgtggtgctgaccatgcaccactgcgccgaccccaacaccgaggactggaagatcctgctgaagaaccaggccgcccagggccagtgggaggacgtggtggtggtgggcgaggagaacttcaccaccccctgctacatccagctggacgccgaggcctgccacatcctgaccgagaacctgagcacctacgccctggtgggccacagcaccaccaaggccgccgccaagagactgaagctggccatcttcggccccctgtgctgcagcagcctggagtacagcatcagagtgtactgcctggacgacacccaggacgccctgaaggagatcctgcacctggagagacagatgggcggccagctgctggaggagcccaaggccctgcacttcaagggcagcacccacaacctgagactgagcatccacgacatcgcccacagcctgtggaagagcaagctgctggccaagtaccaggagatccccttctaccacgtgtggagcggcagccagagaaacctgcactgcaccttcaccctggagagattcagcctgaacaccgtggagctggtgtgcaagctgtgcgtgagacaggtggagggcgagggccagatcttccagctgaactgcaccgtgagcgaggagcccaccggcatcgacctgcccctgctggaccccgccaacaccatcaccaccgtgaccggccccagcgccttcagcatccccctgcccatcagacagaagctgtgcagcagcctggacgccccccagaccagaggccacgactggagaatgctggcccacaagctgaacctggacagatacctgaactacttcgccaccaagagcagccccaccggcgtgatcctggacctgtgggaggcccagaacttccccgacggcaacctgagcatgctggccgccgtgctggaggagatgggcagacacgagaccgtggtgagcctggccgccgagggccagtactag

SEQ ID NO: 104689 - DNA, 2796 bp, Artificial Sequence
  Description of Artificial Sequence: Synthetic coding sequence
atgagaaagggcctgagagccaccgccgccagatgcggcctgggcctgggctacctgctgcagatgctggtgctgcccgccctggccctgctgagcgccagcggcaccggcagcgccgcccaggacgacgacttcttccacgagctgcccgagaccttccccagcgacccccccgagcccctgccccacttcctgatcgagcccgaggaggcctacatcgtgaagaacaagcccgtgaacctgtactgcaaggccagccccgccacccagatctacttcaagtgcaacagcgagtgggtgcaccagaaggaccacatcgtggacgagagagtggacgagaccagcggcctgatcgtgagagaggtgagcatcgagatcagcagacagcaggtggaggagctgttcggccccgaggactactggtgccagtgcgtggcctggagcagcgccggcaccaccaagagcagaaaggcctacgtgagaatcgcctacctgagaaagaccttcgagcaggagcccctgggcaaggaggtgagcctggagcaggaggtgctgctgcagtgcagaccccccgagggcatccccgtggccgaggtggagtggctgaagaacgaggacatcatcgaccccgtggaggacagaaacttctacatcaccatcgaccacaacctgatcatcaagcaggccagactgagcgacaccgccaactacacctgcgtggccaagaacatcgtggccaagagaaagagcaccaccgccaccgtgatcgtgtacgtgaacggcggctggagcacctggaccgagtggagcgtgtgcaacagcagatgcggcagaggctaccagaagagaaccagaacctgcaccaaccccgcccccctgaacggcggcgccttctgcgagggccagagcgtgcagaagatcgcctgcaccaccctgtgccccgtggacggcagatggaccccctggagcaagtggagcacctgcggcaccgagtgcacccactggagaagaagagagtgcaccgcccccgcccccaagaacggcggcaaggactgcgacggcctggtgctgcagagcaagaactgcaccgacggcctgtgcatgcagaccgcccccgacagcgacgacgtggccctgtacgtgggcatcgtgatcgccgtgatcgtgtgcctggccatcagcgtggtggtggccctgttcgtgtacagaaagaaccacagagacttcgagagcgacatcatcgacagcagcgccctgaacggcggcttccagcccgtgaacatcaaggccgccagacaggacctgctggccgtgccccccgacctgaccagcgccgccgccatgtacagaggccccgtgtacgccctgcacgacgtgagcgacaagatccccatgaccaacagccccatcctggaccccctgcccaacctgaagatcaaggtgtacaacaccagcggcgccgtgaccccccaggacgacctgagcgagttcaccagcaagctgagcccccagatgacccagagcctgctggagaacgaggccctgagcctgaagaaccagagcctggccagacagaccgaccccagctgcaccgccttcggcagcttcaacagcctgggcggccacctgatcgtgcccaacagcggcgtgagcctgctgatccccgccggcgccatcccccagggcagagtgtacgagatgtacgtgaccgtgcacagaaaggagaccatgagaccccccatggacgacagccagaccctgctgacccccgtggtgagctgcggcccccccggcgccctgctgaccagacccgtggtgctgaccatgcaccactgcgccgaccccaacaccgaggactggaagatcctgctgaagaaccaggccgcccagggccagtgggaggacgtggtggtggtgggcgaggagaacttcaccaccccctgctacatccagctggacgccgaggcctgccacatcctgaccgagaacctgagcacctacgccctggtgggccacagcaccaccaaggccgccgccaagagactgaagctggccatcttcggccccctgtgctgcagcagcctggagtacagcatcagagtgtactgcctggacgacacccaggacgccctgaaggagatcctgcacctggagagacagatgggcggccagctgctggaggagcccaaggccctgcacttcaagggcagcacccacaacctgagactgagcatccacgacatcgcccacagcctgtggaagagcaagctgctggccaagtaccaggagatccccttctaccacgtgtggagcggcagccagagaaacctgcactgcaccttcaccctggagagattcagcctgaacaccgtggagctggtgtgcaagctgtgcgtgagacaggtggagggcgagggccagatcttccagctgaactgcaccgtgagcgaggagcccaccggcatcgacctgcccctgctggaccccgccaacaccatcaccaccgtgaccggccccagcgccttcagcatccccctgcccatcagacagaagctgtgcagcagcctggacgccccccagaccagaggccacgactggagaatgctggcccacaagctgaacctggacagatacctgaactacttcgccaccaagagcagccccaccggcgtgatcctggacctgtgggaggcccagaacttccccgacggcaacctgagcatgctggccgccgtgctggaggagatgggcagacacgagaccgtggtgagcctggccgccgagggccagtactag

SEQ ID NO: 104690 - DNA, 3153 bp, Artificial Sequence
  Description of Artificial Sequence: Synthetic coding sequence
atggagcccggcagaggcggcaccgagaccgtgggcaagttcgagttcagcagaaaggacctgatcggccacggcgccttcgccgtggtgttcaagggcagacacagagagaagcacgacctggaggtggccgtgaagtgcatcaacaagaagaacctggccaagagccagaccctgctgggcaaggagatcaagatcctgaaggagctgaagcacgagaacatcgtggccctgtacgacttccaggagatggccaacagcgtgtacctggtgatggagtactgcaacggcggcgacctggccgactacctgcacgccatgagaaccctgagcgaggacaccatcagactgttcctgcagcagatcgccggcgccatgagactgctgcacagcaagggcatcatccacagagacctgaagccccagaacatcctgctgagcaaccccgccggcagaagagccaaccccaacagcatcagagtgaagatcgccgacttcggcttcgccagatacctgcagagcaacatgatggccgccaccctgtgcggcagccccatgtacatggcccccgaggtgatcatgagccagcactacgacggcaaggccgacctgtggagcatcggcaccatcgtgtaccagtgcctgaccggcaaggcccccttccaggccagcagcccccaggacctgagactgttctacgagaagaacaagaccctggtgcccaccatccccagagagaccagcgcccccctgagacagctgctgctggccctgctgcagagaaaccacaaggacagaatggacttcgacgagttcttccaccaccccttcctggacgccagccccagcgtgagaaagagcccccccgtgcccgtgcccagctaccccagcagcggcagcggcagcagcagcagcagcagcagcaccagccacctggccagcccccccagcctgggcgagatgcagcagctgcagaagaccctggccagccccgccgacaccgccggcttcctgcacagcagcagagacagcggcggcagcaaggacagcagctgcgacaccgacgacttcgtgatggtgcccgcccagttccccggcgacctggtggccgaggcccccagcgccaagcccccccccgacagcctgatgtgcagcggcagcagcctggtggccagcgccggcctggagagccacggcagaacccccagccccagccccccctgcagcagcagccccagccccagcggcagagccggccccttcagcagcagcagatgcggcgccagcgtgcccatccccgtgcccacccaggtgcagaactaccagagaatcgagagaaacctgcagagccccacccagttccagacccccagaagcagcgccatcagaagaagcggcagcaccagccccctgggcttcgccagagccagccccagcccccccgcccacgccgagcacggcggcgtgctggccagaaagatgagcctgggcggcggcagaccctacacccccagcccccaggtgggcaccatccccgagagacccggctggagcggcacccccagcccccagggcgccgagatgagaggcggcagaagccccagacccggcagcagcgcccccgagcacagccccagaaccagcggcctgggctgcagactgcacagcgcccccaacctgagcgacctgcacgtggtgagacccaagctgcccaagccccccaccgaccccctgggcgccgtgttcagccccccccaggccagccccccccagcccagccacggcctgcagagctgcagaaacctgagaggcagccccaagctgcccgacttcctgcagagaaaccccctgccccccatcctgggcagccccaccaaggccgtgcccagcttcgacttccccaagacccccagcagccagaacctgctggccctgctggccagacagggcgtggtgatgaccccccccagaaacagaaccctgcccgacctgagcgaggtgggccccttccacggccagcccctgggccccggcctgagacccggcgaggaccccaagggccccttcggcagaagcttcagcaccagcagactgaccgacctgctgctgaaggccgccttcggcacccaggcccccgaccccggcagcaccgagagcctgcaggagaagcccatggagatcgcccccagcgccggcttcggcggcagcctgcaccccggcgccagagccggcggcaccagcagccccagccccgtggtgttcaccgtgggcagcccccccagcggcagcacccccccccagggccccagaaccagaatgttcagcgccggccccaccggcagcgccagcagcagcgccagacacctggtgcccggcccctgcagcgaggcccccgcccccgagctgcccgcccccggccacggctgcagcttcgccgaccccatcaccgccaacctggagggcgccgtgaccttcgaggcccccgacctgcccgaggagaccctgatggagcaggagcacaccgagatcctgagaggcctgagattcaccctgctgttcgtgcagcacgtgctggagatcgccgccctgaagggcagcgccagcgaggccgccggcggccccgagtaccagctgcaggagagcgtggtggccgaccagatcagcctgctgagcagagagtggggcttcgccgagcagctggtgctgtacctgaaggtggccgagctgctgagcagcggcctgcagagcgccatcgaccagatcagagccggcaagctgtgcctgagcagcaccgtgaagcaggtggtgagaagactgaacgagctgtacaaggccagcgtggtgagctgccagggcctgagcctgagactgcagagattcttcctggacaagcagagactgctggacagaatccacagcatcaccgccgagagactgatcttcagccacgccgtgcagatggtgcagagcgccgccctggacgagatgttccagcacagagagggctgcgtgcccagataccacaaggccctgctgctgctggagggcctgcagcacatgctgagcgaccaggccgacatcgagaacgtgaccaagtgcaagctgtgcatcgagagaagactgagcgccctgctgaccggcatctgcgcctag

SEQ ID NO: 104691 - DNA, 1452 bp, Artificial Sequence
  Description of Artificial Sequence: Synthetic coding sequence
atgcagagaaacggcagcgccagcagaggcctggagaagaccagactgagactgtgcagagaggccagaatccccgagagcgccttcctgaccggcctgaccagagagagctgggaggccagatgctggtgcgccaaggacaccagagaggtggtggccatcaagtgcgtggccaagaagagcctgaacaaggccagcgtggagaacctgctgaccgagatcgagatcctgaagggcatcagacacccccacatcgtgcagctgaaggacttccagtgggacagcgacaacatctacctgatcatggagttctgcgccggcggcgacctgagcagattcatccacaccagaagaatcctgcccgagaaggtggccagagtgttcatgcagcagctggccagcgccctgcagttcctgcacgagagaaacatcagccacctggacctgaagccccagaacatcctgctgagcagcctggagaagccccacctgaagctggccgacttcggcttcgcccagcacatgagcccctgggacgagaagcacgtgctgagaggcagccccctgtacatggcccccgagatggtgtgccagagacagtacgacgccagagtggacctgtggagcatgggcgtgatcctgtacgaggccctgttcggccagccccccttcgccagcagaagcttcagcgagctggaggagaagatcagaagcaacagagtgatcgagctgcccctgagacccctgctgagcagagactgcagagacctgctgcagagactgctggagagagaccccagcagaagaatcagcttccaggacttcttcgcccacccctgggtggacctggagcacatgcccagcggcgagagcctgggcagagccaccgccctggtggtgcaggccgtgaagaaggaccaggagggcgacagcgccgccgccctgagcctgtactgcaaggccctggacttcttcgtgcccgccctgcactacgaggtggacgcccagagaaaggaggccatcaaggccaaggtgggccagtacgtgagcagagccgaggagctgaaggccatcgtgagcagcagcaaccaggccctgctgagacagggcaccagcgccagagacctgctgagagagatggccagagacaagcccagactgctggccgccctggaggtggccagcgccgccatggccaaggaggaggccgccggcggcgagcaggacgccctggacctgtaccagcacagcctgggcgagctgctgctgctgctggccgccgagccccccggcagaagaagagagctgctgcacaccgaggtgcagaacctgatggccagagccgagtacctgaaggagcaggtgaagatgagagagagcagatgggaggccgacaccctggacaaggagggcctgagcgagagcgtgagaagcagctgcaccctgcagtag

SEQ ID NO: 104692 - DNA, 1419 bp, Artificial Sequence
  Description of Artificial Sequence: Synthetic coding sequence
atggccggccccggctggggcccccccagactggacggcttcatcctgaccgagagactgggcagcggcacctacgccaccgtgtacaaggcctacgccaagaaggacaccagagaggtggtggccatcaagtgcgtggccaagaagagcctgaacaaggccagcgtggagaacctgctgaccgagatcgagatcctgaagggcatcagacacccccacatcgtgcagctgaaggacttccagtgggacagcgacaacatctacctgatcatggagttctgcgccggcggcgacctgagcagattcatccacaccagaagaatcctgcccgagaaggtggccagagtgttcatgcagcagctggccagcgccctgcagttcctgcacgagagaaacatcagccacctggacctgaagccccagaacatcctgctgagcagcctggagaagccccacctgaagctggccgacttcggcttcgcccagcacatgagcccctgggacgagaagcacgtgctgagaggcagccccctgtacatggcccccgagatggtgtgccagagacagtacgacgccagagtggacctgtggagcatgggcgtgatcctgtacgaggccctgttcggccagccccccttcgccagcagaagcttcagcgagctggaggagaagatcagaagcaacagagtgatcgagctgcccctgagacccctgctgagcagagactgcagagacctgctgcagagactgctggagagagaccccagcagaagaatcagcttccaggacttcttcgcccacccctgggtggacctggagcacatgcccagcggcgagagcctgggcagagccaccgccctggtggtgcaggccgtgaagaaggaccaggagggcgacagcgccgccgccctgagcctgtactgcaaggccctggacttcttcgtgcccgccctgcactacgaggtggacgcccagagaaaggaggccatcaaggccaaggtgggccagtacgtgagcagagccgaggagctgaaggccatcgtgagcagcagcaaccaggccctgctgagacagggcaccagcgccagagacctgctgagagagatggccagagacaagcccagactgctggccgccctggaggtggccagcgccgccatggccaaggaggaggccgccggcggcgagcaggacgccctggacctgtaccagcacagcctgggcgagctgctgctgctgctggccgccgagccccccggcagaagaagagagctgctgcacaccgaggtgcagaacctgatggccagagccgagtacctgaaggagcaggtgaagatgagagagagcagatgggaggccgacaccctggacaaggagggcctgagcgagagcgtgagaagcagctgcaccctgcagtag

SEQ ID NO: 104693 - DNA, 9705 bp, Artificial Sequence
  Description of Artificial Sequence: Synthetic coding sequence
atggtgaagagaaagagcagcgagggccaggagcaggacggcggcagaggcatccccctgcccatccagaccttcctgtggagacagaccagcgccttcctgagacccaagctgggcaagcagtacgaggccagctgcgtgagcttcgagagagtgctggtggagaacaagctgcacggcctgagccccgccctgagcgaggccatccagagcatcagcagatgggagctggtgcaggccgccctgccccacgtgctgcactgcaccgccaccctgctgagcaacagaaacaagctgggccaccaggacaagctgggcgtggccgagaccaagctgctgcacaccctgcactggatgctgctggaggccccccaggactgcaacaacgagagattcggcggcaccgacagaggcagcagctggggcggcagcagcagcgccttcatccaccaggtggagaaccagggcagccccggccagccctgccagagcagcagcaacgacgaggaggagaacaacagaagaaagatcttccagaacagcatggccaccgtggagctgttcgtgttcctgttcgcccccctggtgcacagaatcaaggagagcgacctgaccttcagactggccagcggcctggtgatctggcagcccatgtgggagcacagacagcccggcgtgagcggcttcaccgccctggtgaagcccatcagaaacatcatcaccgccaagagaagcagccccatcaacagccagagcagaacctgcgagagccccaaccaggacgccagacacctggagggcctgcaggtggtgtgcgagaccttccagagcgacagcatcagccccaaggccaccatcagcggctgccacagaggcaacagcttcgacggcagcctgagcagccagaccagccaggagagaggccccagccacagcagagccagcctggtgatccccccctgccagagaagcagatacgccacctacttcgacgtggccgtgctgagatgcctgctgcagccccactggagcgaggagggcacccagtggagcctgatgtactacctgcagagactgagacacatgctggaggagaagcccgagaagccccccgagcccgacatccccctgctgcccagacccagaagcagcagcatggtggccgccgcccccagcctggtgaacacccacaagacccaggacctgaccatgaagtgcaacgaggaggagaagagcctgagcagcgaggccttcagcaaggtgagcctgaccaacctgagaagaagcgccgtgcccgacctgagcagcgacctgggcatgaacatcttcaagaagttcaagagcagaaaggaggacagagagagaaagggcagcatccccttccaccacaccggcaagagaagacccagaagaatgggcgtgcccttcctgctgcacgaggaccacctggacgtgagccccaccagaagcaccttcagcttcggcagcttcagcggcctgggcgaggacagaagaggcatcgagaagggcggctggcagaccaccatcctgggcaagctgaccagaagaggcagcagcgacgccgccaccgagatggagagcctgagcgccagacacagccacagccaccacaccctggtgagcgacctgcccgaccccagcaacagccacggcgagaacaccgtgaaggaggtgagaagccagatcagcaccatcaccgtggccaccttcaacaccaccctggccagcttcaacgtgggctacgccgacttcttcaacgagcacatgagaaagctgtgcaaccaggtgcccatccccgagatgccccacgagcccctggcctgcgccaacctgcccagaagcctgaccgacagctgcatcaactacagctacctggaggacaccgagcacatcgacggcaccaacaacttcgtgcacaagaacggcatgctggacctgagcgtggtgctgaaggccgtgtacctggtgctgaaccacgacatcagcagcagaatctgcgacgtggccctgaacatcgtggagtgcctgctgcagctgggcgtggtgccctgcgtggagaagaacagaaagaagagcgagaacaaggagaacgagaccctggagaagagacccagcgagggcgccttccagttcaagggcgtgagcggcagcagcacctgcggcttcggcggccccgccgtgagcggcgccggcgacggcggcggcgaggagggcggcggcggcgacggcggcggcggcggcggcgacggcggcggcggcggcggcggcggcggcggcccctacgagaagaacgacaagaaccaggagaaggacgagagcacccccgtgagcaaccacagactggccctgaccatgctgatcaagatcgtgaagagcctgggctgcgcctacggctgcggcgagggccacagaggcctgagcggcgacagactgagacaccaggcccagaactgcctgaccaagctgtacaagctggacaagatgcagttcagacagaccatgagagactacgtgaacaaggacagcctgaacaacgtggtggacttcctgcacgccctgctgggcttctgcatggagcccgtgaccgacaacaaggccggcttcggcaacaacttcaccaccgtggacaacaagagcaccgcccagaacgtggagggcatcatcgtgagcgccatgttcaagagcctgatcaccagatgcgccagcaccacccacgagctgcacagccccgagaacctgggcctgtactgcgacatcagacagctggtgcagttcatcaaggaggcccacggcaacgtgttcagaagagtggccctgagcgccctgctggacagcgccgagaagctggcccccggcaagaaggtggaggagaacgagcaggagagcaagcccgccggcagcaagagaagcgaggccggcagcatcgtggacaagggccaggtgagcagcgcccccgaggagtgcagaagcttcatgagcggcagacccagccagacccccgagcacgacgagcagatgcagggcgccaacctgggcagaaaggacttctggagaaagatgttcaagagccagagcgccgccagcgacaccagcagccagagcgagcaggacaccagcgagtgcaccaccgcccacagcggcaccaccagcgacagaagagccagaagcagaagcagaagaatcagcctgagaaagaagctgaagctgcccatcggcaagagaaactggctgaagagaagcagcctgagcggcctggccgacggcgtggaggacctgctggacatcagcagcgtggacagactgagcttcatcagacagagcagcaaggtgaagttcaccagcgccgtgaagctgagcgagggcggccccggcagcggcatggagaacggcagagacgaggaggagaacttcttcaagagactgggctgccacagcttcgacgaccacctgagccccaaccaggacggcggcaagagcaagaacgtggtgaacctgggcgccatcagacagggcatgaagagattccagttcctgctgaactgctgcgagcccggcaccatccccgacgccagcatcctggccgccgccctggacctggaggcccccgtggtggccagagccgccctgttcctggagtgcgccagattcgtgcacagatgcaacagaggcaactggcccgagtggatgaagggccaccacgtgaacatcaccaagaagggcctgagcagaggcagaagccccatcgtgggcaacaagagaaaccagaagctgcagtggaacgccgccaagctgttctaccagtggggcgacgccatcggcgtgagactgaacgagctgtgccacggcgagagcgagagccccgccaacctgctgggcctgatctacgacgaggagaccaagagaagactgagaaaggaggacgaggaggaggacttcctggacgacagcaccgtgaaccccagcaagtgcggctgccccttcgccctgaagatggccgcctgccagctgctgctggagatcaccaccttcctgagagagaccttcagctgcctgcccagacccagaaccgagcccctggtggacctggagagctgcagactgagactggaccccgagctggacagacacagatacgagagaaagatcagcttcgccggcgtgctggacgagaacgaggacagcaaggacagcctgcacagcagcagccacaccctgaagagcgacgccggcgtggaggagaagaaggagggcagcccctggagcgccagcgagcccagcatcgagcccgagggcatgagcaacgccggcgccgaggagaactaccacagaaacatgagctggctgcacgtgatgatcctgctgtgcaaccagcagagcttcatctgcacccacgtggactactgccacccccactgctacctgcaccacagcagaagctgcgccagactggtgagagccatcaagctgctgtacggcgacagcgtggacagcctgagagagagcagcaacatcagcagcgtggccctgagaggcaagaagcagaaggagtgcagcgacaagagctgcctgagaacccccagcctgaagaagagagtgagcgacgccaacctggagggcaagaaggacagcggcatgctgaagtacatcagactgcaggtgatgagcctgagccccgcccccctgagcctgctgatcaaggccgcccccatcctgaccgaggagatgtacggcgacatccagcccgccgcctgggagctgctgctgagcatggacgagcacatggccggcgccgccgccgccatgttcctgctgtgcgccgtgaaggtgcccgaggccgtgagcgacatgctgatgagcgagttccaccaccccgagaccgtgcagagactgaacgccgtgctgaagttccacaccctgtggagattcagataccaggtgtggcccagaatggaggagggcgcccagcagatcttcaagatccccccccccagcatcaacttcaccctgcccagccccgtgctgggcatgcccagcgtgcccatgttcgaccccccctgggtgccccagtgcagcggcagcgtgcaggaccccatcaacgaggaccagagcaagagcttcagcgccagagccgtgagcagaagccaccagagagccgagcacatcctgaagaacctgcagcaggaggaggagaagaagagactgggcagagaggccagcctgatcaccgccatccccatcacccaggaggcctgctacgagcccacctgcacccccaacagcgagcccgaggaggaggtggaggaggtgaccaacctggccagcagaagactgagcgtgagccccagctgcaccagcagcaccagccacagaaactacagcttcagaagaggcagcgtgtggagcgtgagaagcgccgtgagcgccgaggacgaggagcacaccaccgagcacacccccaaccaccacgtgccccagcccccccaggccgtgttccccgcctgcatctgcgccgccgtgctgcccatcgtgcacctgatggaggacggcgaggtgagagaggacggcgtggccgtgagcgccgtggcccagcaggtgctgtggaactgcctgatcgaggaccccagcaccgtgctgagacacttcctggagaagctgaccatcagcaacagacaggacgagctgatgtacatgctgagaaagctgctgctgaacatcggcgacttccccgcccagaccagccacatcctgttcaactacctggtgggcctgatcatgtacttcgtgagaaccccctgcgagtggggcatggacgccatcagcgccaccctgaccttcctgtgggaggtggtgggctacgtggagggcctgttcttcaaggacctgaagcagaccatgaagaaggagcagtgcgaggtgaagctgctggtgaccgccagcatgcccggcaccaagaccctggtggtgcacggccagaacgagtgcgacatccccacccagctgcccgtgcacgaggacacccagttcgaggccctgctgaaggagtgcctggagttcttcaacatccccgagagccagagcacccactacttcctgatggacaagagatggaacctgatccactacaacaagacctacgtgagagacatctaccccttcagaagaagcgtgagcccccagctgaacctggtgcacatgcaccccgagaagggccaggagctgatccagaagcaggtgttcaccagaaagctggaggaggtgggcagagtgctgttcctgatcagcctgacccagaagatccccaccgcccacaagcagagccacgtgagcatgctgcaggaggacctgctgagactgcccagcttccccagaagcgccatcgacgccgagttcagcctgttcagcgacccccaggccggcaaggagctgttcggcctggacaccctgcagaagagcctgtggatccagctgctggaggagatgttcctgggcatgcccagcgagttcccctggggcgacgagatcatgctgttcctgaacgtgttcaacggcgccctgatcctgcaccccgaggacagcgccctgctgagacagtacgccgccaccgtgatcaacaccgccgtgcacttcaaccacctgttcagcctgagcggctaccagtggatcctgcccaccatgctgcaggtgtacagcgactacgagagcaacccccagctgagacaggccatcgagttcgcctgccaccagttctacatcctgcacagaaagcccttcgtgctgcagctgttcgccagcgtggcccccctgctggagttccccgacgccgccaacaacggccccagcaagggcgtgagcgcccagtgcctgttcgacctgctgcagagcctggagggcgagaccaccgacatcctggacatcctggagctggtgaaggccgagaagcccctgaagagcctggacttctgctacggcaacgaggacctgaccttcagcatcagcgaggccatcaagctgtgcgtgaccgtggtggcctacgcccccgagagcttcagaagcctgcagatgctgatggtgctggaggccctggtgccctgctacctgcagaagctgaagagacagaccagccaggtggagaccgtgcccgccgccagagaggagatcgccgccaccgccgccctggccaccagcctgcaggccctgctgtacagcgtggaggtgctgaccagacccatgaccgccccccagatgagcagatgcgaccagggccacaagggcaccaccaccgccaaccacaccatgagcagcggcgtgaacaccagataccaggagcagggcgccaagctgcacttcatcagagagaacctgcacctgctggaggagggccagggcatccccagagaggagctggacgagagaatcgccagagaggagttcagaagacccagagagagcctgctgaacatctgcaccgagttctacaagcactgcggccccagactgaagatcctgcagaacctggccggcgagcccagagtgatcgccctggagctgctggacgtgaagagccacatgagactggccgagatcgcccacagcctgctgaagctggccccctacgacacccagaccatggagagcagaggcctgagaagatacatcatggagatgctgcccatcaccgactggaccgccgaggccgtgagacccgccctgatcctgatcctgaagagactggacagaatgttcaacaagatccacaagatgcccaccctgagaagacaggtggagtgggagcccgccagcaacctgatcgagggcgtgtgcctgaccctgcagagacagcccatcatcagcttcctgccccacctgagaagcctgatcaacgtgtgcgtgaacctggtgatgggcgtggtgggccccagcagcgtggccgacggcctgcccctgctgcacctgagcccctacctgagcccccccctgcccttcagcaccgccgtggtgagactggtggccctgcagatccaggccctgaaggaggacttccccctgagccacgtgatcagccccttcaccaaccaggagagaagagagggcatgctgctgaacctgctgatccccttcgtgctgaccgtgggcagcggcagcaaggacagcccctggctggagcagcccgaggtgcagctgctgctgcagaccgtgatcaacgtgctgctgccccccagaatcatcagcaccagcagaagcaagaacttcatgctggagagcagccccgcccactgcagcacccccggcgacgccggcaaggacctgagaagagagggcctggccgagagcaccagccaggccgcctacctggccctgaaggtgatcctggtgtgcttcgagagacagctgggcagccagtggtactggctgagcctgcaggtgaaggagatggccctgagaaaggtgggcggcctggccctgtgggacttcctggacttcatcgtgagaaccagaatccccatcttcgtgctgctgagacccttcatccagtgcaagctgctggcccagcccgccgagaaccacgaggagctgagcgccagacagcacatcgccgaccagctggagagaagattcatccccagacccctgtgcaagagcagcctgatcgccgagttcaacagcgagctgaagatcctgaaggaggccgtgcacagcggcagcgcctaccagggcaagaccagcatcagcaccgtgggcaccagcaccagcgcctacagactgagcctggccaccatgagcagaagcaacaccggcaccggcaccgtgtgggagcaggacagcgagcccagccagcaggccagccaggacaccctgagcagaaccgacgaggaggacgaggagaacgacagcatcagcatgcccagcgtggtgagcgagcaggaggcctacctgctgagcgccatcggcagaagaagattcagcagccacgtgagcagcatgagcgtgccccaggccgaggtgggcatgctgcccagccagagagtggccagcatccagagcgagcccggccagcagaacctgctggtgcagcagcccctgggcagaaagagaggcctgagacagctgagaagacccctgctgagcagacagaagacccagaccgagcccagaaacagacagggcgccagactgagcaccaccagaagaagcatccagcccaagaccaagcccagcgccgaccagaagagaagcgtgaccttcatcgaggcccagcccgagcccgccgccgcccccaccgacgccctgcccgccaccggccagctgcagggctgcagccccgcccccagcagaaagcccgaggccatggacgagcccgtgctgaccagcagccccgccatcgtggtggccgacctgcacagcgtgagccccaagcagagcgagaacttccccaccgaggagggcgagaaggaggaggacaccgaggcccagggcgccaccgcccacagccccctgagcgcccagctgagcgaccccgacgacttcaccggcctggagaccagcagcctgctgcagcacggcgacaccgtgctgcacatcagcgaggagaacggcatggagaaccccctgctgagcagccagttcaccttcacccccaccgagctgggcaagaccgacgccgtgctggacgagagccacgtgtag

SEQ ID NO: 104694 - DNA, 9777 bp, Artificial Sequence
  Description of Artificial Sequence: Synthetic coding sequence
atggtgaagagaaagagcagcgagggccaggagcaggacggcggcagaggcatccccctgcccatccagaccttcctgtggagacagaccagcgccttcctgagacccaagctgggcaagcagtacgaggccagctgcgtgagcttcgagagagtgctggtggagaacaagctgcacggcctgagccccgccctgagcgaggccatccagagcatcagcagatgggagctggtgcaggccgccctgccccacgtgctgcactgcaccgccaccctgctgagcaacagaaacaagctgggccaccaggacaagctgggcgtggccgagaccaagctgctgcacaccctgcactggatgctgctggaggccccccaggactgcaacaacgagagattcggcggcaccgacagaggcagcagctggggcggcagcagcagcgccttcatccaccaggtggagaaccagggcagccccggccagccctgccagagcagcagcaacgacgaggaggagaacaacagaagaaagatcttccagaacagcatggccaccgtggagctgttcgtgttcctgttcgcccccctggtgcacagaatcaaggagagcgacctgaccttcagactggccagcggcctggtgatctggcagcccatgtgggagcacagacagcccggcgtgagcggcttcaccgccctggtgaagcccatcagaaacatcatcaccgccaagagaagcagccccatcaacagccagagcagaacctgcgagagccccaaccaggacgccagacacctggagggcctgcaggtggtgtgcgagaccttccagagcgacagcatcagccccaaggccaccatcagcggctgccacagaggcaacagcttcgacggcagcctgagcagccagaccagccaggagagaggccccagccacagcagagccagcctggtgatccccccctgccagagaagcagatacgccacctacttcgacgtggccgtgctgagatgcctgctgcagccccactggagcgaggagggcacccagtggagcctgatgtactacctgcagagactgagacacatgctggaggagaagcccgagaagccccccgagcccgacatccccctgctgcccagacccagaagcagcagcatggtggccgccgcccccagcctggtgaacacccacaagacccaggacctgaccatgaagtgcaacgaggaggagaagagcctgagcagcgaggccttcagcaaggtgagcctgaccaacctgagaagaagcgccgtgcccgacctgagcagcgacctgggcatgaacatcttcaagaagttcaagagcagaaaggaggacagagagagaaagggcagcatccccttccaccacaccggcaagagaagacccagaagaatgggcgtgcccttcctgctgcacgaggaccacctggacgtgagccccaccagaagcaccttcagcttcggcagcttcagcggcctgggcgaggacagaagaggcatcgagaagggcggctggcagaccaccatcctgggcaagctgaccagaagaggcagcagcgacgccgccaccgagatggagagcctgagcgccagacacagccacagccaccacaccctggtgagcgacctgcccgaccccagcaacagccacggcgagaacaccgtgaaggaggtgagaagccagatcagcaccatcaccgtggccaccttcaacaccaccctggccagcttcaacgtgggctacgccgacttcttcaacgagcacatgagaaagctgtgcaaccaggtgcccatccccgagatgccccacgagcccctggcctgcgccaacctgcccagaagcctgaccgacagctgcatcaactacagctacctggaggacaccgagcacatcgacggcaccaacaacttcgtgcacaagaacggcatgctggacctgagcgtggtgctgaaggccgtgtacctggtgctgaaccacgacatcagcagcagaatctgcgacgtggccctgaacatcgtggagtgcctgctgcagctgggcgtggtgccctgcgtggagaagaacagaaagaagagcgagaacaaggagaacgagaccctggagaagagacccagcgagggcgccttccagttcaagggcgtgagcggcagcagcacctgcggcttcggcggccccgccgtgagcggcgccggcgacggcggcggcgaggagggcggcggcggcgacggcggcggcggcggcggcgacggcggcggcggcggcggcggcggcggcggcccctacgagaagaacgacaagaaccaggagaaggacgagagcacccccgtgagcaaccacagactggccctgaccatgctgatcaagatcgtgaagagcctgggctgcgcctacggctgcggcgagggccacagaggcctgagcggcgacagactgagacaccaggtgttcagagagaacgcccagaactgcctgaccaagctgtacaagctggacaagatgcagttcagacagaccatgagagactacgtgaacaaggacagcctgaacaacgtggtggacttcctgcacgccctgctgggcttctgcatggagcccgtgaccgacaacaaggccggcttcggcaacaacttcaccaccgtggacaacaagagcaccgcccagaacgtggagggcatcatcgtgagcgccatgttcaagagcctgatcaccagatgcgccagcaccacccacgagctgcacagccccgagaacctgggcctgtactgcgacatcagacagctggtgcagttcatcaaggaggcccacggcaacgtgttcagaagagtggccctgagcgccctgctggacagcgccgagaagctggcccccggcaagaaggtggaggagaacgagcaggagagcaagcccgccggcagcaagagaagcgaggccggcagcatcgtggacaagggccaggtgagcagcgcccccgaggagtgcagaagcttcatgagcggcagacccagccagacccccgagcacgacgagcagatgcagggcgccaacctgggcagaaaggacttctggagaaagatgttcaagagccagagcgccgccagcgacaccagcagccagagcgagcaggacaccagcgagtgcaccaccgcccacagcggcaccaccagcgacagaagagccagaagcagaagcagaagaatcagcctgagaaagaagctgaagctgcccatcggcaagagaaactggctgaagagaagcagcctgagcggcctggccgacggcgtggaggacctgctggacatcagcagcgtggacagactgagcttcatcagacagagcagcaaggtgaagttcaccagcgccgtgaagctgagcgagggcggccccggcagcggcatggagaacggcagagacgaggaggagaacttcttcaagagactgggctgccacagcttcgacgaccacctgagccccaaccaggacggcggcaagagcaagaacgtggtgaacctgggcgccatcagacagggcatgaagagattccagttcctgctgaactgctgcgagcccggcaccatccccgacgccagcatcctggccgccgccctggacctggaggcccccgtggtggccagagccgccctgttcctggagtgcgccagattcgtgcacagatgcaacagaggcaactggcccgagtggatgaagggccaccacgtgaacatcaccaagaagggcctgagcagaggcagaagccccatcgtgggcaacaagagaaaccagaagctgcagtggaacgccgccaagctgttctaccagtggggcgacgccatcggcgtgagactgaacgagctgtgccacggcgagagcgagagccccgccaacctgctgggcctgatctacgacgaggagaccaagagaagactgagaaaggaggacgaggaggaggacttcctggacgacagcaccgtgaaccccagcaagtgcggctgccccttcgccctgaagatggccgcctgccagctgctgctggagatcaccaccttcctgagagagaccttcagctgcctgcccagacccagaaccgagcccctggtggacctggagagctgcagactgagactggaccccgagctggacagacacagatacgagagaaagatcagcttcgccggcgtgctggacgagaacgaggacagcaaggacagcctgcacagcagcagccacaccctgaagagcgacgccggcgtggaggagaagaaggagggcagcccctggagcgccagcgagcccagcatcgagcccgagggcatgagcaacgccggcgccgaggagaactaccacagaaacatgagctggctgcacgtgatgatcctgctgtgcaaccagcagagcttcatctgcacccacgtggactactgccacccccactgctacctgcaccacagcagaagctgcgccagactggtgagagccatcaagctgctgtacggcgacagcgtggacagcctgagagagagcagcaacatcagcagcgtggccctgagaggcaagaagcagaaggagtgcagcgacaagagctgcctgagaacccccagcctgaagaagagagtgagcgacgccaacctggagggcaagaaggacagcggcatgctgaagtacatcagactgcaggtgatgagcctgagccccgcccccctgagcctgctgatcaaggccgcccccatcctgaccgaggagatgtacggcgacatccagcccgccgcctgggagctgctgctgagcatggacgagcacatggccggcgccgccgccgccatgttcctgctgtgcgccgtgaaggtgcccgaggccgtgagcgacatgctgatgagcgagttccaccaccccgagaccgtgcagagactgaacgccgtgctgaagttccacaccctgtggagattcagataccaggtgtggcccagaatggaggagggcgcccagcagatcttcaagatccccccccccagcatcaacttcaccctgcccagccccgtgctgggcatgcccagcgtgcccatgttcgaccccccctgggtgccccagtgcagcggcagcgtgcaggaccccatcaacgaggaccagagcaagagcttcagcgccagagccgtgagcagaagccaccagagagccgagcacatcctgaagaacctgcagcaggaggaggagaagaagagactgggcagagaggccagcctgatcaccgccatccccatcacccaggaggcctgctacgagcccacctgcacccccaacagcgagcccgaggaggaggtggaggaggtgaccaacctggccagcagaagactgagcgtgagccccagctgcaccagcagcaccagccacagaaactacagcttcagaagaggcagcgtgtggagcgtgagaagcgccgtgagcgccgaggacgaggagcacaccaccgagcacacccccaaccaccacgtgccccagcccccccaggccgtgttccccgcctgcatctgcgccgccgtgctgcccatcgtgcacctgatggaggacggcgaggtgagagaggacggcgtggccgtgagcgccgtggcccagcaggtgctgtggaactgcctgatcgaggaccccagcaccgtgctgagacacttcctggagaagctgaccatcagcaacagacaggacgagctgatgtacatgctgagaaagctgctgctgaacatcggcgacttccccgcccagaccagccacatcctgttcaactacctggtgggcctgatcatgtacttcgtgagaaccccctgcgagtggggcatggacgccatcagcgccaccctgaccttcctgtgggaggtggtgggctacgtggagggcctgttcttcaaggacctgaagcagaccatgaagaaggagcagtgcgaggtgaagctgctggtgaccgccagcatgcccggcaccaagaccctggtggtgcacggccagaacgagtgcgacatccccacccagctgcccgtgcacgaggacacccagttcgaggccctgctgaaggagtgcctggagttcttcaacatccccgagagccagagcacccactacttcctgatggacaagagatggaacctgatccactacaacaagacctacgtgagagacatctaccccttcagaagaagcgtgagcccccagctgaacctggtgcacatgcaccccgagaagggccaggagctgatccagaagcaggtgttcaccagaaagctggaggaggtgggcagagtgctgttcctgatcagcctgacccagaagatccccaccgcccacaagcagagccacgtgagcatgctgcaggaggacctgctgagactgcccagcttccccagaagcgccatcgacgccgagttcagcctgttcagcgacccccaggccggcaaggagctgttcggcctggacaccctgcagaagagcctgtggatccagctgctggaggagatgttcctgggcatgcccagcgagttcccctggggcgacgagatcatgctgttcctgaacgtgttcaacggcgccctgatcctgcaccccgaggacagcgccctgctgagacagtacgccgccaccgtgatcaacaccgccgtgcacttcaaccacctgttcagcctgagcggctaccagtggatcctgcccaccatgctgcaggtgtacagcgactacgagagcaacccccagctgagacaggccatcgagttcgcctgccaccagttctacatcctgcacagaaagcccttcgtgctgcagctgttcgccagcgtggcccccctgctggagttccccgacgccgccaacaacggccccagcaagggcgtgagcgcccagtgcctgttcgacctgctgcagagcctggagggcgagaccaccgacatcctggacatcctggagctggtgaaggccgagaagcccctgaagagcctggacttctgctacggcaacgaggacctgaccttcagcatcagcgaggccatcaagctgtgcgtgaccgtggtggcctacgcccccgagagcttcagaagcctgcagatgctgatggtgctggaggccctggtgccctgctacctgcagaagctgaagagacagaccagccaggtggagaccgtgcccgccgccagagaggagatcgccgccaccgccgccctggccaccagcctgcaggccctgctgtacagcgtggaggtgctgaccagacccatgaccgccccccagatgagcagatgcgaccagggccacaagggcaccaccaccgccaaccacaccatgagcagcggcgtgaacaccagataccaggagcagggcgccaagctgcacttcatcagagagaacctgcacctgctggaggagggccagggcatccccagagaggagctggacgagagaatcgccagagaggagttcagaagacccagagagagcctgctgaacatctgcaccgagttctacaagcactgcggccccagactgaagatcctgcagaacctggccggcgagcccagagtgatcgccctggagctgctggacgtgaagagccacatgagactggccgagatcgcccacagcctgctgaagctggccccctacgacacccagaccatggagagcagaggcctgagaagatacatcatggagatgctgcccatcaccgactggaccgccgaggccgtgagacccgccctgatcctgatcctgaagagactggacagaatgttcaacaagatccacaagatgcccaccctgagaagacaggtggagtgggagcccgccagcaacctgatcgagggcgtgtgcctgaccctgcagagacagcccatcatcagcttcctgccccacctgagaagcctgatcaacgtgtgcgtgaacctggtgatgggcgtggtgggccccagcagcgtggccgacggcctgcccctgctgcacctgagcccctacctgagcccccccctgcccttcagcaccgccgtggtgagactggtggccctgcagatccaggccctgaaggaggacttccccctgagccacgtgatcagccccttcaccaaccaggagagaagagagggcatgctgctgaacctgctgatccccttcgtgctgaccgtgggcagcggcagcaaggacagcccctggctggagcagcccgaggtgcagctgctgctgcagaccgtgatcaacgtgctgctgccccccagaatcatcagcaccagcagaagcaagaacttcatgctggagagcagccccgcccactgcagcacccccggcgacgccggcaaggacctgagaagagagggcctggccgagagcaccagccaggccgcctacctggccctgaaggtgatcctggtgtgcttcgagagacagctgggcagccagtggtactggctgagcctgcaggtgaaggagatggccctgagaaaggtgggcggcctggccctgtgggacttcctggacttcatcgtgagaaccagaatccccatcttcgtgctgctgagacccttcatccagtgcaagctgctggcccagcccgccgagaaccacgaggagctgagcgccagacagcacatcgccgaccagctggagagaagattcatccccagacccctgtgcaagagcagcctgatcgccgagttcaacagcgagctgaagatcctgaaggaggccgtgcacagcggcagcgcctaccagggcaagaccagcatcagcaccgtgggcaccagcaccagcgcctacagactgagcctggccaccatgagcagaagcaacaccggcaccggcaccgtgtgggagcaggacagcgagcccagccagcaggccagccaggacaccctgagcagaaccgacgaggaggacgaggagaacgacagcatcagcatgcccagcgtggtgagcgagcaggaggcctacctgctgagcgccatcggcagaagaagattcagcagccacgtgagcagcatgagcgtgccccaggccgaggtgggcatgctgcccagccagagcgagcccaacgtgctggacgacagccagggcctggccgccgagggcagcctgagcagagtggccagcatccagagcgagcccggccagcagaacctgctggtgcagcagcccctgggcagaaagagaggcctgagacagctgagaagacccctgctgagcagacagaagacccagaccgagcccagaaacagacagggcgccagactgagcaccaccagaagaagcatccagcccaagaccaagcccagcgccgaccagaagagaagcgtgaccttcatcgaggcccagcccgagcccgccgccgcccccaccgacgccctgcccgccaccggccagctgcagggctgcagccccgcccccagcagaaagcccgaggccatggacgagcccgtgctgaccagcagccccgccatcgtggtggccgacctgcacagcgtgagccccaagcagagcgagaacttccccaccgaggagggcgagaaggaggaggacaccgaggcccagggcgccaccgcccacagccccctgagcgcccagctgagcgaccccgacgacttcaccggcctggagaccagcagcctgctgcagcacggcgacaccgtgctgcacatcagcgaggagaacggcatggagaaccccctgctgagcagccagttcaccttcacccccaccgagctgggcaagaccgacgccgtgctggacgagagccacgtgtag

SEQ ID NO: 104695 - DNA, 1401 bp, Artificial Sequence
  Description of Artificial Sequence: Synthetic coding sequence
atggagagcagaggcctgagaagatacatcatggagatgctgcccatcaccgactggaccgccgaggccgtgagacccgccctgatcctgatcctgaagagactggacagaatgttcaacaagatccacaagatgcccaccctgagaagacaggtggagtgggagcccgccagcaacctgatcgagggcgtgtgcctgaccctgcagagacagcccatcatcagcttcctgccccacctgagaagcctgatcaacgtgtgcgtgaacctggtgatgggcgtggtgggccccagcagcgtggccgacggcctgcccctgctgcacctgagcccctacctgagcccccccctgcccttcagcaccgccgtggtgagactggtggccctgcagatccaggccctgaaggaggacttccccctgagccacgtgatcagccccttcaccaaccaggagagaagagagggcatgctgctgaacctgctgatccccttcgtgctgaccgtgggcagcggcagcaaggacagcccctggctggagcagcccgaggtgcagctgctgctgcagaccgtgatcaacgtgctgctgccccccagaatcatcagcaccagcagaagcaagaacttcatgctggagagcagccccgcccactgcagcacccccggcgacgccggcaaggacctgagaagagagggcctggccgagagcaccagccaggccgcctacctggccctgaaggtgatcctggtgtgcttcgagagacagctgggcagccagtggtactggctgagcctgcaggtgaaggagatggccctgagaaaggtgggcggcctggccctgtgggacttcctggacttcatcgtgagaaccagaatccccatcttcgtgctgctgagacccttcatccagtgcaagctgctggcccagcccgccgagaaccacgaggagctgagcgccagacagcacatcgccgaccagctggagagaagattcatccccagacccctgtgcaagagcagcctgatcgccgagttcaacagcgagctgaagatcctgaaggaggccgtgcacagcggcagcgcctaccagggcaagaccagcatcagcaccgtgggcaccagcaccagcgcctacagactgagcctggccaccatgagcagaagcaacaccggcaccggcaccgtgtgggagcaggacagcgagcccagccagcaggccagccaggacaccctgagcagaaccgacgaggaggacgaggagaacgacagcatcagcatgcccagcgtggtgagcgagcaggaggcctacctgctgagcgccatcggcagaagaagattcagcagccacgtgagcagcatgagcgtgccccaggccgaggtgggcatgctgcccagccagagatag

SEQ ID NO: 104696 - DNA, 786 bp, Artificial Sequence; identical to SEQ ID NO: 84966
  Description of Artificial Sequence: Synthetic coding sequence

SEQ ID NO: 104697 - DNA, 1248 bp, Artificial Sequence
  Description of Artificial Sequence: Synthetic coding sequence
atggacagaagcctgagaaacgtgctggtggtgagcttcggcttcctgctgctgttcaccgcctacggcggcctgcagagcctgcagagcagcctgtacagcgaggagggcctgggcgtgaccgccctgagcaccctgtacggcggcatgctgctgagcagcatgttcctgccccccctgctgatcgagagactgggctgcaagggcaccatcatcctgagcatgtgcggctacgtggccttcagcgtgggcaacttcttcgccagctggtacaccctgatccccaccagcatcctgctgggcctgggcgccgcccccctgtggagcgcccagtgcacctacctgaccatcaccggcaacacccacgccgagaaggccggcaagagaggcaaggacatggtgaaccagtacttcggcatcttcttcctgatcttccagagcagcggcgtgtggggcaacctgatcagcagcctggtgttcggccagacccccagccagggcagcggcgtgctggccgtgctgatgatcgccgccttcctgcagcccatcagagacgtgcagagagagagcgagggcgagaagaagagcgtgcccttctggagcaccctgctgagcaccttcaagctgtacagagacaagagactgtgcctgctgatcctgctgcccctgtacagcggcctgcagcagggcttcctgagcagcgagtacaccagaagctacgtgacctgcaccctgggcatccagttcgtgggctacgtgatgatctgcttcagcgccaccgacgccctgtgcagcgtgctgtacggcaaggtgagccagtacaccggcagagccgtgctgtacgtgctgggcgccgtgacccacgtgagctgcatgatcgccctgctgctgtggagacccagagccgaccacctggccgtgttcttcgtgttcagcggcctgtggggcgtggccgacgccgtgtggcagacccagaacaacgccctgtacggcgtgctgttcgagaagagcaaggaggccgccttcgccaactacagactgtgggaggccctgggcttcgtgatcgccttcggctacagcatgttcctgtgcgtgcacgtgaagctgtacatcctgctgggcgtgctgagcctgaccatggtggcctacggcctggtggagtgcgtggagagcaagaaccccatcagaccccacgcccccggccaggtgaaccaggccgaggacgaggagatccagaccaagatgtag

SEQ ID NO: 104698 - DNA, 435 bp, Artificial Sequence
  Description of Artificial Sequence: Synthetic coding sequence
atggacagaagcctgagaaacgtgctggtggtgagcttcggcttcctgctgctgttcaccgcctacggcggcctgcagagcctgcagagcagcctgtacagcgaggagggcctgggcgtgaccgccctgagcaccctgtacggcggcatgctgctgagcagcatgttcctgccccccctgctgatcgagagactgggctgcaagggcaccatcatcctgagcatgtgcggctacgtggccttcagcgtgggcaacttcttcgccagctggtacaccctgatccccaccagcatcctgctgggcctgggcgccgcccccctgtggagcgcccagtgcacctacctgaccatcaccggcaacacccacgccgagaaggccggcaagagaggcaaggacatggtgaaccagtacttcggcatcttcttcctgatctag

SEQ ID NO: 104699 - DNA, 1545 bp, Artificial Sequence
  Description of Artificial Sequence: Synthetic coding sequence
atgagcagatggctgtggccctggagcaactgcgtgaaggagagagtgtgcagatacctgctgcaccactacctgggccacttcttccaggagcacctgagcctggaccagctgagcctggacctgtacaagggcagcgtggccctgagagacatccacctggagatctggagcgtgaacgaggtgctggagagcatggagagccccctggagctggtggagggcttcgtgggcagcatcgaggtggccgtgccctgggccgccctgctgaccgaccactgcaccgtgagagtgagcggcctgcagctgaccctgcagcccagaagaggccccgcccccggcgccgccgacagccagagctgggccagctgcatgaccaccagcctgcagctggcccaggagtgcctgagagacggcctgcccgagcccagcgagcccccccagcccctggagggcctggagatgttcgcccagaccatcgagaccgtgctgagaagaatcaaggtgaccttcctggacaccgtggtgagagtggagcacagccccggcgacggcgagagaggcgtggccgtggaggtgagagtgcagagactggagtactgcgacgaggccgtgagagaccccagccaggccccccccgtggacgtgcaccagccccccgccttcctgcacaagctgctgcagctggccggcgtgagactgcactacgaggagctgcccgcccaggaggagccccccgagccccccctgcagatcggcagctgcagcggctacatggagctgatggtgaagctgaagcagaacgaggccttccccggccccaagctggaggtggccggccagctgggcagcctgcacctgctgctgacccccagacagctgcagcagctgcaggagctgctgagcgccgtgagcctgaccgaccacgagggcctggccgacaagctgaacaagagcagacccctgggcgccgaggacctgtggctgatcgagcaggacctgaaccagcagctgcaggccggcgccgtggccgagcccctgagccccgaccccctgaccaaccccctgctgaacctggacaacaccgacctgttcttcagcatggccggcctgaccagcagcgtggccagcgccctgagcgagctgagcctgagcgacgtggacctggccagcagcgtgagaagcgacatggccagcagaagactgagcgcccaggccagacccggcctggccctgcagggcatggccaccgtgaaggacgccttccccgcctgccccctgcccatctgctgcgagagaggcgccagcctgccctggggcctgagccccggcagcgccctgttcctgagaggcgagagaaccctgcccctgcccagacccggccccaccctgctgcccagccccagaaccgaggccttcggccccagcgaccccatccccctgagccaggtgagcttctgcgtgtggggcgaggagggcatgatcagcgtgtggttcgacgtgctgttcctgagcagcgtgagcgcctgggtgagcgtgtgctag

SEQ ID NO: 104700 - DNA, 924 bp, Artificial Sequence
  Description of Artificial Sequence: Synthetic coding sequence
atgggcggcctgaccgccagcgacgtgcaccccaccctgggcgtgcagctgttcagcgccggcatcgccgcctgcctggccgacgtgatcaccttccccctggacaccgccaaggtgagactgcaggtgcagggcgagtgccccaccagcagcgtgatcagatacaagggcgtgctgggcaccatcaccgccgtggtgaagaccgagggcagaatgaagctgtacagcggcctgcccgccggcctgcagagacagatcagcagcgccagcctgagaatcggcctgtacgacaccgtgcaggagttcctgaccgccggcaaggagaccgcccccagcctgggcagcaagatcctggccggcctgaccaccggcggcgtggccgtgttcatcggccagcccaccgaggtggtgaaggtgagactgcaggcccagagccacctgcacggcatcaagcccagatacaccggcacctacaacgcctacagaatcatcgccaccaccgagggcctgaccggcctgtggaagggcaccacccccaacctgatgagaagcgtgatcatcaactgcaccgagctggtgacctacgacctgatgaaggaggccttcgtgaagaacaacatcctggccgacgacgtgccctgccacctggtgagcgccctgatcgccggcttctgcgccaccgccatgagcagccccgtggacgtggtgaagaccagattcatcaacagcccccccggccagtacaagagcgtgcccaactgcgccatgaaggtgttcaccaacgagggccccaccgccttcttcaagggcctggtgcccagcttcctgagactgggcagctggaacgtgatcatgttcgtgtgcttcgagcagctgaagagagagctgagcaagagcagacagaccatggactgcgccacctag

SEQ ID NO: 104701 - DNA, 930 bp, Artificial Sequence
  Description of Artificial Sequence: Synthetic coding sequence
atggtgggcttcaaggccaccgacgtgccccccaccgccaccgtgaagttcctgggcgccggcaccgccgcctgcatcgccgacctgatcaccttccccctggacaccgccaaggtgagactgcagatccagggcgagagccagggccccgtgagagccaccgccagcgcccagtacagaggcgtgatgggcaccatcctgaccatggtgagaaccgagggccccagaagcctgtacaacggcctggtggccggcctgcagagacagatgagcttcgccagcgtgagaatcggcctgtacgacagcgtgaagcagttctacaccaagggcagcgagcacgccagcatcggcagcagactgctggccggcagcaccaccggcgccctggccgtggccgtggcccagcccaccgacgtggtgaaggtgagattccaggcccaggccagagccggcggcggcagaagataccagagcaccgtgaacgcctacaagaccatcgccagagaggagggcttcagaggcctgtggaagggcaccagccccaacgtggccagaaacgccatcgtgaactgcgccgagctggtgacctacgacctgatcaaggacgccctgctgaaggccaacctgatgaccgacgacctgccctgccacttcaccagcgccttcggcgccggcttctgcaccaccgtgatcgccagccccgtggacgtggtgaagaccagatacatgaacagcgccctgggccagtacagcagcgccggccactgcgccctgaccatgctgcagaaggagggccccagagccttctacaagggcttcatgcccagcttcctgagactgggcagctggaacgtggtgatgttcgtgacctacgagcagctgaagagagccctgatggccgcctgcaccagcagagaggcccccttctag

SEQ ID NO: 104702 - DNA, 102 bp, Artificial Sequence
  Description of Artificial Sequence: Synthetic coding sequence
atggtgggcttcaaggccaccgacgtgccccccaccgccaccgtgaagttcctgggcgccggcaccgccgcctgcatcgccgacctgatcaccttcccctag

SEQ ID NO: 104703 - DNA, 939 bp, Artificial Sequence
  Description of Artificial Sequence: Synthetic coding sequence
atggtgggcctgaagcccagcgacgtgccccccaccatggccgtgaagttcctgggcgccggcaccgccgcctgcttcgccgacctggtgaccttccccctggacaccgccaaggtgagactgcagatccagggcgagaaccaggccgtgcagaccgccagactggtgcagtacagaggcgtgctgggcaccatcctgaccatggtgagaaccgagggcccctgcagcccctacaacggcctggtggccggcctgcagagacagatgagcttcgccagcatcagaatcggcctgtacgacagcgtgaagcaggtgtacacccccaagggcgccgacaacagcagcctgaccaccagaatcctggccggctgcaccaccggcgccatggccgtgacctgcgcccagcccaccgacgtggtgaaggtgagattccaggccagcatccacctgggccccagcagaagcgacagaaagtacagcggcaccatggacgcctacagaaccatcgccagagaggagggcgtgagaggcctgtggaagggcaccctgcccaacatcatgagaaacgccatcgtgaactgcgccgaggtggtgacctacgacatcctgaaggagaagctgctggactaccacctgctgaccgacaacttcccctgccacttcgtgagcgccttcggcgccggcttctgcgccaccgtggtggccagccccgtggacgtggtgaagaccagatacatgaacagcccccccggccagtacttcagccccctggactgcatgatcaagatggtggcccaggagggccccaccgccttctacaagggcttcacccccagcttcctgagactgggcagctggaacgtggtgatgttcgtgacctacgagcagctgaagagagccctgatgaaggtgcagatgctgagagagagccccttctag

SEQ ID NO: 104704 - DNA, 633 bp, Artificial Sequence
  Description of Artificial Sequence: Synthetic coding sequence
atggtgggcctgaagcccagcgacgtgccccccaccatggccgtgaagttcctgggcgccggcaccgccgcctgcttcgccgacctggtgaccttccccctggacaccgccaaggtgagactgcagatccagggcgagaaccaggccgtgcagaccgccagactggtgcagtacagaggcgtgctgggcaccatcctgaccatggtgagaaccgagggcccctgcagcccctacaacggcctggtggccggcctgcagagacagatgagcttcgccagcatcagaatcggcctgtacgacagcgtgaagcaggtgtacacccccaagggcgccgacaacaacttcccctgccacttcgtgagcgccttcggcgccggcttctgcgccaccgtggtggccagccccgtggacgtggtgaagaccagatacatgaacagcccccccggccagtacttcagccccctggactgcatgatcaagatggtggcccaggagggccccaccgccttctacaagggcttcacccccagcttcctgagactgggcagctggaacgtggtgatgttcgtgacctacgagcagctgaagagagccctgatgaaggtgcagatgctgagagagagccccttctag

SEQ ID NO: 104705 - DNA, 828 bp, Artificial Sequence
  Description of Artificial Sequence: Synthetic coding sequence
atggtgggcctgaagcccagcgacgtgccccccaccatggccgtgaagttcctgggcgccggcaccgccgcctgcttcgccgacctggtgaccttccccctggacaccgccaaggtgagactgcagatccagggcgagaaccaggccgtgcagaccgccagactggtgcagtacagaggcgtgctgggcaccatcctgaccatggtgagaaccgagggcccctgcagcccctacaacggcctggtggccggcctgcagagacagatgagcttcgccagcatcagaatcggcctgtacgacagcgtgaagcaggtgtacacccccaagggcgccgacaacagcagcctgaccaccagaatcctggccggctgcaccaccggcgccatggccgtgacctgcgcccagcccaccgacgtggtgaaggtgagattccaggccagcatccacctgggccccagcagaagcgacagaaagtacagcggcaccatggacgcctacagaaccatcgccagagaggagggcgtgagaggcctgtggaagggcaccctgcccaacatcatgagaaacgccatcgtgaactgcgccgaggtggtgacctacgacatcctgaaggagaagctgctggactaccacctgctgaccgacaacttcccctgccacttcgtgagcgccttcggcgccggcttctgcgccaccgtggtggccagccccgtggacgtggtgaagaccagatacatgaacagcccccccggccagtacttcagccccctggactgcatgatcaagatggtggcccaggagggccccaccgccttctacaagggctag

SEQ ID NO: 104706 - DNA, 291 bp, Artificial Sequence
  Description of Artificial Sequence: Synthetic coding sequence
atggtgggcctgaagcccagcgacgtgccccccaccatggccgtgaagttcctgggcgccggcaccgccgcctgcttcgccgacctggtgaccttccccctggacaccgccaaggtgagactgcagatccagggcgagaaccaggccgtgcagaccgccagactggtgcagtacagaggcgtgctgggcaccatcctgaccatggtgagaaccgagggcccctgcagcccctacaacggcctggtggccggcctgcagagacagatgagcttcgccagcatcagaatctag

SEQ ID NO: 104707 - DNA, 1026 bp, Artificial Sequence
  Description of Artificial Sequence: Synthetic coding sequence
atgctgctgagacccagaagacccccccccctggccccccccgccccccccagccccgccagccccgaccccgagcccagaacccccggcgacgcccccggcaccccccccagaagacccgccagccccagcgccctgggcgagctgggcctgcccgtgagccccggcagcgcccagagaaccccctggagcgccagagagaccgagctgctgctgggcaccctgctgcagcccgccgtgtggagagccctgctgctggacagaagacaggccctgcccacctacagaagagtgagcgccgccctggcccagcagcaggtgagaagaacccccgcccagtgcagaagaagatacaagttcctgaaggacaagttcagagaggcccacggccagccccccggccccttcgacgagcagatcagaaagctgatgggcctgctgggcgacaacggcagaaagagacccagaagaagaagccccggcagcggcagaccccagagagccagaagacccgtgcccaacgcccacgcccccgcccccagcgagcccgacgccacccccctgcccaccgccagagacagagacgccgaccccacctggaccctgagattcagccccagcccccccaagagcgccgacgccagccccgcccccggcagcccccccgcccccgcccccaccgccctggccacctgcatccccgaggacagagcccccgtgagaggccccggcagccccccccccccccccgccagagaggaccccgacagcccccccggcagacccgaggactgcgcccccccccccgccgccccccccagcctgaacaccgccctgctgcagaccctgggccacctgggcgacatcgccaacatcctgggccccctgagagaccagctgctgaccctgaaccagcacgtggagcagctgagaggcgccttcgaccagaccgtgagcctggccgtgggcttcatcctgggcagcgccgccgccgagagaggcgtgctgagagacccctgccagtag

SEQ ID NO: 104708 - DNA, 3357 bp, Artificial Sequence
  Description of Artificial Sequence: Synthetic coding sequence
atgagcgtggaggcctacggccccagcagccagaccctgaccttcctggacaccgaggaggccgagctgctgggcgccgacacccagggcagcgagttcgagttcaccgacttcaccctgcccagccagacccagaccccccccggcggccccggcggccccggcggcggcggcgccggcggccccggcggcgccggcgccggcgccgccgccggccagctggacgcccaggtgggccccgagggcatcctgcagaacggcgccgtggacgacagcgtggccaagaccagccagctgctggccgagctgaacttcgaggaggacgaggaggacacctactacaccaaggacctgcccatccacgcctgcagctactgcggcatccacgaccccgcctgcgtggtgtactgcaacaccagcaagaagtggttctgcaacggcagaggcaacaccagcggcagccacatcgtgaaccacctggtgagagccaagtgcaaggaggtgaccctgcacaaggacggccccctgggcgagaccgtgctggagtgctacaactgcggctgcagaaacgtgttcctgctgggcttcatccccgccaaggccgacagcgtggtggtgctgctgtgcagacagccctgcgccagccagagcagcctgaaggacatcaactgggacagcagccagtggcagcccctgatccaggacagatgcttcctgagctggctggtgaagatccccagcgagcaggagcagctgagagccagacagatcaccgcccagcagatcaacaagctggaggagctgtggaaggagaaccccagcgccaccctggaggacctggagaagcccggcgtggacgaggagccccagcacgtgctgctgagatacgaggacgcctaccagtaccagaacatcttcggccccctggtgaagctggaggccgactacgacaagaagctgaaggagagccagacccaggacaacatcaccgtgagatgggacctgggcctgaacaagaagagaatcgcctacttcaccctgcccaagaccgacagcgacatgagactgatgcagggcgacgagatctgcctgagatacaagggcgacctggcccccctgtggaagggcatcggccacgtgatcaaggtgcccgacaactacggcgacgagatcgccatcgagctgagaagcagcgtgggcgcccccgtggaggtgacccacaacttccaggtggacttcgtgtggaagagcaccagcttcgacagaatgcagagcgccctgaagaccttcgccgtggacgagaccagcgtgagcggctacatctaccacaagctgctgggccacgaggtggaggacgtgatcatcaagtgccagctgcccaagagattcaccgcccagggcctgcccgacctgaaccacagccaggtgtacgccgtgaagaccgtgctgcagagacccctgagcctgatccagggcccccccggcaccggcaagaccgtgaccagcgccaccatcgtgtaccacctggccagacagggcaacggccccgtgctggtgtgcgcccccagcaacatcgccgtggaccagctgaccgagaagatccaccagaccggcctgaaggtggtgagactgtgcgccaagagcagagaggccatcgacagccccgtgagcttcctggccctgcacaaccagatcagaaacatggacagcatgcccgagctgcagaagctgcagcagctgaaggacgagaccggcgagctgagcagcgccgacgagaagagatacagagccctgaagagaaccgccgagagagagctgctgatgaacgccgacgtgatctgctgcacctgcgtgggcgccggcgaccccagactggccaagatgcagttcagaagcatcctgatcgacgagagcacccaggccaccgagcccgagtgcatggtgcccgtggtgctgggcgccaagcagctgatcctggtgggcgaccactgccagctgggccccgtggtgatgtgcaagaaggccgccaaggccggcctgagccagagcctgttcgagagactggtggtgctgggcatcagacccatcagactgcaggtgcagtacagaatgcaccccgccctgagcgccttccccagcaacatcttctacgagggcagcctgcagaacggcgtgaccgccgccgacagagtgaagaagggcttcgacttccagtggccccagcccgacaagcccatgttcttctacgtgacccagggccaggaggagatcgccagcagcggcaccagctacctgaacagaaccgaggccgccaacgtggagaagatcaccaccaagctgctgaaggccggcgccaagcccgaccagatcggcatcatcaccccctacgagggccagagaagctacctggtgcagtacatgcagttcagcggcagcctgcacaccaagctgtaccaggaggtggagatcgccagcgtggacgccttccagggcagagagaaggacttcatcatcctgagctgcgtgagagccaacgagcaccagggcatcggcttcctgaacgaccccagaagactgaacgtggccctgaccagagccagatacggcgtgatcatcgtgggcaaccccaaggccctgagcaagcagcccctgtggaaccacctgctgaactactacaaggagcagaaggtgctggtggagggccccctgaacaacctgagagagagcctgatgcagttcagcaagcccagaaagctggtgaacaccatcaaccccggcgccagattcatgaccaccgccatgtacgacgccagagaggccatcatccccggcagcgtgtacgacagaagcagccagggcagacccagcagcatgtacttccagacccacgaccagatcggcatgatcagcgccggccccagccacgtggccgccatgaacatccccatccccttcaacctggtgatgccccccatgcccccccccggctacttcggccaggccaacggccccgccgccggcagaggcacccccaagggcaagaccggcagaggcggcagacagaagaacagattcggcctgcccggccccagccagaccaacctgcccaacagccaggccagccaggacgtggccagccagcccttcagccagggcgccctgacccagggctacatcagcatgagccagcccagccagatgagccagcccggcctgagccagcccgagctgagccaggacagctacctgggcgacgagttcaagagccagatcgacgtggccctgagccaggacagcacctaccagggcgagagagcctaccagcacggcggcgtgaccggcctgagccagtactag

SEQ ID NO: 104709 - DNA, 1740 bp, Artificial Sequence
  Description of Artificial Sequence: Synthetic coding sequence
atgcccgccgagagaaagaagcccgccagcatggaggagaaggacagcctgcccaacaacaaggagaaggactgcagcgagagaagaaccgtgagcagcaaggagagacccaaggacgacatcaagctgaccgccaagaaggaggtgagcaaggcccccgaggagagcaagaagaaggaggaggaggagaagaagaagcaccaggaggaggagagaaagaagcaggaggagcaggccaagagacagcaggaggaggaggccgccgcccagatgaaggagaaggaggagagcatccagctgcaccaggaggcctgggagagacaccacctgagaaaggagctgagaagcaagaaccagaacgcccccgacagcagacccgaggagaacttcttcagcagactggacagcagcctgaagaagaacaccgccttcgtgaagaagctgaagaccatcaccgagcagcagagagacagcctgagccacgacttcaacggcctgaacctgagcaagtacatcgccgaggccgtggccagcatcgtggaggccaagctgaagatcagcgacgtgaactgcgccgtgcacctgtgcagcctgttccaccagagatacgccgacttcgcccccagcctgctgcaggtgtggaagaagcacttcgaggccagaaaggaggagaagacccccaacatcaccaagctgagaaccgacctgagattcatcgccgagctgaccatcgtgggcatcttcaccgacaaggagggcctgagcctgatctacgagcagctgaagaacatcatcaacgccgacagagagagccacacccacgtgagcgtggtgatcagcttctgcagacactgcggcgacgacatcgccggcctggtgcccagaaaggtgaagagcgccgccgagaagttcaacctgagcttcccccccagcgagatcatcagccccgagaagcagcagcccttccagaacctgctgaaggagtacttcaccagcctgaccaagcacctgaagagagaccacagagagctgcagaacaccgagagacagaacagaagaatcctgcacagcaagggcgagctgagcgaggacagacacaagcagtacgaggagttcgccatgagctaccagaagctgctggccaacagccagagcctggccgacctgctggacgagaacatgcccgacctgccccaggacaagcccacccccgaggagcacggccccggcatcgacatcttcacccccggcaagcccggcgagtacgacctggagggcggcatctgggaggacgaggacgccagaaacttctacgagaacctgatcgacctgaaggccttcgtgcccgccatcctgttcaaggacaacgagaagagctgccagaacaaggagagcaacaaggacgacaccaaggaggccaaggagagcaaggagaacaaggaggtgagcagccccgacgacctggagctggagctggagaacctggagatcaacgacgacaccctggagctggagggcggcgacgaggccgaggacctgaccaagaagctgctggacgagcaggagcaggaggacgaggaggccagcaccggcagccacctgaagctgatcgtggacgccttcctgcagcagctgcccaactgcgtgaacagagacctgatcgacaaggccgagaaggccttctgcaacggcaacctggccagagtgaacctgctgctgagaatggccgtgaagaagtag

SEQ ID NO: 104710 - DNA, 3819 bp, Artificial Sequence
  Description of Artificial Sequence: Synthetic coding sequence
atgcccgccgagagaaagaagcccgccagcatggaggagaaggacagcctgcccaacaacaaggagaaggactgcagcgagagaagaaccgtgagcagcaaggagagacccaaggacgacatcaagctgaccgccaagaaggaggtgagcaaggcccccgaggacaagaagaagagactggaggacgacaagagaaagaaggaggacaaggagagaaagaagaaggacgaggagaaggtgaaggccgaggaggagagcaagaagaaggaggaggaggagaagaagaagcaccaggaggaggagagaaagaagcaggaggagcaggccaagagacagcaggaggaggaggccgccgcccagatgaaggagaaggaggagagcatccagctgcaccaggaggcctgggagagacaccacctgagaaaggagctgagaagcaagaaccagaacgcccccgacagcagacccgaggagaacttcttcagcagactggacagcagcctgaagaagaacaccgccttcgtgaagaagctgaagaccatcaccgagcagcagagagacagcctgagccacgacttcaacggcctgaacctgagcaagtacatcgccgaggccgtggccagcatcgtggaggccaagctgaagatcagcgacgtgaactgcgccgtgcacctgtgcagcctgttccaccagagatacgccgacttcgcccccagcctgctgcaggtgtggaagaagcacttcgaggccagaaaggaggagaagacccccaacatcaccaagctgagaaccgacctgagattcatcgccgagctgaccatcgtgggcatcttcaccgacaaggagggcctgagcctgatctacgagcagctgaagaacatcatcaacgccgacagagagagccacacccacgtgagcgtggtgatcagcttctgcagacactgcggcgacgacatcgccggcctggtgcccagaaaggtgaagagcgccgccgagaagttcaacctgagcttcccccccagcgagatcatcagccccgagaagcagcagcccttccagaacctgctgaaggagtacttcaccagcctgaccaagcacctgaagagagaccacagagagctgcagaacaccgagagacagaacagaagaatcctgcacagcaagggcgagctgagcgaggacagacacaagcagtacgaggagttcgccatgagctaccagaagctgctggccaacagccagagcctggccgacctgctggacgagaacatgcccgacctgccccaggacaagcccacccccgaggagcacggccccggcatcgacatcttcacccccggcaagcccggcgagtacgacctggagggcggcatctgggaggacgaggacgccagaaacttctacgagaacctgatcgacctgaaggccttcgtgcccgccatcctgttcaaggacaacgagaagagctgccagaacaaggagagcaacaaggacgacaccaaggaggccaaggagagcaaggagaacaaggaggtgagcagccccgacgacctggagctggagctggagaacctggagatcaacgacgacaccctggagctggagggcggcgacgaggccgaggacctgaccaagaagctgctggacgagcaggagcaggaggacgaggaggccagcaccggcagccacctgaagctgatcgtggacgccttcctgcagcagctgcccaactgcgtgaacagagacctgatcgacaaggccgccatggacttctgcatgaacatgaacaccaaggccaacagaaagaagctggtgagagccctgttcatcgtgcccagacagagactggacctgctgcccttctacgccagactggtggccaccctgcacccctgcatgagcgacgtggccgaggacctgtgcagcatgctgagaggcgacttcagattccacgtgagaaagaaggaccagatcaacatcgagaccaagaacaagaccgtgagattcatcggcgagctgaccaagttcaagatgttcaccaagaacgacaccctgcactgcctgaagatgctgctgagcgacttcagccaccaccacatcgagatggcctgcaccctgctggagacctgcggcagattcctgttcagaagccccgagagccacctgagaaccagcgtgctgctggagcagatgatgagaaagaagcaggccatgcacctggacgccagatacgtgaccatggtggagaacgcctactactactgcaaccccccccccgccgagaagaccgtgaagaagaagagaccccccctgcaggagtacgtgagaaagctgctgtacaaggacctgagcaaggtgaccaccgagaaggtgctgagacagatgagaaagctgccctggcaggaccaggaggtgaaggactacgtgatctgctgcatgatcaacatctggaacgtgaagtacaacagcatccactgcgtggccaacctgctggccggcctggtgctgtaccaggaggacgtgggcatccacgtggtggacggcgtgctggaggacatcagactgggcatggaggtgaaccagcccaagttcaaccagagaagaatcagcagcgccaagttcctgggcgagctgtacaactacagaatggtggagagcgccgtgatcttcagaaccctgtacagcttcaccagcttcggcgtgaaccccgacggcagccccagcagcctggacccccccgagcacctgttcagaatcagactggtgtgcaccatcctggacacctgcggccagtacttcgacagaggcagcagcaagagaaagctggactgcttcctggtgtacttccagagatacgtgtggtggaagaagagcctggaggtgtggaccaaggaccaccccttccccatcgacatcgactacatgatcagcgacaccctggagctgctgagacccaagatcaagctgtgcaacagcctggaggagagcatcagacaggtgcaggacctggagagagagttcctgatcaagctgggcctggtgaacgacaaggacagcaaggacagcatgaccgagggcgagaacctggaggaggacgaggaggaggaggagggcggcgccgagaccgaggagcagagcggcaacgagagcgaggtgaacgagcccgaggaggaggagggcagcgacaacgacgacgacgagggcgaggaggaggaggaggagaacaccgactacctgaccgacagcaacaaggagaacgagaccgacgaggagaacaccgaggtgatgatcaagggcggcggcctgaagcacgtgccctgcgtggaggacgaggacttcatccaggccctggacaagatgatgctggagaacctgcagcagagaagcggcgagagcgtgaaggtgcaccagctggacgtggccatccccctgcacctgaagagccagctgagaaagggcccccccctgggcggcggcgagggcgaggccgagagcgccgacaccatgcccttcgtgatgctgaccagaaagggcaacaagcagcagttcaagatcctgaacgtgcccatgagcagccagctggccgccaaccactggaaccagcagcaggccgagcaggaggagagaatgagaatgaagaagctgaccctggacatcaacgagagacaggagcaggaggactaccaggagatgctgcagagcctggcccagagacccgcccccgccaacaccaacagagagagaagacccagataccagcaccccaagggcgcccccaacgccgacctgatcttcaagaccggcggcagaagaagatag

SEQ ID NO: 104711 - DNA, 3819 bp, Artificial Sequence; identical to SEQ ID NO: 104710
  Description of Artificial Sequence: Synthetic coding sequence

SEQ ID NO: 104712 - DNA, 375 bp, Artificial Sequence
  Description of Artificial Sequence: Synthetic coding sequence
atgatcaagggcggcggcctgaagcacgtgccctgcgtggaggacgaggacttcatccaggccctggacaagatgatgctggagaacctgcagcagagaagcggcgagagcgtgaaggtgcaccagctggacgtggccatccccctgcacctgaagagccagctgagaaagggcccccccctgggcggcggcgagggcgaggccgagagcgccgacaccatgcccttcgtgatgctgaccagaaagggcaacaagcagcagttcaagatcctgaacgtgcccatgagcagccagctggccgccaaccactggaaccagcagcaggccgagagaagagaggacgagaacgagaaggcccacaccagataccagtag

SEQ ID NO: 104713 - DNA, 1740 bp, Artificial Sequence; identical to SEQ ID NO: 104709
  Description of Artificial Sequence: Synthetic coding sequence

SEQ ID NO: 104714 - DNA, 3819 bp, Artificial Sequence; identical to SEQ ID NO: 104710
  Description of Artificial Sequence: Synthetic coding sequence

SEQ ID NO: 104715 - DNA, 1332 bp, Artificial Sequence
  Description of Artificial Sequence: Synthetic coding sequence
atgagaagcgagaaggagggcgccggcggcctgagagccgccgtggccgccagaggccccagcggcagagagaagctgagcgccctggaggtgcagttccacagagacagccagcagcaggaggccgagaccccccccaccagcagcagcggctgcggcggcggcgccggcaagcccagagaggagaagagaaccgccctgagcaaggtggtgatcagaagactgccccccggcctgaccaaggagcagctggaggagcagctgagacccctgcccgcccacgactacttcgagttcttcgccgccgacctgagcctgtacccccacctgtacagcagagcctacatcaacttcagaaaccccgacgacatcctgctgttcagagacagattcgacggctacatcttcctggacagcaaggaccccgagtacaagaagttcctggagacctactgcgtggaggaggagaagaccagcgccaaccccgagaccctgctgggcgagatggaggccaagaccagagagctgatcgccagaagaaccacccccctgctggagtacatcaagaacagaaagctggagaagcagagaatcagagaggagaagagagaggagagaagaagaagagagctggagaagaagagactgagagaggaggagaagagaagaagaagagaggaggagagatgcaagaagaaggagaccgacaagcagaagaagatcgccgagaaggaggtgagaatcaagctgctgaagaagcccgagaagggcgaggagcccaccaccgagaagcccaaggagagaggcgaggagatcgacaccggcggcggcaagcaggagagctgcgcccccggcgccgtggtgaaggccagacccatggagggcagcctggaggagccccaggagaccagccacagcggcagcgacaaggagcacagagacgtggagagaagccaggagcaggagagcgaggcccagagataccacgtggacgacggcagaagacacagagcccaccacgagcccgagagactgagcagaagaagcgaggacgagcagagatggggcaagggccccggccaggacagaggcaagaagggcagccaggacagcggcgcccccggcgaggccatggagagactgggcagagcccagagatgcgacgacagccccgcccccagaaaggagagactggccaacaaggacagacccgccctgcagctgtacgaccccggcgccagattcagagccagagagtgcggcggcaacagaagaatctgcaaggccgagggcagcggcaccggccccgagaagagagaggaggccgagtag

SEQ ID NO: 104716 - DNA, 1431 bp, Artificial Sequence
  Description of Artificial Sequence: Synthetic coding sequence
atgagaagcgagaaggagggcgccggcggcctgagagccgccgtggccgccagaggccccagcggcagagagaagctgagcgccctggaggtgcagttccacagagacagccagcagcaggaggccgagaccccccccaccagcagcagcggctgcggcggcggcgccggcaagcccagagaggagaagagaaccgccctgagcaaggtggtgatcagaagactgccccccggcctgaccaaggagcagctggaggagcagctgagacccctgcccgcccacgactacttcgagttcttcgccgccgacctgagcctgtacccccacctgtacagcagagcctacatcaacttcagaaaccccgacgacatcctgctgttcagagacagattcgacggctacatcttcctggacagcaagggcctggagtaccccgccgtggtggagttcgcccccttccagaagatcgccaagaagaagctgagaaagaaggacgccaagaccggcagcatcgaggacgaccccgagtacaagaagttcctggagacctactgcgtggaggaggagaagaccagcgccaaccccgagaccctgctgggcgagatggaggccaagaccagagagctgatcgccagaagaaccacccccctgctggagtacatcaagaacagaaagctggagaagcagagaatcagagaggagaagagagaggagagaagaagaagagagctggagaagaagagactgagagaggaggagaagagaagaagaagagaggaggagagatgcaagaagaaggagaccgacaagcagaagaagatcgccgagaaggaggtgagaatcaagctgctgaagaagcccgagaagggcgaggagcccaccaccgagaagcccaaggagagaggcgaggagatcgacaccggcggcggcaagcaggagagctgcgcccccggcgccgtggtgaaggccagacccatggagggcagcctggaggagccccaggagaccagccacagcggcagcgacaaggagcacagagacgtggagagaagccaggagcaggagagcgaggcccagagataccacgtggacgacggcagaagacacagagcccaccacgagcccgagagactgagcagaagaagcgaggacgagcagagatggggcaagggccccggccaggacagaggcaagaagggcagccaggacagcggcgcccccggcgaggccatggagagactgggcagagcccagagatgcgacgacagccccgcccccagaaaggagagactggccaacaaggacagacccgccctgcagctgtacgaccccggcgccagattcagagccagagagtgcggcggcaacagaagaatctgcaaggccgagggcagcggcaccggccccgagaagagagaggaggccgagtag

SEQ ID NO: 104717 - DNA, 627 bp, Artificial Sequence
  Description of Artificial Sequence: Synthetic coding sequence
atggaggccaagaccagagagctgatcgccagaagaaccacccccctgctggagtacatcaagaacagaaagctggagaagcagagaatcagagaggagaagagagaggagagaagaagaagagagctggagaagaagagactgagagaggaggagaagagaagaagaagagaggaggagagatgcaagaagaaggagaccgacaagcagaagaagatcgccgagaaggaggtgagaatcaagctgctgaagaagcccgagaagggcgaggagcccaccaccgagaagcccaaggagagaggcgaggagatcgacaccggcggcggcaagcaggagagctgcgcccccggcgccgtggtgaaggccagacccatggagggcagcctggaggagccccaggagaccagccacagcggcagcgacaaggagcacagagacgtggagagaagccaggagcaggagagcgaggcccccagaaaggagagactggccaacaaggacagacccgccctgcagctgtacgaccccggcgccagattcagagccagagagtgcggcggcaacagaagaatctgcaaggccgagggcagcggcaccggccccgagaagagagaggaggccgagtag

SEQ ID NO: 104718 - DNA, 1452 bp, Artificial Sequence
  Description of Artificial Sequence: Synthetic coding sequence
atgaaggaggagaaggagcacagacccaaggagaagagagtgaccctgctgacccccgccggcgccaccggcagcggcggcggcaccagcggcgacagcagcaagggcgaggacaagcaggacagaaacaaggagaagaaggaggccctgagcaaggtggtgatcagaagactgccccccaccctgaccaaggagcagctgcaggagcacctgcagcccatgcccgagcacgactacttcgagttcttcagcaacgacaccagcctgtacccccacatgtacgccagagcctacatcaacttcaagaaccaggaggacatcatcctgttcagagacagattcgacggctacgtgttcctggacaacaagggccaggagtaccccgccatcgtggagttcgcccccttccagaaggccgccaagaagaagaccaagaagagagacaccaaggtgggcaccatcgacgacgaccccgagtacagaaagttcctggagagctacgccaccgacaacgagaagatgaccagcacccccgagaccctgctggaggagatcgaggccaagaacagagagctgatcgccaagaagaccacccccctgctgagcttcctgaagaacaagcagagaatgagagaggagaagagagaggagagaagaagaagagagatcgagagaaagagacagagagaggaggagagaagaaagtggaaggaggaggagaagagaaagagaaaggacatcgagaagctgaagaagatcgacagaatccccgagagagacaagctgaaggacgagcccaagatcaaggtgcacagattcctgctgcaggccgtgaaccagaagaacctgctgaagaagcccgagaagggcgacgagaaggagctggacaagagagagaaggccaagaagctggacaaggagaacctgagcgacgagagagccagcggccagagctgcaccctgcccaagagaagcgacagcgagctgaaggacgagaagcccaagagacccgaggacgagagcggcagagactacagagagagagagagagagtacgagagagaccaggagagaatcctgagagagagagagagactgaagagacaggaggaggagagaagaagacagaaggagagatacgagaaggagaagaccttcaagagaaaggaggaggagatgaagaaggagaaggacaccctgagagacaagggcaagaaggccgagagcaccgagagcatcggcagcagcgagaagaccgagaagaaggaggaggtggtgaagagagacagaatcagaaacaaggacagacccgccatgcagctgtaccagcccggcgccagaagcagaaacagactgtgcccccccgacgacagcaccaagagcggcgacagcgccgccgagagaaagcaggagagcggcatcagccacagaaaggagggcggcgaggagtag

SEQ ID NO: 104719 - DNA, 1413 bp, Artificial Sequence
  Description of Artificial Sequence: Synthetic coding sequence
atgaaggaggagaaggagcacagacccaaggagaagagagtgaccctgctgacccccgccggcgccaccggcagcggcggcggcaccagcggcgacagcagcaagggcgaggacaagcaggacagaaacaaggagaagaaggaggccctgagcaaggtggtgatcagaagactgccccccaccctgaccaaggagcagctgcaggagcacctgcagcccatgcccgagcacgactacttcgagttcttcagcaacgacaccagcctgtacccccacatgtacgccagagcctacatcaacttcaagaaccaggaggacatcatcctgttcagagacagattcgacggctacgtgttcctggacaacaagggccaggagtaccccgccatcgtggagttcgcccccttccagaaggccgccaagaagaagaccaagaagagagacaccaaggtgggcaccatcgacgacgaccccgagtacagaaagttcctggagagctacgccaccgacaacgagaagatgaccagcacccccgagaccctgctggaggagatcgaggccaagaacagagagctgatcgccaagaagaccacccccctgctgagcttcctgaagaacaagcagagaatgagagaggagaagagagaggagagaagaagaagagagatcgagagaaagagacagagagaggaggagagaagaaagtggaaggaggaggagaagagaaagagaaaggacatcgagaagctgaagaagatcgacagaatccccgagagagacaagctgaaggacgagcccaagatcaagctgctgaagaagcccgagaagggcgacgagaaggagctggacaagagagagaaggccaagaagctggacaaggagaacctgagcgacgagagagccagcggccagagctgcaccctgcccaagagaagcgacagcgagctgaaggacgagaagcccaagagacccgaggacgagagcggcagagactacagagagagagagagagagtacgagagagaccaggagagaatcctgagagagagagagagactgaagagacaggaggaggagagaagaagacagaaggagagatacgagaaggagaagaccttcaagagaaaggaggaggagatgaagaaggagaaggacaccctgagagacaagggcaagaaggccgagagcaccgagagcatcggcagcagcgagaagaccgagaagaaggaggaggtggtgaagagagacagaatcagaaacaaggacagacccgccatgcagctgtaccagcccggcgccagaagcagaaacagactgtgcccccccgacgacagcaccaagagcggcgacagcgccgccgagagaaagcaggagagcggcatcagccacagaaaggagggcggcgaggagtag

SEQ ID NO: 104720 - DNA, 657 bp, Artificial Sequence
  Description of Artificial Sequence: Synthetic coding sequence
atgaaggaggagaaggagcacagacccaaggagaagagagtgaccctgctgacccccgccggcgccaccggcagcggcggcggcaccagcggcgacagcagcaagggcgaggacaagcaggacagaaacaaggagaagaaggaggccctgagcaaggtggtgatcagaagactgccccccaccctgaccaaggagcagctgcaggagcacctgcagcccatgcccgagcacgactacttcgagttcttcagcaacgacaccagcctgtacccccacatgtacgccagagcctacatcaacttcaagaaccaggaggacatcatcctgttcagagacagattcgacggctacgtgttcctggacaacaagggccaggagtaccccgccatcgtggagttcgcccccttccagaaggccgccaagaagaagaccaagaagagagacaccaaggtgggcaccatcgacgacgaccccgagtacagaaagttcctggagagctacgccaccgacaacgagaagatgaccagcacccccgagaccctgctggaggagatcgaggccaagaacagagagctgatcgccaagaagaccacccccctgctgagcttcctgaagaacaagcagagaatgagagaggagaagagagaggacttctag

SEQ ID NO: 104721 - DNA, 441 bp, Artificial Sequence
  Description of Artificial Sequence: Synthetic coding sequence
atgatgtggcagaagtacgccggcagcagaagaagcatgcccctgggcgccagaatcctgttccacggcgtgttctacgccggcggcttcgccatcgtgtactacctgatccagaagttccacagcagagccctgtactacaagctggccgtggagcagctgcagagccaccccgaggcccaggaggccctgggcccccccctgaacatccactacctgaagctgatcgacagagagaacttcgtggacatcgtggacgccaagctgaagatccccgtgagcggcagcaagagcgagggcctgctgtacgtgcacagcagcagaggcggccccttccagagatggcacctggacgaggtgttcctggagctgaaggacggccagcagatccccgtgttcaagctgagcggcgagaacggcgacgaggtgaagaaggagtag

SEQ ID NO: 104722 - DNA, 2667 bp, Artificial Sequence
  Description of Artificial Sequence: Synthetic coding sequence
atggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggccgccgacatctacagcttcagcgagctgcccacccccgacacccccgtgaaccccctggacctgctgtgcgccctgctgctgagcagcgacagcttcctgcagcaggagatcgccctgaagatggccctgtgccagttcgccctgcccctggtgctgcccgacagcgagaaccactaccacaccttcctgctgtgggccatgagaggcatcgtgagaacctggtggagccagccccccagaggcatgggcagcttcagagaggacagcgtggtgctgagcagagcccccgccttcgccttcgtgagaatggacgtgagcagcaacagcaagagccagctgctgaacgccgtgctgagccccggccacagacagtgggactgcttctggcacagagacctgaacctgggcaccaacgccagagagatcagcgacggcctggtggagatcagctggttcttccccagcggcagagaggacctggacatcttccccgagcccgtggccttcctgaacctgagaggcgacatcggcagccactggctgcagttcaagctgctgaccgagatcagcagcgccgtgttcatcctgaccgacaacatcagcaagaaggagtacaagctgctgtacagcatgaaggagagcaccaccaagtactacttcatcctgagcccctacagaggcaagagaaacaccaacctgagattcctgaacaagctgatccccgtgctgaagatcgaccacagccacgtgctggtgaaggtgagcagcaccgacagcgacagcttcgtgaagagaatcagagccatcgtgggcaacgtgctgagagccccctgcagaagagtgagcgtggaggacatggcccacgccgccagaaagctgggcctgaaggtggacgaggactgcgaggagtgccagaaggccaaggacagaatggagagaatcaccagaaagatcaaggacagcgacgcctacagaagagacgagctgagactgcagggcgacccctggagaaaggccgcccaggtggagaaggagttctgccagctgcagtgggccgtggacccccccgagaagcacagagccgagctgagaagaagactgctggagctgagaatgcagcagaacggccacgaccccagcagcggcgtgcaggagttcatcagcggcatcagcagccccagcctgagcgagaagcagtacttcctgagatggatggagtggggcctggccagagtggcccagcccagactgagacagccccccgagaccctgctgaccctgagacccaagcacggcggcaccaccgacgtgggcgagcccctgtggcccgagcccctgggcgtggagcacttcctgagagagatgggccagttctacgaggccgagagctgcctggtggaggccggcagactgcccgccggccagagaagattcgcccacttccccggcctggccagcgagctgctgctgaccggcctgcccctggagctgatcgacggcagcaccctgagcatgcccgtgagatgggtgaccggcctgctgaaggagctgcacgtgagactggagagaagaagcagactggtggtgctgagcaccgtgggcgtgcccggcaccggcaagagcaccctgctgaacaccatgttcggcctgagattcgccaccggcaagagctgcggccccagaggcgccttcatgcagctgatcaccgtggccgagggcttcagccaggacctgggctgcgaccacatcctggtgatcgacagcggcggcctgatcggcggcgccctgaccagcgccggcgacagattcgagctggaggccagcctggccaccctgctgatgggcctgagcaacgtgaccgtgatcagcctggccgagaccaaggacatccccgccgccatcctgcacgccttcctgagactggagaagaccggccacatgcccaactaccagttcgtgtaccagaacctgcacgacgtgagcgtgcccggccccagacccagagacaagagacagctgctggacccccccggcgacctgagcagagccgccgcccagatggagaagcagggcgacggcttcagagccctggccggcctggccttctgcgaccccgagaagcagcacatctggcacatccccggcctgtggcacggcgccccccccatggccgccgtgagcctggcctacagcgaggccatcttcgagctgaagagatgcctgctggagaacatcagaaacggcctgagcaaccagaacaagaacatccagcagctgatcgagctggtgagaagactgtag

SEQ ID NO: 104723 - DNA, 2769 bp, Artificial Sequence
  Description of Artificial Sequence: Synthetic coding sequence
atggccagccccggccacagcgacctgggcgaggtggcccccgagatcaaggccagcgagagaagaaccgccgtggccatcgccgacctggagtggagagagatggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggccgccgacatctacagcttcagcgagctgcccacccccgacacccccgtgaaccccctggacctgctgtgcgccctgctgctgagcagcgacagcttcctgcagcaggagatcgccctgaagatggccctgtgccagttcgccctgcccctggtgctgcccgacagcgagaaccactaccacaccttcctgctgtgggccatgagaggcatcgtgagaacctggtggagccagccccccagaggcatgggcagcttcagagaggacagcgtggtgctgagcagagcccccgccttcgccttcgtgagaatggacgtgagcagcaacagcaagagccagctgctgaacgccgtgctgagccccggccacagacagtgggactgcttctggcacagagacctgaacctgggcaccaacgccagagagatcagcgacggcctggtggagatcagctggttcttccccagcggcagagaggacctggacatcttccccgagcccgtggccttcctgaacctgagaggcgacatcggcagccactggctgcagttcaagctgctgaccgagatcagcagcgccgtgttcatcctgaccgacaacatcagcaagaaggagtacaagctgctgtacagcatgaaggagagcaccaccaagtactacttcatcctgagcccctacagaggcaagagaaacaccaacctgagattcctgaacaagctgatccccgtgctgaagatcgaccacagccacgtgctggtgaaggtgagcagcaccgacagcgacagcttcgtgaagagaatcagagccatcgtgggcaacgtgctgagagccccctgcagaagagtgagcgtggaggacatggcccacgccgccagaaagctgggcctgaaggtggacgaggactgcgaggagtgccagaaggccaaggacagaatggagagaatcaccagaaagatcaaggacagcgacgcctacagaagagacgagctgagactgcagggcgacccctggagaaaggccgcccaggtggagaaggagttctgccagctgcagtgggccgtggacccccccgagaagcacagagccgagctgagaagaagactgctggagctgagaatgcagcagaacggccacgaccccagcagcggcgtgcaggagttcatcagcggcatcagcagccccagcctgagcgagaagcagtacttcctgagatggatggagtggggcctggccagagtggcccagcccagactgagacagccccccgagaccctgctgaccctgagacccaagcacggcggcaccaccgacgtgggcgagcccctgtggcccgagcccctgggcgtggagcacttcctgagagagatgggccagttctacgaggccgagagctgcctggtggaggccggcagactgcccgccggccagagaagattcgcccacttccccggcctggccagcgagctgctgctgaccggcctgcccctggagctgatcgacggcagcaccctgagcatgcccgtgagatgggtgaccggcctgctgaaggagctgcacgtgagactggagagaagaagcagactggtggtgctgagcaccgtgggcgtgcccggcaccggcaagagcaccctgctgaacaccatgttcggcctgagattcgccaccggcaagagctgcggccccagaggcgccttcatgcagctgatcaccgtggccgagggcttcagccaggacctgggctgcgaccacatcctggtgatcgacagcggcggcctgatcggcggcgccctgaccagcgccggcgacagattcgagctggaggccagcctggccaccctgctgatgggcctgagcaacgtgaccgtgatcagcctggccgagaccaaggacatccccgccgccatcctgcacgccttcctgagactggagaagaccggccacatgcccaactaccagttcgtgtaccagaacctgcacgacgtgagcgtgcccggccccagacccagagacaagagacagctgctggacccccccggcgacctgagcagagccgccgcccagatggagaagcagggcgacggcttcagagccctggccggcctggccttctgcgaccccgagaagcagcacatctggcacatccccggcctgtggcacggcgccccccccatggccgccgtgagcctggcctacagcgaggccatcttcgagctgaagagatgcctgctggagaacatcagaaacggcctgagcaaccagaacaagaacatccagcagctgatcgagctggtgagaagactgtag

SEQ ID NO: 104724 - DNA, 492 bp, Artificial Sequence
  Description of Artificial Sequence: Synthetic coding sequence
atggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggccgccgacatctacagcttcagcgagctgcccacccccgacacccccgtgaaccccctggacctgctgtgcgccctgctgctgagcagcgacagcttcctgcagcaggagatcgccctgaagatgtag

SEQ ID NO: 104725 - DNA, 2667 bp, Artificial Sequence; identical to SEQ ID NO: 104722
  Description of Artificial Sequence: Synthetic coding sequence

SEQ ID NO: 104726 - DNA, 2667 bp, Artificial Sequence; identical to SEQ ID NO: 104722
  Description of Artificial Sequence: Synthetic coding sequence

SEQ ID NO: 104727 - DNA, 2796 bp, Artificial Sequence
  Description of Artificial Sequence: Synthetic coding sequence
atggccagccccggcatcgaggtggagctgctgggcaagggccacagcgacctgggcgaggtggcccccgagatcaaggccagcgagagaagaaccgccgtggccatcgccgacctggagtggagagagatggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggccgccgacatctacagcttcagcgagctgcccacccccgacacccccgtgaaccccctggacctgctgtgcgccctgctgctgagcagcgacagcttcctgcagcaggagatcgccctgaagatggccctgtgccagttcgccctgcccctggtgctgcccgacagcgagaaccactaccacaccttcctgctgtgggccatgagaggcatcgtgagaacctggtggagccagccccccagaggcatgggcagcttcagagaggacagcgtggtgctgagcagagcccccgccttcgccttcgtgagaatggacgtgagcagcaacagcaagagccagctgctgaacgccgtgctgagccccggccacagacagtgggactgcttctggcacagagacctgaacctgggcaccaacgccagagagatcagcgacggcctggtggagatcagctggttcttccccagcggcagagaggacctggacatcttccccgagcccgtggccttcctgaacctgagaggcgacatcggcagccactggctgcagttcaagctgctgaccgagatcagcagcgccgtgttcatcctgaccgacaacatcagcaagaaggagtacaagctgctgtacagcatgaaggagagcaccaccaagtactacttcatcctgagcccctacagaggcaagagaaacaccaacctgagattcctgaacaagctgatccccgtgctgaagatcgaccacagccacgtgctggtgaaggtgagcagcaccgacagcgacagcttcgtgaagagaatcagagccatcgtgggcaacgtgctgagagccccctgcagaagagtgagcgtggaggacatggcccacgccgccagaaagctgggcctgaaggtggacgaggactgcgaggagtgccagaaggccaaggacagaatggagagaatcaccagaaagatcaaggacagcgacgcctacagaagagacgagctgagactgcagggcgacccctggagaaaggccgcccaggtggagaaggagttctgccagctgcagtgggccgtggacccccccgagaagcacagagccgagctgagaagaagactgctggagctgagaatgcagcagaacggccacgaccccagcagcggcgtgcaggagttcatcagcggcatcagcagccccagcctgagcgagaagcagtacttcctgagatggatggagtggggcctggccagagtggcccagcccagactgagacagccccccgagaccctgctgaccctgagacccaagcacggcggcaccaccgacgtgggcgagcccctgtggcccgagcccctgggcgtggagcacttcctgagagagatgggccagttctacgaggccgagagctgcctggtggaggccggcagactgcccgccggccagagaagattcgcccacttccccggcctggccagcgagctgctgctgaccggcctgcccctggagctgatcgacggcagcaccctgagcatgcccgtgagatgggtgaccggcctgctgaaggagctgcacgtgagactggagagaagaagcagactggtggtgctgagcaccgtgggcgtgcccggcaccggcaagagcaccctgctgaacaccatgttcggcctgagattcgccaccggcaagagctgcggccccagaggcgccttcatgcagctgatcaccgtggccgagggcttcagccaggacctgggctgcgaccacatcctggtgatcgacagcggcggcctgatcggcggcgccctgaccagcgccggcgacagattcgagctggaggccagcctggccaccctgctgatgggcctgagcaacgtgaccgtgatcagcctggccgagaccaaggacatccccgccgccatcctgcacgccttcctgagactggagaagaccggccacatgcccaactaccagttcgtgtaccagaacctgcacgacgtgagcgtgcccggccccagacccagagacaagagacagctgctggacccccccggcgacctgagcagagccgccgcccagatggagaagcagggcgacggcttcagagccctggccggcctggccttctgcgaccccgagaagcagcacatctggcacatccccggcctgtggcacggcgccccccccatggccgccgtgagcctggcctacagcgaggccatcttcgagctgaagagatgcctgctggagaacatcagaaacggcctgagcaaccagaacaagaacatccagcagctgatcgagctggtgagaagactgtag

SEQ ID NO: 104728 - DNA, 369 bp, Artificial Sequence
  Description of Artificial Sequence: Synthetic coding sequence
atggagggcgacgactgcgagttcagatacggcgacggcaccaacgaggcccaggacaacgacttccccaccgtggagagaagcagactgcaggagatgctgagcctgctgggcctggagacctaccaggtgcagaagctgagcctgcaggacagcctgcagatcagcttcgacagcatgaagaactgggccccccaggtgcccaaggacctgccctggaacttcctgagaaagctgcaggccctgaacgccgacgccagaaacaccaccatggtgctggacgtgctgcccgacgccagacccgtggagaaggagagccagatggaggaggagatcatctactgggaccccgccgacgacctggcctag

SEQ ID NO: 104729 - DNA, 1623 bp, Artificial Sequence
  Description of Artificial Sequence: Synthetic coding sequence
atggcctgggtgctgaagatggacgaggtgatcgagagcggcctggtgcacgacttcgacgccagcctgagcggcatcggccaggagctgggcgccggcgcctacagcatgagcgacgtgctggccctgcccatcttcaagcaggaggacagcagcctgcccctggacggcgagaccgagcacccccccttccagtacgtgatgtgcgccgccaccagccccgccgtgaagctgcacgacgagaccctgacctacctgaaccagggccagagctacgagatcagaatgctggacaacagaaagatgggcgacatgcccgagatcaacggcaagctggtgaagagcatcatcagagtggtgttccacgacagaagactgcagtacaccgagcaccagcagctggagggctggaagtggaacagacccggcgacagactgctggacctggacatccccatgagcgtgggcatcatcgacaccagaaccaaccccagccagctgaacgccgtggagttcctgtgggaccccgccaagagaaccagcgccttcatccaggtgcactgcatcagcaccgagttcacccccagaaagcacggcggcgagaagggcgtgcccttcagaatccaggtggacaccttcaagcagaacgagaacggcgagtacaccgaccacctgcacagcgccagctgccagatcaaggtgttcaagcccaagggcgccgacagaaagcagaagaccgacagagagaagatggagaagagaaccgcccacgagaaggagaagtaccagcccagctacgacaccaccatcctgaccgagatgagactggagcccatcatcgaggacgccgtggagcacgagcagaagaagagcagcaagagaaccctgcccgccgactacggcgacagcctggccaagagaggcagctgcagcccctggcccgacgcccccaccgcctacgtgaacaacagccccagccccgcccccaccttcaccagcccccagcagagcacctgcagcgtgcccgacagcaacagcagcagccccaaccaccagggcgacggcgccagccagaccagcggcgagcagatccagcccagcgccaccatccaggagacccagcagtggctgctgaagaacagattcagcagctacaccagactgttcagcaacttcagcggcgccgacctgctgaagctgaccaaggaggacctggtgcagatctgcggcgccgccgacggcatcagactgtacaacagcctgaagagcagaagcgtgagacccagactgaccatctacgtgtgcagagagcagcccagcagcaccgtgctgcagggccagcagcaggccgccagcagcgccagcgagaacggcagcggcgccccctacgtgtaccacgccatctacctggaggagatgatcgccagcgaggtggccagaaagctggccctggtgttcaacatccccctgcaccagatcaaccaggtgtacagacagggccccaccggcatccacatcctggtgagcgaccagatggtgcagaacttccaggacgagagctgcttcctgttcagcaccgtgaaggccgagagcagcgacggcatccacatcatcctgaagtag

SEQ ID NO: 104730 - DNA, 1623 bp, Artificial Sequence; identical to SEQ ID NO: 104729
  Description of Artificial Sequence: Synthetic coding sequence

SEQ ID NO: 104731 - DNA, 1515 bp, Artificial Sequence
  Description of Artificial Sequence: Synthetic coding sequence
atggcctgggtgctgaagatggacgaggtgatcgagagcggcctggtgcacgacttcgacgccagcctgagcggcatcggccaggagctgggcgccggcgcctacagcatgagcgacgtgctggccctgcccatcttcaagcaggaggacagcagcctgcccctggacggcgagaccgagcacccccccttccagtacgtgatgtgcgccgccaccagccccgccgtgaagctgcacgacgagaccctgacctacctgaaccagggccagagctacgagatcagaatgctggacaacagaaagatgggcgacatgcccgagatcaacggcaagctggtgaagagcatcatcagagtggtgttccacgacagaagactgcagtacaccgagcaccagcagctggagggctggaagtggaacagacccggcgacagactgctggacctggacatccccatgagcgtgggcatcatcgacaccagaaccaaccccagccagctgaacgccgtggagttcctgtgggaccccgccaagagaaccagcgccttcatccaggtgcactgcatcagcaccgagttcacccccagaaagcacggcggcgagaagggcgtgcccttcagaatccaggtggacaccttcaagcagaacgagaacggcgagtacaccgaccacctgcacagcgccagctgccagatcaaggtgttcaagcccaagggcgccgacagaaagcagaagaccgacagagagaagatggagaagagaaccgcccacgagaaggagaagtaccagcccagctacgacaccaccatcctgaccgagtgcagcccctggcccgacgcccccaccgcctacgtgaacaacagccccagccccgcccccaccttcaccagcccccagcagagcacctgcagcgtgcccgacagcaacagcagcagccccaaccaccagggcgacggcgccagccagaccagcggcgagcagatccagcccagcgccaccatccaggagacccagcagtggctgctgaagaacagattcagcagctacaccagactgttcagcaacttcagcggcgccgacctgctgaagctgaccaaggaggacctggtgcagatctgcggcgccgccgacggcatcagactgtacaacagcctgaagagcagaagcgtgagacccagactgaccatctacgtgtgcagagagcagcccagcagcaccgtgctgcagggccagcagcaggccgccagcagcgccagcgagaacggcagcggcgccccctacgtgtaccacgccatctacctggaggagatgatcgccagcgaggtggccagaaagctggccctggtgttcaacatccccctgcaccagatcaaccaggtgtacagacagggccccaccggcatccacatcctggtgagcgaccagatggtgcagaacttccaggacgagagctgcttcctgttcagcaccgtgaaggccgagagcagcgacggcatccacatcatcctgaagtag

SEQ ID NO: 104732 - DNA, 447 bp, Artificial Sequence
  Description of Artificial Sequence: Synthetic coding sequence
atggcctgggtgctgaagatggacgaggtgatcgagagcggcctggtgcacgacttcgacgccagcctgagcggcatcggccaggagctgggcgccggcgcctacagcatgagcgacgtgctggccctgcccatcttcaagcaggaggacagcagcctgcccctggacggcgagaccgagcacccccccttccagtacgtgatgtgcgccgccaccagccccgccgtgaagctgcacgacgagaccctgacctacctgaaccagggccagagctacgagatcagaatgctggacaacagaaagatgggcgacatgcccgagatcaacggcaagctggtgaagagcatcatcagagtggtgttccacgacagaagactgcagtacaccgagcaccagcagctggagggctggaagtggaacagacccggcgacagactgctggactag

SEQ ID NO: 104733 - DNA, 2295 bp, Artificial Sequence
  Description of Artificial Sequence: Synthetic coding sequence
atgaacggcgaggccgactgccccaccgacctggagatggccgcccccaagggccaggacagatggagccaggaggacatgctgaccctgctggagtgcatgaagaacaacctgcccagcaacgacagcagcaagttcaagaccaccgagagccacatggactgggagaaggtggccttcaaggacttcagcggcgacatgtgcaagctgaagtgggtggagatcagcaacgaggtgagaaagttcagaaccctgaccgagctgatcctggacgcccaggagcacgtgaagaacccctacaagggcaagaagctgaagaagcaccccgacttccccaagaagcccctgaccccctacttcagattcttcatggagaagagagccaagtacgccaagctgcaccccgagatgagcaacctggacctgaccaagatcctgagcaagaagtacaaggagctgcccgagaagaagaagatgaagtacatccaggacttccagagagagaagcaggagttcgagagaaacctggccagattcagagaggaccaccccgacctgatccagaacgccaagaagagcgacatccccgagaagcccaagaccccccagcagctgtggtacacccacgagaagaaggtgtacctgaaggtgagacccgacgccaccaccaaggaggtgaaggacagcctgggcaagcagtggagccagctgagcgacaagaagagactgaagtggatccacaaggccctggagcagagaaaggagtacgaggagatcatgagagactacatccagaagcaccccgagctgaacatcagcgaggagggcatcaccaagagcaccctgaccaaggccgagagacagctgaaggacaagttcgacggcagacccaccaagcccccccccaacagctacagcctgtactgcgccgagctgatggccaacatgaaggacgtgcccagcaccgagagaatggtgctgtgcagccagcagtggaagctgctgagccagaaggagaaggacgcctaccacaagaagtgcgaccagaagaagaaggactacgaggtggagctgctgagattcctggagagcctgcccgaggaggagcagcagagagtgctgggcgaggagaagatgctgaacatcaacaagaagcaggccaccagccccgccagcaagaagcccgcccaggagggcggcaagggcggcagcgagaagcccaagagacccgtgagcgccatgttcatcttcagcgaggagaagagaagacagctgcaggaggagagacccgagctgagcgagagcgagctgaccagactgctggccagaatgtggaacgacctgagcgagaagaagaaggccaagtacaaggccagagaggccgccctgaaggcccagagcgagagaaagcccggcggcgagagagaggagagaggcaagctgcccgagagccccaagagagccgaggagatctggcagcagagcgtgatcggcgactacctggccagattcaagaacgacagagtgaaggccctgaaggccatggagatgacctggaacaacatggagaagaaggagaagctgatgtggatcaagaaggccgccgaggaccagaagagatacgagagagagctgagcgagatgagagccccccccgccgccaccaacagcagcaagaagatgaagttccagggcgagcccaagaagccccccatgaacggctaccagaagttcagccaggagctgctgagcaacggcgagctgaaccacctgcccctgaaggagagaatggtggagatcggcagcagatggcagagaatcagccagagccagaaggagcactacaagaagctggccgaggagcagcagaagcagtacaaggtgcacctggacctgtgggtgaagagcctgagcccccaggacagagccgcctacaaggagtacatcagcaacaagagaaagagcatgaccaagctgagaggccccaaccccaagagcagcagaaccaccctgcagagcaagagcgagagcgaggaggacgacgaggaggacgaggacgacgaggacgaggacgaggaggaggaggacgacgagaacggcgacagcagcgaggacggcggcgacagcagcgagagcagcagcgaggacgagagcgaggacggcgacgagaacgaggaggacgacgaggacgaggacgacgacgaggacgacgacgaggacgaggacaacgagagcgagggcagcagcagcagcagcagcagcagcggcgacagcagcgacagcgacagcaactag

SEQ ID NO: 104734 - DNA, 2184 bp, Artificial Sequence
  Description of Artificial Sequence: Synthetic coding sequence
atgaacggcgaggccgactgccccaccgacctggagatggccgcccccaagggccaggacagatggagccaggaggacatgctgaccctgctggagtgcatgaagaacaacctgcccagcaacgacagcagcaagttcaagaccaccgagagccacatggactgggagaaggtggccttcaaggacttcagcggcgacatgtgcaagctgaagtgggtggagatcagcaacgaggtgagaaagttcagaaccctgaccgagctgatcctggacgcccaggagcacgtgaagaacccctacaagggcaagaagctgaagaagcaccccgacttccccaagaagcccctgaccccctacttcagattcttcatggagaagagagccaagtacgccaagctgcaccccgagatgagcaacctggacctgaccaagatcctgagcaagaagtacaaggagctgcccgagaagaagaagatgaagtacatccaggacttccagagagagaagcaggagttcgagagaaacctggccagattcagagaggaccaccccgacctgatccagaacgccaagaagagcgacatccccgagaagcccaagaccccccagcagctgtggtacacccacgagaagaaggtgtacctgaaggtgagacccgacgagatcatgagagactacatccagaagcaccccgagctgaacatcagcgaggagggcatcaccaagagcaccctgaccaaggccgagagacagctgaaggacaagttcgacggcagacccaccaagcccccccccaacagctacagcctgtactgcgccgagctgatggccaacatgaaggacgtgcccagcaccgagagaatggtgctgtgcagccagcagtggaagctgctgagccagaaggagaaggacgcctaccacaagaagtgcgaccagaagaagaaggactacgaggtggagctgctgagattcctggagagcctgcccgaggaggagcagcagagagtgctgggcgaggagaagatgctgaacatcaacaagaagcaggccaccagccccgccagcaagaagcccgcccaggagggcggcaagggcggcagcgagaagcccaagagacccgtgagcgccatgttcatcttcagcgaggagaagagaagacagctgcaggaggagagacccgagctgagcgagagcgagctgaccagactgctggccagaatgtggaacgacctgagcgagaagaagaaggccaagtacaaggccagagaggccgccctgaaggcccagagcgagagaaagcccggcggcgagagagaggagagaggcaagctgcccgagagccccaagagagccgaggagatctggcagcagagcgtgatcggcgactacctggccagattcaagaacgacagagtgaaggccctgaaggccatggagatgacctggaacaacatggagaagaaggagaagctgatgtggatcaagaaggccgccgaggaccagaagagatacgagagagagctgagcgagatgagagccccccccgccgccaccaacagcagcaagaagatgaagttccagggcgagcccaagaagccccccatgaacggctaccagaagttcagccaggagctgctgagcaacggcgagctgaaccacctgcccctgaaggagagaatggtggagatcggcagcagatggcagagaatcagccagagccagaaggagcactacaagaagctggccgaggagcagcagaagcagtacaaggtgcacctggacctgtgggtgaagagcctgagcccccaggacagagccgcctacaaggagtacatcagcaacaagagaaagagcatgaccaagctgagaggccccaaccccaagagcagcagaaccaccctgcagagcaagagcgagagcgaggaggacgacgaggaggacgaggacgacgaggacgaggacgaggaggaggaggacgacgagaacggcgacagcagcgaggacggcggcgacagcagcgagagcagcagcgaggacgagagcgaggacggcgacgagaacgaggaggacgacgaggacgaggacgacgacgaggacgacgacgaggacgaggacaacgagagcgagggcagcagcagcagcagcagcagcagcggcgacagcagcgacagcgacagcaactag

SEQ ID NO: 104735 - DNA, 2184 bp, Artificial Sequence; identical to SEQ ID NO: 104734
  Description of Artificial Sequence: Synthetic coding sequence

SEQ ID NO: 104736 - DNA, 2295 bp, Artificial Sequence; identical to SEQ ID NO: 104733
  Description of Artificial Sequence: Synthetic coding sequence

SEQ ID NO: 104737 - DNA, 2184 bp, Artificial Sequence; identical to SEQ ID NO: 104734
  Description of Artificial Sequence: Synthetic coding sequence

SEQ ID NO: 104738 - DNA, 2295 bp, Artificial Sequence; identical to SEQ ID NO: 104733
  Description of Artificial Sequence: Synthetic coding sequence

SEQ ID NO: 104739 - DNA, 2184 bp, Artificial Sequence; identical to SEQ ID NO: 104734
  Description of Artificial Sequence: Synthetic coding sequence

SEQ ID NO: 104740 - DNA, 849 bp, Artificial Sequence
  Description of Artificial Sequence: Synthetic coding sequence
atgaagggccagcagaagaccgccgagaccgaggagggcaccgtgcagatccaggagggcgccgtggccaccggcgaggaccccaccagcgtggccatcgccagcatccagagcgccgccaccttccccgaccccaacgtgaagtacgtgttcagaaccgagaacggcggccaggtgatgtacagagtgatccaggtgagcgagggccagctggacggccagaccgagggcaccggcgccatcagcggctaccccgccacccagagcatgacccaggccgtgatccagggcgccttcaccagcgacgacgccgtggacaccgagggcaccgccgccgagacccactacacctacttccccagcaccgccgtgggcgacggcgccggcggccagttcttcgtgatgatgagcccccaggaggtgctgcagggcggcagccagagaagcatcgcccccagaacccacccctacagccccaagagcgaggcccccagaaccaccagagacgagaagagaagagcccagcacaacgaggtggagagaagaagaagagacaagatcaacaactggatcgtgcagctgagcaagatcatccccgactgcagcatggagagcaccaagagcggccagagcaagggcggcatcctgagcaaggcctgcgactacatccaggagctgagacagagcaaccacagactgagcgaggagctgcagggcctggaccagctgcagctggacaacgacgtgctgagacagcaggtggaggacctgaagaacaagaacctgctgctgagagcccagctgagacaccacggcctggaggtggtgatcaagaacgacagcaactag

SEQ ID NO: 104741 - DNA, 933 bp, Artificial Sequence
  Description of Artificial Sequence: Synthetic coding sequence
atgaagggccagcagaagaccgccgagaccgaggagggcaccgtgcagatccaggagggcgccgtggccaccggcgaggaccccaccagcgtggccatcgccagcatccagagcgccgccaccttccccgaccccaacgtgaagtacgtgttcagaaccgagaacggcggccaggtgatgtacagagtgatccaggtgagcgagggccagctggacggccagaccgagggcaccggcgccatcagcggctaccccgccacccagagcatgacccaggccgtgatccagggcgccttcaccagcgacgacgccgtggacaccgagggcaccgccgccgagacccactacacctacttccccagcaccgccgtgggcgacggcgccggcggcaccaccagcggcagcaccgccgccgtggtgaccacccagggcagcgaggccctgctgggccaggccaccccccccggcaccggccagttcttcgtgatgatgagcccccaggaggtgctgcagggcggcagccagagaagcatcgcccccagaacccacccctacagccccaagagcgaggcccccagaaccaccagagacgagaagagaagagcccagcacaacgaggtggagagaagaagaagagacaagatcaacaactggatcgtgcagctgagcaagatcatccccgactgcagcatggagagcaccaagagcggccagagcaagggcggcatcctgagcaaggcctgcgactacatccaggagctgagacagagcaaccacagactgagcgaggagctgcagggcctggaccagctgcagctggacaacgacgtgctgagacagcaggtggaggacctgaagaacaagaacctgctgctgagagcccagctgagacaccacggcctggaggtggtgatcaagaacgacagcaactag

SEQ ID NO: 104742 - DNA, 933 bp, Artificial Sequence; identical to SEQ ID NO: 104741
  Description of Artificial Sequence: Synthetic coding sequence

SEQ ID NO: 104743 - DNA, 756 bp, Artificial Sequence
  Description of Artificial Sequence: Synthetic coding sequence
atgtacagagtgatccaggtgagcgagggccagctggacggccagaccgagggcaccggcgccatcagcggctaccccgccacccagagcatgacccaggccgtgatccagggcgccttcaccagcgacgacgccgtggacaccgagggcaccgccgccgagacccactacacctacttccccagcaccgccgtgggcgacggcgccggcggcaccaccagcggcagcaccgccgccgtggtgaccacccagggcagcgaggccctgctgggccaggccaccccccccggcaccggccagttcttcgtgatgatgagcccccaggaggtgctgcagggcggcagccagagaagcatcgcccccagaacccacccctacagccccaagagcgaggcccccagaaccaccagagacgagaagagaagagcccagcacaacgaggtggagagaagaagaagagacaagatcaacaactggatcgtgcagctgagcaagatcatccccgactgcagcatggagagcaccaagagcggccagagcaagggcggcatcctgagcaaggcctgcgactacatccaggagctgagacagagcaaccacagactgagcgaggagctgcagggcctggaccagctgcagctggacaacgacgtgctgagacagcaggtggaggacctgaagaacaagaacctgctgctgagagcccagctgagacaccacggcctggaggtggtgatcaagaacgacagcaactag

SEQ ID NO: 104744 - DNA, 1155 bp, Artificial Sequence
  Description of Artificial Sequence: Synthetic coding sequence
atggccggcgccgagtggaagagcctggaggagtgcctggagaagcacctgcccctgcccgacctgcaggaggtgaagagagtgctgtacggcaaggagctgagaaagctggacctgcccagagaggccttcgaggccgccagcagagaggacttcgagctgcagggctacgccttcgaggccgccgaggagcagctgagaagacccagaatcgtgcacgtgggcctggtgcagaacagaatccccctgcccgccaacgcccccgtggccgagcaggtgagcgccctgcacagaagaatcaaggccatcgtggaggtggccgccatgtgcggcgtgaacatcatctgcttccaggaggcctggaccatgcccttcgccttctgcaccagagagaagctgccctggaccgagttcgccgagagcgccgaggacggccccaccaccagattctgccagaagctggccaagaaccacgacatggtggtggtgagccccatcctggagagagacagcgagcacggcgacgtgctgtggaacaccgccgtggtgatcagcaacagcggcgccgtgctgggcaagaccagaaagaaccacatccccagagtgggcgacttcaacgagagcacctactacatggagggcaacctgggccaccccgtgttccagacccagttcggcagaatcgccgtgaacatctgctacggcagacaccaccccctgaactggctgatgtacagcatcaacggcgccgagatcatcttcaaccccagcgccaccatcggcgccctgagcgagagcctgtggcccatcgaggccagaaacgccgccatcgccaaccactgcttcacctgcgccatcaacagagtgggcaccgagcacttccccaacgagttcaccagcggcgacggcaagaaggcccaccaggacttcggctacttctacggcagcagctacgtggccgcccccgacagcagcagaacccccggcctgagcagaagcagagacggcctgctggtggccaagctggacctgaacctgtgccagcaggtgaacgacgtgtggaacttcaagatgaccggcagatacgagatgtacgccagagagctggccgaggccgtgaagagcaactacagccccaccatcgtgaaggagtag

SEQ ID NO: 104745 - DNA, 951 bp, Artificial Sequence
  Description of Artificial Sequence: Synthetic coding sequence
atgctgggcgaggcccccgccgcccccagactggccggcagcgaggccagaagcctgtggcagggcacccaggtgagcgccctgcacagaagaatcaaggccatcgtggaggtggccgccatgtgcggcgtgaacatcatctgcttccaggaggcctggaccatgcccttcgccttctgcaccagagagaagctgccctggaccgagttcgccgagagcgccgaggacggccccaccaccagattctgccagaagctggccaagaaccacgacatggtggtggtgagccccatcctggagagagacagcgagcacggcgacgtgctgtggaacaccgccgtggtgatcagcaacagcggcgccgtgctgggcaagaccagaaagaaccacatccccagagtgggcgacttcaacgagagcacctactacatggagggcaacctgggccaccccgtgttccagacccagttcggcagaatcgccgtgaacatctgctacggcagacaccaccccctgaactggctgatgtacagcatcaacggcgccgagatcatcttcaaccccagcgccaccatcggcgccctgagcgagagcctgtggcccatcgaggccagaaacgccgccatcgccaaccactgcttcacctgcgccatcaacagagtgggcaccgagcacttccccaacgagttcaccagcggcgacggcaagaaggcccaccaggacttcggctacttctacggcagcagctacgtggccgcccccgacagcagcagaacccccggcctgagcagaagcagagacggcctgctggtggccaagctggacctgaacctgtgccagcaggtgaacgacgtgtggaacttcaagatgaccggcagatacgagatgtacgccagagagctggccgaggccgtgaagagcaactacagccccaccatcgtgaaggagtag

SEQ ID NO: 104746 - DNA, 561 bp, Artificial Sequence
  Description of Artificial Sequence: Synthetic coding sequence
atggccggcgccgagtggaagagcctggaggagtgcctggagaagcacctgcccctgcccgacctgcaggaggtgaagagagtgctgtacggcaaggagctgagaaagctggacctgcccagagaggccttcgaggccgccagcagagaggacttcgagctgcagggctacgccttcgaggccgccgaggagcagctgagaagacccagaatcgtgcacgtgggcctggtgcagaacagaatccccctgcccgccaacgcccccgtggccgagcaggtgagcgccctgcacagaagaatcaaggccatcgtggaggtggccgccatgtgcggcgtgaacatcatctgcttccaggaggcctggatcctgagaccccaccaccaggagcccagacccccctgctgctacgcccccagctgctgcctgatccccagcgtgttcccccacagaagcgagagcatcagaagcagccccagcctgtaccaccacctggtgcaggcccccggcagcagccccctggccttcgtgatccccagcagctggagccccgtgcccagctag

SEQ ID NO: 104747 - DNA, 2955 bp, Artificial Sequence
  Description of Artificial Sequence: Synthetic coding sequence
atggacgacagataccccgccctgcagagagcccagctgagactggacttcatccacgccaacagcaccacccacagcttcctgttcggcgccctggccgagctgctggacaacgccagagacgccggcgccgagagactggacgtgttcagcgtggacaacgagaagctgcagggcggcttcatgctgtgcttcctggacgacggctgcggcatgagccccgaggaggccagcgacatcatctacttcggcagaagcaagaagagactgagcaccctgaagttcatcggccagtacggcaacggcctgaagagcggcagcatgagaatcggcaaggacttcatcctgttcaccaagaaggaggagaccatgacctgcgtgttcttcagccagaccttctgcgaggaggagagcctgagcgaggtggtggtgcccatgcccagctggctgatcagaaccagagagagcgtgaccgacgacccccagaagttcgccatggagctgagcatcatctacaagtacagccccttcaagaccgaggccgagctgatgcagcagttcgacgtgatctacggcaagtgcggcaccctgctggtgatctacaacctgaagctgctgctgaacggcgagcccgagctggacgtgaagaccgacaaggaggacatcctgatggccggcgccctggaggacttccccgccagatggagcttcagagcctacaccagcgtgctgtacttcaacccctggatgagaatcttcatccaggccaagagagtgaagaccaagcacctgtgctactgcctgtacagacccagaaagtacctgtacgtgaccagcagcttcaagggcgccttcaaggacgaggtgaagaaggccgaggaggccgtgaagatcgccgagagcatcctgaaggaggcccagatcaaggtgaaccagtgcgacagaaccagcctgagcagcgccaaggacgtgctgcagagagccctggaggacgtggaggccaagcagaagaacctgaaggagaagcagagagagctgaagaccgccagaaccctgagcctgttctacggcgtgaacgtggagaacagaagccaggccggcatgttcatctacagcaacaacagactgatcaagatgcacgagaaggtgggcagccagctgaagctgaagagcctgctgggcgccggcgtggtgggcatcgtgaacatccccctggaggtgatggagcccagccacaacaagcaggagttcctgaacgtgcaggagtacaaccacctgctgaaggtgatgggccagtacctggtgcagtactgcaaggacaccggcatcaacaacagaaacctgaccctgttctgcaacgagttcggctaccagaacgacatcgacgtggagaagcccctgaacagcttccagtaccagagaagacaggccatgggcatccccttcatcatccagtgcgacctgtgcctgaagtggagagtgctgcccagcagcaccaactaccaggagaaggagttcttcgacatctggatctgcgccaacaaccccaacagactggagaacagctgccaccaggtggagtgcctgcccagcatccccctgggcaccatgagcaccatcagccccagcaagaacgagaaggagaagcagctgagagagagcgtgatcaagtaccagaacagactggccgagcagcagccccagccccagttcatccccgtggacgagatcaccgtgaccagcacctgcctgaccagcgcccacaaggagaacaccaagacccagaagatcagactgctgggcgacgacctgaagcacgagagcctgagcagcttcgagctgagcgccagcagaagaggccagaagagaaacatcgaggagaccgacagcgacgtggagtacatcagcgagaccaagatcatgaagaagagcatggaggagaagatgaacagccagcagcagagaatccccgtggccctgcccgagaacgtgaagctggccgagagaagccagagaagccagatcgccaacatcaccaccgtgtggagagcccagcccaccgagggctgcctgaagaacgcccaggccgccagctgggagatgaagagaaagcagagcctgaacttcgtggaggagtgcaaggtgctgaccgaggacgagaacaccagcgacagcgacatcatcctggtgagcgacaagagcaacaccgacgtgagcctgaagcaggagaagaaggagatccccctgctgaaccaggagaagcaggagctgtgcaacgacgtgctggccatgaagagaagcagcagcctgcccagctggaagagcctgctgaacgtgcccatggaggacgtgaacctgagcagcggccacatcgccagagtgagcgtgagcggcagctgcaaggtggccagcagccccgccagcagccagagcacccccgtgaaggagaccgtgagaaagctgaagagcaagctgagagagatcctgctgtacttcttccccgagcaccagctgcccagcgagctggaggagcccgccctgagctgcgagctggagcagtgccccgagcagatgaacaagaagctgaagatgtgcttcaaccagatccagaacacctacatggtgcagtacgagaagaagatcaagagaaagctgcagagcatcatctacgacagcaacaccagaggcatccacaacgagatcagcctgggccagtgcgagaacaagagaaagatcagcgaggacaagctgaagaacctgagaatcaagctggccctgctgctgcagaagctgcagctgggcggccccgagggcgacctggagcagaccgacacctacctggaggccctgctgaaggaggacaacctgctgttccagaacaacctgaacaaggtgaccatcgacgccagacacagactgcccctggagaagaacgagaagaccagcgagaactag

SEQ ID NO: 104748 - DNA, 618 bp, Artificial Sequence
  Description of Artificial Sequence: Synthetic coding sequence
atgctggagatcctggagcagcagaagaaggtggacgccgagaccgtgggcagagtgaagagattcatccaggagaacgtgttcgtggccgccaaccacaacggcagccccctgagcatcaaggaggcccccaaggagctgagcttcggcgccagagccgagctgcccagaatccaccccgtggccagcaagctgctgagactgatgcagaagaaggagaccaacctgtgcctgagcgccgacgtgagcctggccagagagctgctgcagctggccgacgccctgggccccagcatctgcatgctgaagacccacgtggacatcctgaacgacttcaccctggacgtgatgaaggagctgatcaccctggccaagtgccacgagttcctgatcttcgaggacagaaagttcgccgacatcggcaacaccgtgaagaagcagtacgagggcgacaacctgggccagcagtacaacagcccccaggaggtgatcggcaagagaggcagcgacatcatcatcgtgggcagaggcatcatcagcgccgccgacagactggaggccgccgagatgtacagaaaggccgcctgggaggcctacctgagcagactgggcgtgtag

SEQ ID NO: 104749 - DNA, 1167 bp, Artificial Sequence
  Description of Artificial Sequence: Synthetic coding sequence
atgctgatcagaagaaaggagaccaaggactacggcaccaagagactggtggagggcaccatcaaccccggcgagacctgcctgatcatcgaggacgtggtgaccagcggcagcagcgtgctggagaccgtggaggtgctgcagaaggagggcctgaaggtgaccgacgccatcgtgctgctggacagagagcagggcggcaaggacaagctgcaggcccacggcatcagactgcacagcgtgtgcaccctgagcaagatgctggagatcctggagcagcagaagaaggtggacgccgagaccgtgggcagagtgaagagattcatccaggagaacgtgttcgtggccgccaaccacaacggcagccccctgagcatcaaggaggcccccaaggagctgagcttcggcgccagagccgagctgcccagaatccaccccgtggccagcaagctgctgagactgatgcagaagaaggagaccaacctgtgcctgagcgccgacgtgagcctggccagagagctgctgcagctggccgacgccctgggccccagcatctgcatgctgaagacccacgtggacatcctgaacgacttcaccctggacgtgatgaaggagctgatcaccctggccaagtgccacgagttcctgatcttcgaggacagaaagttcgccgacatcggcaacaccgtgaagaagcagtacgagggcggcatcttcaagatcgccagctgggccgacctggtgaacgcccacgtggtgcccggcagcggcgtggtgaagggcctgcaggaggtgggcctgcccctgcacagaggctgcctgctgatcgccgagatgagcagcaccggcagcctggccaccggcgactacaccagagccgccgtgagaatggccgaggagcacagcgagttcgtggtgggcttcatcagcggcagcagagtgagcatgaagcccgagttcctgcacctgacccccggcgtgcagctggaggccggcggcgacaacctgggccagcagtacaacagcccccaggaggtgatcggcaagagaggcagcgacatcatcatcgtgggcagaggcatcatcagcgccgccgacagactggaggccgccgagatgtacagaaaggccgcctgggaggcctacctgagcagactgggcgtgtag

SEQ ID NO: 104750 - DNA, 909 bp, Artificial Sequence
  Description of Artificial Sequence: Synthetic coding sequence
atgctggagatcctggagcagcagaagaaggtggacgccgagaccgtgggcagagtgaagagattcatccaggagaacgtgttcgtggccgccaaccacaacggcagccccctgagcatcaaggaggcccccaaggagctgagcttcggcgccagagccgagctgcccagaatccaccccgtggccagcaagctgctgagactgatgcagaagaaggagaccaacctgtgcctgagcgccgacgtgagcctggccagagagctgctgcagctggccgacgccctgggccccagcatctgcatgctgaagacccacgtggacatcctgaacgacttcaccctggacgtgatgaaggagctgatcaccctggccaagtgccacgagttcctgatcttcgaggacagaaagttcgccgacatcggcaacaccgtgaagaagcagtacgagggcggcatcttcaagatcgccagctgggccgacctggtgaacgcccacgtggtgcccggcagcggcgtggtgaagggcctgcaggaggtgggcctgcccctgcacagaggctgcctgctgatcgccgagatgagcagcaccggcagcctggccaccggcgactacaccagagccgccgtgagaatggccgaggagcacagcgagttcgtggtgggcttcatcagcggcagcagagtgagcatgaagcccgagttcctgcacctgacccccggcgtgcagctggaggccggcggcgacaacctgggccagcagtacaacagcccccaggaggtgatcggcaagagaggcagcgacatcatcatcgtgggcagaggcatcatcagcgccgccgacagactggaggccgccgagatgtacagaaaggccgcctgggaggcctacctgagcagactgggcgtgtag

SEQ ID NO: 104751 - DNA, 933 bp, Artificial Sequence
  Description of Artificial Sequence: Synthetic coding sequence
atggccgccaccggcgccaacgccgagaaggccgagagccacaacgactgccccgtgagactgctgaaccccaacatcgccaagatgaaggaggacatcctgtaccacttcaacctgaccaccagcagacacaacttccccgccctgttcggcgacgtgaagttcgtgtgcgtgggcggcagccccagcagaatgaaggccttcatcagatgcgtgggcgccgagctgggcctggactgccccggcagagactaccccaacatctgcgccggcaccgacagatacgccatgtacaaggtgggccccgtgctgagcgtgagccacggcatgggcatccccagcatcagcatcatgctgcacgagctgatcaagctgctgtactacgccagatgcagcaacgtgaccatcatcagaatcggcaccagcggcggcatcggcctggagcccggcaccgtggtgatcaccgagcaggccgtggacacctgcttcaaggccgagttcgagcagatcgtgctgggcaagagagtgatcagaaagaccgacctgaacaagaagctggtgcaggagctgctgctgtgcagcgccgagctgagcgagttcaccaccgtggtgggcaacaccatgtgcaccctggacttctacgagggccagggcagactggacggcgccctgtgcagctacaccgagaaggacaagcaggcctacctggaggccgcctacgccgccggcgtgagaaacatcgagatggagagcagcgtgttcgccgccatgtgcagcgcctgcggcctgcaggccgccgtggtgtgcgtgaccctgctgaacagactggagggcgaccagatcagcagccccagaaacgtgctgagcgagtaccagcagagaccccagagactggtgagctacttcatcaagaagaagctgagcaaggcctag

SEQ ID NO: 104752 - DNA, 933 bp, Artificial Sequence; identical to SEQ ID NO: 104751
  Description of Artificial Sequence: Synthetic coding sequence

SEQ ID NO: 104753 - DNA, 933 bp, Artificial Sequence; identical to SEQ ID NO: 104751
  Description of Artificial Sequence: Synthetic coding sequence

SEQ ID NO: 104754 - DNA, 435 bp, Artificial Sequence
  Description of Artificial Sequence: Synthetic coding sequence
atggccgccaccggcgccaacgccgagaaggccgagagccacaacgactgccccgtgagactgctgaaccccaacatcgccaagatgaaggaggacatcctgtaccacttcaacctgaccaccagcagacacaacttccccgccctgttcggcgacgtgaagttcgtgtgcgtgggcggcagccccagcagaatgaaggccttcatcagatgcgtgggcgccgagctgggcctggactgccccggcagagactaccccaacatctgcgccggcaccgacagatacgccatgtacaaggtgggccccgtgctgagcgtgagccacggcatgggcatccccagcatcagcatcatgctgcacgagctgatcaagctgctgtactacgccagatgcagcaacgtgaccatcatcagaatcggcaccagcggcggctag

SEQ ID NO: 104755 - DNA, 516 bp, Artificial Sequence
  Description of Artificial Sequence: Synthetic coding sequence
atggccgccaccggcgccaacgccgagaaggccgagagccacaacgactgccccgtgagactgctgaaccccaacatcgccaagatgaaggaggacatcctgtaccacttcaacctgaccaccagcagacacaacttccccgccctgttcggcgacgtgaagttcgtgtgcgtgggcggcagccccagcagaatgaaggccttcatcagatgcgtgggcgccgagctgggcctggactgccccggcagagactaccccaacatctgcgccggcaccgacagatacgccatgtacaaggtgggccccgtgctgagcgtgagccacggcatgggcatccccagcatcagcatcatgctgcacgagctgatcaagctgctgtactacgccagatgcagcaacgtgaccatcatcagaatcggcaccagcggcggcatcggcatcctgaagcacctgagaagaaaggacaccggcaagagcaagggcggcagagagagaagaagcaccaagctgagatag

SEQ ID NO: 104756 - DNA, 522 bp, Artificial Sequence
  Description of Artificial Sequence: Synthetic coding sequence
atgcagagaaagctgaaggtgaccagcctggagcccggcaccgtggtgatcaccgagcaggccgtggacacctgcttcaaggccgagttcgagcagatcgtgctgggcaagagagtgatcagaaagaccgacctgaacaagaagctggtgcaggagctgctgctgtgcagcgccgagctgagcgagttcaccaccgtggtgggcaacaccatgtgcaccctggacttctacgagggccagggcagactggacggcgccctgtgcagctacaccgagaaggacaagcaggcctacctggaggccgcctacgccgccggcgtgagaaacatcgagatggagagcagcgtgttcgccgccatgtgcagcgcctgcggcctgcaggccgccgtggtgtgcgtgaccctgctgaacagactggagggcgaccagatcagcagccccagaaacgtgctgagcgagtaccagcagagaccccagagactggtgagctacttcatcaagaagaagctgagcaaggcctag

SEQ ID NO: 104757 - DNA, 90 bp, Artificial Sequence
  Description of Artificial Sequence: Synthetic coding sequence
atggccgccaccggcgccaacgccgagaaggccgagagccacaacgactgccccgtgagactgctgaaccccaacatcgccaagatgtag

SEQ ID NO: 104758 - DNA, 441 bp, Artificial Sequence
  Description of Artificial Sequence: Synthetic coding sequence
atggccgccaccggcgccaacgccgagaaggccgagagccacaacgactgccccgtgagactgctgaaccccaacatcgccaagatgaaggaggacatcctgtaccacttcaacctgaccaccagcagacacaacttccccgccctgttcggcgacgtgaagttcgtgtgcgtgggcggcagccccagcagaatgaaggccttcatcagatgcgtgggcgccgagctgggcctggactgccccggcagagactaccccaacatctgcgccggcaccgacagatacgccatgtacaaggtgggccccgtgctgagcgtgagccacggcatgggcatccccagcatcagcatcatgctgcacgagctgatcaagctgctgtactacgccagatgcagcaacgtgaccatcatcagaatcggcaccagcggcggcatcggctag

SEQ ID NO: 104759 - DNA, 606 bp, Artificial Sequence
  Description of Artificial Sequence: Synthetic coding sequence
atggccagcgccggcggcgaggactgcgagagccccgcccccgaggccgacagaccccaccagagacccttcctgatcggcgtgagcggcggcaccgccagcggcaagagcaccgtgtgcgagaagatcatggagctgctgggccagaacgaggtggagcagagacagagaaaggtggtgatcctgagccaggacagattctacaaggtgctgaccgccgagcagaaggccaaggccctgaagggccagtacaacttcgaccaccccgacgccttcgacaacgacctgatgcacagaaccctgaagaacatcgtggagggcaagaccgtggaggtgcccacctacgacttcgtgacccacagcagactgcccgagaccaccgtggtgtaccccgccgacgtggtgctgttcgagggcatcctggtgttctacagccaggagatcagagacatgttccacctgagactgttcgtggacaccgacagcgacgtgagactgagcagaagagacaaggaggtgtgcagatgcgaccaccccgccagaagcggccagtacggctgccaccagcccgacagagccgcccaccccggccacagcgagtggtag

SEQ ID NO: 104760 - DNA, 807 bp, Artificial Sequence
  Description of Artificial Sequence: Synthetic coding sequence
atggccagcgccggcggcgaggactgcgagagccccgcccccgaggccgacagaccccaccagagacccttcctgatcggcagcaccgtgtgcgagaagatcatggagctgctgggccagaacgaggtggagcagagacagagaaaggtggtgatcctgagccaggacagattctacaaggtgctgaccgccgagcagaaggccaaggccctgaagggccagtacaacttcgaccaccccgacgccttcgacaacgacctgatgcacagaaccctgaagaacatcgtggagggcaagaccgtggaggtgcccacctacgacttcgtgacccacagcagactgcccgagaccaccgtggtgtaccccgccgacgtggtgctgttcgagggcatcctggtgttctacagccaggagatcagagacatgttccacctgagactgttcgtggacaccgacagcgacgtgagactgagcagaagagtgctgagagacgtgagaagaggcagagacctggagcagatcctgacccagtacaccaccttcgtgaagcccgccttcgaggagttctgcctgcccaccaagaagtacgccgacgtgatcatccccagaggcgtggacaacatggtggccatcaacctgatcgtgcagcacatccaggacatcctgaacggcgacatctgcaagtggcacagaggcggcagcaacggcagaagctacaagagaaccttcagcgagcccggcgaccaccccggcatgctgaccagcggcaagagaagccacctggagagcagcagcagaccccactag

SEQ ID NO: 104761 - DNA, 849 bp, Artificial Sequence
  Description of Artificial Sequence: Synthetic coding sequence
atggccagcgccggcggcgaggactgcgagagccccgcccccgaggccgacagaccccaccagagacccttcctgatcggcgacgagagattccaggccggcatccccctgctgtgcctgcagagcaccgtgtgcgagaagatcatggagctgctgggccagaacgaggtggagcagagacagagaaaggtggtgatcctgagccaggacagattctacaaggtgctgaccgccgagcagaaggccaaggccctgaagggccagtacaacttcgaccaccccgacgccttcgacaacgacctgatgcacagaaccctgaagaacatcgtggagggcaagaccgtggaggtgcccacctacgacttcgtgacccacagcagactgcccgagaccaccgtggtgtaccccgccgacgtggtgctgttcgagggcatcctggtgttctacagccaggagatcagagacatgttccacctgagactgttcgtggacaccgacagcgacgtgagactgagcagaagagtgctgagagacgtgagaagaggcagagacctggagcagatcctgacccagtacaccaccttcgtgaagcccgccttcgaggagttctgcctgcccaccaagaagtacgccgacgtgatcatccccagaggcgtggacaacatggtggccatcaacctgatcgtgcagcacatccaggacatcctgaacggcgacatctgcaagtggcacagaggcggcagcaacggcagaagctacaagagaaccttcagcgagcccggcgaccaccccggcatgctgaccagcggcaagagaagccacctggagagcagcagcagaccccactag

SEQ ID NO: 104762 - DNA, 834 bp, Artificial Sequence
  Description of Artificial Sequence: Synthetic coding sequence
atggccagcgccggcggcgaggactgcgagagccccgcccccgaggccgacagaccccaccagagacccttcctgatcggcgtgagcggcggcaccgccagcggcaagagcaccgtgtgcgagaagatcatggagctgctgggccagaacgaggtggagcagagacagagaaaggtggtgatcctgagccaggacagattctacaaggtgctgaccgccgagcagaaggccaaggccctgaagggccagtacaacttcgaccaccccgacgccttcgacaacgacctgatgcacagaaccctgaagaacatcgtggagggcaagaccgtggaggtgcccacctacgacttcgtgacccacagcagactgcccgagaccaccgtggtgtaccccgccgacgtggtgctgttcgagggcatcctggtgttctacagccaggagatcagagacatgttccacctgagactgttcgtggacaccgacagcgacgtgagactgagcagaagagtgctgagagacgtgagaagaggcagagacctggagcagatcctgacccagtacaccaccttcgtgaagcccgccttcgaggagttctgcctgcccaccaagaagtacgccgacgtgatcatccccagaggcgtggacaacatggtggccatcaacctgatcgtgcagcacatccaggacatcctgaacggcgacatctgcaagtggcacagaggcggcagcaacggcagaagctacaagagaaccttcagcgagcccggcgaccaccccggcatgctgaccagcggcaagagaagccacctggagagcagcagcagaccccactag

SEQ ID NO: 104763 - DNA, 1647 bp, Artificial Sequence
  Description of Artificial Sequence: Synthetic coding sequence
atggccgccccccccgccagagccgacgccgaccccagccccaccagcccccccaccgccagagacacccccggcagacaggccgagaagagcgagaccgcctgcgaggacagaagcaacgccgagagcctggacagactgctgccccccgtgggcaccggcagaagccccagaaagagaaccaccagccagtgcaagagcgagccccccctgctgagaaccagcaagagaaccatctacaccgccggcagacccccctggtacaacgagcacggcacccagagcaaggaggccttcgccatcggcctgggcggcggcagcgccagcggcaagaccaccgtggccagaatgatcatcgaggccctggacgtgccctgggtggtgctgctgagcatggacagcttctacaaggtgctgaccgagcagcagcaggagcaggccgcccacaacaacttcaacttcgaccaccccgacgccttcgacttcgacctgatcatcagcaccctgaagaagctgaagcagggcaagagcgtgaaggtgcccatctacgacttcaccacccacagcagaaagaaggactggaagaccctgtacggcgccaacgtgatcatcttcgagggcatcatggccttcgccgacaagaccctgctggagctgctggacatgaagatcttcgtggacaccgacagcgacatcagactggtgagaagactgagaagagacatcagcgagagaggcagagacatcgagggcgtgatcaagcagtacaacaagttcgtgaagcccagcttcgaccagtacatccagcccaccatgagactggccgacatcgtggtgcccagaggcagcggcaacaccgtggccatcgacctgatcgtgcagcacgtgcacagccagctggaggagagagagctgagcgtgagagccgccctggccagcgcccaccagtgccaccccctgcccagaaccctgagcgtgctgaagagcaccccccaggtgagaggcatgcacaccatcatcagagacaaggagaccagcagagacgagttcatcttctacagcaagagactgatgagactgctgatcgagcacgccctgagcttcctgcccttccaggactgcgtggtgcagaccccccagggccaggactacgccggcaagtgctacgccggcaagcagatcaccggcgtgagcatcctgagagccggcgagaccatggagcccgccctgagagccgtgtgcaaggacgtgagaatcggcaccatcctgatccagaccaaccagctgaccggcgagcccgagctgcactacctgagactgcccaaggacatcagcgacgaccacgtgatcctgatggactgcaccgtgagcaccggcgccgccgccatgatggccgtgagagtgctgctggaccacgacgtgcccgaggacaagatcttcctgctgagcctgctgatggccgagatgggcgtgcacagcgtggcctacgccttccccagagtgagaatcatcaccaccgccgtggacaagagagtgaacgacctgttcagaatcatccccggcatcggcaacttcggcgacagatacttcggcaccgacgccgtgcccgacggcagcgacgaggaggaggtggcctacaccggctag

SEQ ID NO: 104764 - DNA, 1260 bp, Artificial Sequence
  Description of Artificial Sequence: Synthetic coding sequence
atggccgccccccccgccagagccgacgccgaccccagccccaccagcccccccaccgccagagacacccccggcagacaggccgagaagagcgagaccgcctgcgaggacagaagcaacgccgagagcctggacagactgctgccccccgtgggcaccggcagaagccccagaaagagaaccaccagccagtgcaagagcgagccccccctgctgagaaccagcaagagaaccatctacaccgccggcagacccccctggtacaacgagcacggcacccagagcaaggaggccttcgccatcggcctgggcggcggcagcgccagcggcaagaccaccgtggccagaatgatcatcgaggccctggacgtgccctgggtggtgctgctgagcatggacagcttctacaaggtgctgaccgagcagcagcaggagcaggccgcccacaacaacttcaacttcgaccaccccgacgccttcgacttcgacctgatcatcagcaccctgaagaagctgaagcagggcaagagcgtgaaggtgcccatctacgacttcaccacccacagcagaaagaaggactggaagaccctgtacggcgccaacgtgatcatcttcgagggcatcatggccttcgccgacaagaccctgctggagctgctggacatgaagatcttcgtggacaccgacagcgacatcagactggtgagaagactgagaagagacatcagcgagagaggcagagacatcgagggcgtgatcaagcagtacaacaagttcgtgaagcccagcttcgaccagtacatccagcccaccatgagactggccgacatcgtggtgcccagaggcagcggcaacaccgtggccatcgacctgatcgtgcagcacgtgcacagccagctggaggagggctgcgccggcctgggcacccccgtgccccccgccgcccccgacgccgagagacccgaggagcacgccgccggcaccggccacgcccaccaccaccaggtgagagcccacctgggcaccggcagacccagagccagagcccccgcccagctgctggccccccagggccagggcgaccagagcagaagagtgcacctgctgctgcaggagaccgacgccgccgcccacagagccagagccctgctgcccgccctgagcggcctgagaagaaccgaccccgccggcgccggcctgtgcggccaggtgctgtgcggcgaggccgaccacagatgcgtgcacagcgccagaagatag

SEQ ID NO: 104765 - DNA, 1647 bp, Artificial Sequence
  Description of Artificial Sequence: Synthetic coding sequence
atggccgccccccccgccagagccgacgccgaccccagccccaccagcccccccaccgccagagacacccccggcagacaggccgagaagagcgagaccgcctgcgaggacagaagcaacgccgagagcctggacagactgctgccccccgtgggcaccggcagaagccccagaaagagaaccaccagccagtgcaagagcgagccccccctgctgagaaccagcaagagaaccatctacaccgccggcagacccccctggtacaacgagcacggcacccagagcaaggaggccttcgccatcggcctgggcggcggcagcgccagcggcaagaccaccgtggccagaatgatcatcgaggccctggacgtgccctgggtggtgctgctgagcatggacagcttctacaaggtgctgaccgagcagcagcaggagcaggccgcccacaacaacttcaacttcgaccaccccgacgccttcgacttcgacctgatcatcagcaccctgaagaagctgaagcagggcaagagcgtgaaggtgcccatctacgacttcaccacccacagcagaaagaaggactggaagaccctgtacggcgccaacgtgatcatcttcgagggcatcatggccttcgccgacaagaccctgctggagctgctggacatgaagatcttcgtggacaccgacagcgacatcagactggtgagaagactgagaagagacatcagcgagagaggcagagacatcgagggcgtgatcaagcagtacaacaagttcgtgaagcccagcttcgaccagtacatccagcccaccatgagactggccgacatcgtggtgcccagaggcagcggcaacaccgtggccatcgacctgatcgtgcagcacgtgcacagccagctggaggagctgagattcgtgcccagagccgccctggccagcgcccaccagtgccaccccctgcccagaaccctgagcgtgctgaagagcaccccccaggtgagaggcatgcacaccatcatcagagacaaggagaccagcagagacgagttcatcttctacagcaagagactgatgagactgctgatcgagcacgccctgagcttcctgcccttccaggactgcgtggtgcagaccccccagggccaggactacgccggcaagtgctacgccggcaagcagatcaccggcgtgagcatcctgagagccggcgagaccatggagcccgccctgagagccgtgtgcaaggacgtgagaatcggcaccatcctgatccagaccaaccagctgaccggcgagcccgagctgcactacctgagactgcccaaggacatcagcgacgaccacgtgatcctgatggactgcaccgtgagcaccggcgccgccgccatgatggccgtgagagtgctgctggaccacgacgtgcccgaggacaagatcttcctgctgagcctgctgatggccgagatgggcgtgcacagcgtggcctacgccttccccagagtgagaatcatcaccaccgccgtggacaagagagtgaacgacctgttcagaatcatccccggcatcggcaacttcggcgacagatacttcggcaccgacgccgtgcccgacggcagcgacgaggaggaggtggcctacaccggctag

SEQ ID NO: 104766 - DNA, 1602 bp, Artificial Sequence
  Description of Artificial Sequence: Synthetic coding sequence
atgagcagcccccccgcctaccccggcatcagaatcagcggctgcagagccctgggcgccgagggcagcagcaacgccgagagcctggacagactgctgccccccgtgggcaccggcagaagccccagaaagagaaccaccagccagtgcaagagcgagccccccctgctgagaaccagcaagagaaccatctacaccgccggcagacccccctggtacaacgagcacggcacccagagcaaggaggccttcgccatcggcctgggcggcggcagcgccagcggcaagaccaccgtggccagaatgatcatcgaggccctggacgtgccctgggtggtgctgctgagcatggacagcttctacaaggtgctgaccgagcagcagcaggagcaggccgcccacaacaacttcaacttcgaccaccccgacgccttcgacttcgacctgatcatcagcaccctgaagaagctgaagcagggcaagagcgtgaaggtgcccatctacgacttcaccacccacagcagaaagaaggactggaagaccctgtacggcgccaacgtgatcatcttcgagggcatcatggccttcgccgacaagaccctgctggagctgctggacatgaagatcttcgtggacaccgacagcgacatcagactggtgagaagactgagaagagacatcagcgagagaggcagagacatcgagggcgtgatcaagcagtacaacaagttcgtgaagcccagcttcgaccagtacatccagcccaccatgagactggccgacatcgtggtgcccagaggcagcggcaacaccgtggccatcgacctgatcgtgcagcacgtgcacagccagctggaggagagagagctgagcgtgagagccgccctggccagcgcccaccagtgccaccccctgcccagaaccctgagcgtgctgaagagcaccccccaggtgagaggcatgcacaccatcatcagagacaaggagaccagcagagacgagttcatcttctacagcaagagactgatgagactgctgatcgagcacgccctgagcttcctgcccttccaggactgcgtggtgcagaccccccagggccaggactacgccggcaagtgctacgccggcaagcagatcaccggcgtgagcatcctgagagccggcgagaccatggagcccgccctgagagccgtgtgcaaggacgtgagaatcggcaccatcctgatccagaccaaccagctgaccggcgagcccgagctgcactacctgagactgcccaaggacatcagcgacgaccacgtgatcctgatggactgcaccgtgagcaccggcgccgccgccatgatggccgtgagagtgctgctggaccacgacgtgcccgaggacaagatcttcctgctgagcctgctgatggccgagatgggcgtgcacagcgtggcctacgccttccccagagtgagaatcatcaccaccgccgtggacaagagagtgaacgacctgttcagaatcatccccggcatcggcaacttcggcgacagatacttcggcaccgacgccgtgcccgacggcagcgacgaggaggaggtggcctacaccggctag

SEQ ID NO: 104767 - DNA, 261 bp, Artificial Sequence
  Description of Artificial Sequence: Synthetic coding sequence
atgagcagcccccccgcctaccccggcatcagaatcagcggctgcagagccctgggcgccgagggcagcagcaacgccgagagcctggacagactgctgccccccgtgggcaccggcagaagccccagaaagagaaccaccagccagtgcaagagcgagccccccctgctgagaaccagcaagagaaccatctacaccgccggcagacccccctggtacaacgagcacggcacccagagcaaggaggccttcgccatctag

SEQ ID NO: 104768 - DNA, 408 bp, Artificial Sequence
  Description of Artificial Sequence: Synthetic coding sequence
atgcacaccatcatcagagacaaggagaccagcagagacgagttcatcttctacagcaagagactgatgagactgctgatcgagcacgccctgagcttcctgcccttccaggactgcgtggtgcagaccccccagggccaggactacgccggcaagtgctacgccggcaagcagatcaccggcgtgagcatcctgagagccggcgagaccatggagcccgccctgagagccgtgtgcaaggacgtgagaatcggcaccatcctgatccagaccaaccagctgaccggcgagcccgagctgcactacctgagactgcccaaggacatcagcgacgaccacgtgatcctgatggactgcaccgtgagcaccggcgccgccgccatgatggccgtgagagtgctgctgtag

SEQ ID NO: 104769 - DNA, 786 bp, Artificial Sequence
  Description of Artificial Sequence: Synthetic coding sequence
atggccggcgacagcgagcagaccctgcagaaccaccagcagcccaacggcggcgagcccttcctgatcggcgtgagcggcggcaccgccagcggcaagagcagcgtgtgcgccaagatcgtgcagctgctgggccagaacgaggtggactacagacagaagcaggtggtgatcctgagccaggacagcttctacagagtgctgaccagcgagcagaaggccaaggccctgaagggccagttcaacttcgaccaccccgacgccttcgacaacgagctgatcctgaagaccctgaaggagatcaccgagggcaagaccgtgcagatccccgtgtacgacttcgtgagccacagcagaaaggaggagaccgtgaccgtgtaccccgccgacgtggtgctgttcgagggcatcctggccttctacagccaggaggtgagagacctgttccagatgaagctgttcgtggacaccgacgccgacaccagactgagcagaagagtgctgagagacatcagcgagagaggcagagacctggagcagatcctgagccagtacatcaccttcgtgaagcccgccttcgaggagttctgcctgcccaccaagaagtacgccgacgtgatcatccccagaggcgccgacaacctggtggccatcaacctgatcgtgcagcacatccaggacatcctgaacggcggccccagcaagagacagaccaacggctgcctgaacggctacacccccagcagaaagagacaggccagcgagagcagcagcagaccccactag

SEQ ID NO: 104770 - DNA, 393 bp, Artificial Sequence
  Description of Artificial Sequence: Synthetic coding sequence
atggccggcgacagcgagcagaccctgcagaaccaccagcagcccaacggcggcgagcccttcctgatcggcgtgagcggcggcaccgccagcggcaagagcagcgtgtgcgccaagatcgtgcagctgctgggccagaacgaggtggactacagacagaagcaggtggtgatcctgagccaggacagcttctacagagtgctgaccagcgagcagaaggccaaggccctgaagggccagttcaacttcgaccaccccgacgccttcgacaacgagctgatcctgaagaccctgaaggagatcaccgagggcaagaccgtgcagatccccgtgtacgacttcgtgagccacagcagaatcaagggccaccagagagagagacagggcagctag

SEQ ID NO: 104771 - DNA, 2031 bp, Artificial Sequence
  Description of Artificial Sequence: Synthetic coding sequence
atgagcagcctgcaggccctgtgcagcggcctgcccctgagacccctgcccgagaacagaggcagacaggccggcgtgccccacgcccccgtgagaacccccagcctgagccccgtggagaagcagctggccctgagaaacgccctgagatacttcccccccgacgtgcaggagctgctggcccccgagttcgcccaggagctgcagctgtacggccacatctacatgtacagattctgccccgacatcgagatgagagcctaccccatcgagcagtacccctgccagaccaaggtggccgccgccatcatgcacatgatcatgaacaacctggaccccgccgtggcccagttcccccaggagctggtgacctacggcggcaacggccaggtgttcagcaactgggcccagttctggctgaccatgttctacctgagcaagatgaccgaggagcagaccctggtgatgtacagcggccaccccctgggcctgttccccagcagcagaagcgcccccagactggtgatcaccaacggcatggtgatccccaactacagcagcagaaccgagtacgagaagctgttcgccctgggcgtgaccatgtacggccagatgaccgccggcagctactgctacatcggcccccagggcatcgtgcacggcaccgtgctgaccgtgctgaacgccgccagaagatacctgggcatcgaggacctggccggcaaggtgttcgtgaccagcggcctgggcggcatgagcggcgcccaggccaaggccgccgtgatcgtgggctgcatcggcgtgatcgccgaggtggacaaggccgccctggagaagagacacagacagggctggctgatggaggtgaccgacagcctggacagatgcatccagagactgagagaggccagaaagaagaaggaggtgctgagcctgggctaccacggcaacgtggtggccctgtgggagagactggtgcacgagctggacaccaccggcgagtgcctggtggacctgggcagcgaccagaccagctgccacaaccccttcaacggcggctactaccccgtgcagctgagcttcaccgaggcccagagcctgatggccagcaaccccgccgtgttcaaggacctggtgcaggagagcctgagaagacaggtgagcgccatcaacagactggccgaggagaagttcttcttctgggactacggcaacgccttcctgctggaggcccagagagccggcgccgacgtggagaagaagggcgccggcagaaccgagttcagataccccagctacgtgcagcacatcatgggcgacatcttcagccagggcttcggccccttcagatgggtgtgcaccagcggcgacccccaggacctggccgtgaccgacgagctggccaccagcgtgctggaggaggccatcgccgacggcgtgaaggtgagcgtgaagctgcagtacatggacaacatcagatggatcagagaggccgccagacacagactggtggtgggcagccaggccagaatcctgtacagcgaccagaagggcagagtggccatcgccgtggccatcaaccaggccatcgcctgcagaagaatcaaggcccccgtggtgctgagcagagaccaccacgacgtgagcggcaccgacagccccttcagagagaccagcaacatctacgacggcagcgccttctgcgccgacatggccgtgcagaacttcgtgggcgacgcctgcagaggcgccacctgggtggccctgcacaacggcggcggcgtgggctggggcgaggtgatcaacggcggcttcggcctggtgctggacggcacccccgaggccgagggcagagccagactgatgctgagctgggacgtgagcaacggcgtggccagaagatgctggagcggcaaccagaaggcctacgagatcatctgccagaccatgcaggagaacagcaccctggtggtgaccctgccccacaaggtggaggacgagagagtgctgcagcaggccctgcagctgtag

SEQ ID NO: 104772 - DNA, 2211 bp, Artificial Sequence
  Description of Artificial Sequence: Synthetic coding sequence
atgagcagcctgcaggccctgtgcagcggcctgcccctgagacccctgcccgagaacagaggcagacaggccggcgtgccccacgcccccgtgagaacccccagcctgagccccgtggagaagcagctggccctgagaaacgccctgagatacttcccccccgacgtgcaggagctgctggcccccgagttcgcccaggagctgcagctgtacggccacatctacatgtacagattctgccccgacatcgagatgagagcctaccccatcgagcagtacccctgccagaccaaggtggccgccgccatcatgcacatgatcatgaacaacctggaccccgccgtggcccagttcccccaggagctggtgacctacggcggcaacggccaggtgttcagcaactgggcccagttctggctgaccatgttctacctgagcaagatgaccgaggagcagaccctggtgatgtacagcggccaccccctgggcctgttccccagcagcagaagcgcccccagactggtgatcaccaacggcatggtgatccccaactacagcagcagaaccgagtacgagaagctgttcgccctgggcgtgaccatgtacggccagatgaccgccggcagctactgctacatcggcccccagggcatcgtgcacggcaccgtgctgaccgtgctgaacgccgccagaagatacctgggcatcgaggacctggccggcaaggtgttcgtgaccagcggcctgggcggcatgagcggcgcccaggccaaggccgccgtgatcgtgggctgcatcggcgtgatcgccgaggtggacaaggccgccctggagaagagacacagacagggctggctgatggaggtgaccgacagcctggacagatgcatccagagactgagagtgctgcagctgggcctgcagcaggccctgggctgggccggcctgcccgccgccctgggcctgtgcgtgctgagctgcttcgtgaacctggcccccctgggcgagggcagatgcctggcccccagcggcttcagcagacccctgctgggcgcccccgtgctgctgctgtgccccagcagagaggccagaaagaagaaggaggtgctgagcctgggctaccacggcaacgtggtggccctgtgggagagactggtgcacgagctggacaccaccggcgagtgcctggtggacctgggcagcgaccagaccagctgccacaaccccttcaacggcggctactaccccgtgcagctgagcttcaccgaggcccagagcctgatggccagcaaccccgccgtgttcaaggacctggtgcaggagagcctgagaagacaggtgagcgccatcaacagactggccgaggagaagttcttcttctgggactacggcaacgccttcctgctggaggcccagagagccggcgccgacgtggagaagaagggcgccggcagaaccgagttcagataccccagctacgtgcagcacatcatgggcgacatcttcagccagggcttcggccccttcagatgggtgtgcaccagcggcgacccccaggacctggccgtgaccgacgagctggccaccagcgtgctggaggaggccatcgccgacggcgtgaaggtgagcgtgaagctgcagtacatggacaacatcagatggatcagagaggccgccagacacagactggtggtgggcagccaggccagaatcctgtacagcgaccagaagggcagagtggccatcgccgtggccatcaaccaggccatcgcctgcagaagaatcaaggcccccgtggtgctgagcagagaccaccacgacgtgagcggcaccgacagccccttcagagagaccagcaacatctacgacggcagcgccttctgcgccgacatggccgtgcagaacttcgtgggcgacgcctgcagaggcgccacctgggtggccctgcacaacggcggcggcgtgggctggggcgaggtgatcaacggcggcttcggcctggtgctggacggcacccccgaggccgagggcagagccagactgatgctgagctgggacgtgagcaacggcgtggccagaagatgctggagcggcaaccagaaggcctacgagatcatctgccagaccatgcaggagaacagcaccctggtggtgaccctgccccacaaggtggaggacgagagagtgctgcagcaggccctgcagctgtag

SEQ ID NO: 104773 - DNA, 375 bp, Artificial Sequence
  Description of Artificial Sequence: Synthetic coding sequence
atgagacaggccggcagagccgccctgctggccgccctgctgctgctggtgcagctgtgccccggcagcagccagagaagccccgaggccgccggcgtgcaggaccccagcctgagatggagccccggcgccagaaaccagggcggcggcgccagagccctgctgctgctgctggccgagagattccccagaagagccggccccggcagactgggcctgggcaccgccggcgagagacccagaagagacaaccccagcctgagcatcgacctgaccttccacctgctgagaaccctgctggagctggccagaacccagagccagagagagagagccgagcagaacagaatcatcttcgacagcgtgggcaagtag

SEQ ID NO: 104774 - DNA, 339 bp, Artificial Sequence
  Description of Artificial Sequence: Synthetic coding sequence
atgaccagatgcgccctgctgctgctgatggtgctgatgctgggcagagtgctggtggtgcccgtgacccccatccccaccttccagctgagaccccagaacagcccccagaccacccccagacccgccgccagcgagagccccagcgccgcccccacctggccctgggccgcccagagccactgcagccccaccagacaccccggcagcagaatcgtgctgagcctggacgtgcccatcggcctgctgcagatcctgctggagcaggccagagccagagccgccagagagcaggccaccaccaacgccagaatcctggccagagtgggccactgctag

SEQ ID NO: 104775 - DNA, 1923 bp, Artificial Sequence
  Description of Artificial Sequence: Synthetic coding sequence
atgggccagcccagcctgacctggatgctgatggtggtggtggccagctggttcatcaccaccgccgccaccgacaccagcgaggccagatggtgcagcgagtgccacagcaacgccacctgcaccgaggacgaggccgtgaccacctgcacctgccaggagggcttcaccggcgacggcctgacctgcgtggacctggacgagtgcgccatccccggcgcccacaactgcagcgccaacagcagctgcgtgaacacccccggcagcttcagctgcgtgtgccccgagggcttcagactgagccccggcctgggctgcaccgacgtggacgagtgcgccgagcccggcctgagccactgccacgccctggccacctgcgtgaacgtggtgggcagctacctgtgcgtgtgccccgccggctacagaggcgacggctggcactgcgagtgcagccccggcagctgcggccccggcctggactgcgtgcccgagggcgacgccctggtgtgcgccgacccctgccaggcccacagaaccctggacgagtactggagaagcaccgagtacggcgagggctacgcctgcgacaccgacctgagaggctggtacagattcgtgggccagggcggcgccagaatggccgagacctgcgtgcccgtgctgagatgcaacaccgccgcccccatgtggctgaacggcacccaccccagcagcgacgagggcatcgtgagcagaaaggcctgcgcccactggagcggccactgctgcctgtgggacgccagcgtgcaggtgaaggcctgcgccggcggctactacgtgtacaacctgaccgccccccccgagtgccacctggcctactgcaccgaccccagcagcgtggagggcacctgcgaggagtgcagcatcgacgaggactgcaagagcaacaacggcagatggcactgccagtgcaagcaggacttcaacatcaccgacatcagcctgctggagcacagactggagtgcggcgccaacgacatgaaggtgagcctgggcaagtgccagctgaagagcctgggcttcgacaaggtgttcatgtacctgagcgacagcagatgcagcggcttcaacgacagagacaacagagactgggtgagcgtggtgacccccgccagagacggcccctgcggcaccgtgctgaccagaaacgagacccacgccacctacagcaacaccctgtacctggccgacgagatcatcatcagagacctgaacatcaagatcaacttcgcctgcagctaccccctggacatgaaggtgagcctgaagaccgccctgcagcccatggtgagcgccctgaacatcagagtgggcggcaccggcatgttcaccgtgagaatggccctgttccagacccccagctacacccagccctaccagggcagcagcgtgaccctgagcaccgaggccttcctgtacgtgggcaccatgctggacggcggcgacctgagcagattcgccctgctgatgaccaactgctacgccacccccagcagcaacgccaccgaccccctgaagtacttcatcatccaggacagatgcccccacaccagagacagcaccatccaggtggtggagaacggcgagagcagccagggcagattcagcgtgcagatgttcagattcgccggcaactacgacctggtgtacctgcactgcgaggtgtacctgtgcgacaccatgaacgagaagtgcaagcccacctgcagcggcaccagattcagaagcggcagcgtgatcgaccagagcagagtgctgaacctgggccccatcaccagaaagggcgtgcaggccaccgtgagcagagccttcagcagcctgggcctgctgaaggtgtggctgcccctgctgctgagcgccaccctgaccctgaccttccagtag

SEQ ID NO: 104776 - DNA, 2022 bp, Artificial Sequence
  Description of Artificial Sequence: Synthetic coding sequence
atgggccagcccagcctgacctggatgctgatggtggtggtggccagctggttcatcaccaccgccgccaccgacaccagcgaggccagaaccaagtacaactgccccgccagatggagctggagaaccccccagagaggcggcgacaccgagcagggccccgacgaggacttcaccagccagggcagatggtgcagcgagtgccacagcaacgccacctgcaccgaggacgaggccgtgaccacctgcacctgccaggagggcttcaccggcgacggcctgacctgcgtggacctggacgagtgcgccatccccggcgcccacaactgcagcgccaacagcagctgcgtgaacacccccggcagcttcagctgcgtgtgccccgagggcttcagactgagccccggcctgggctgcaccgacgtggacgagtgcgccgagcccggcctgagccactgccacgccctggccacctgcgtgaacgtggtgggcagctacctgtgcgtgtgccccgccggctacagaggcgacggctggcactgcgagtgcagccccggcagctgcggccccggcctggactgcgtgcccgagggcgacgccctggtgtgcgccgacccctgccaggcccacagaaccctggacgagtactggagaagcaccgagtacggcgagggctacgcctgcgacaccgacctgagaggctggtacagattcgtgggccagggcggcgccagaatggccgagacctgcgtgcccgtgctgagatgcaacaccgccgcccccatgtggctgaacggcacccaccccagcagcgacgagggcatcgtgagcagaaaggcctgcgcccactggagcggccactgctgcctgtgggacgccagcgtgcaggtgaaggcctgcgccggcggctactacgtgtacaacctgaccgccccccccgagtgccacctggcctactgcaccgaccccagcagcgtggagggcacctgcgaggagtgcagcatcgacgaggactgcaagagcaacaacggcagatggcactgccagtgcaagcaggacttcaacatcaccgacatcagcctgctggagcacagactggagtgcggcgccaacgacatgaaggtgagcctgggcaagtgccagctgaagagcctgggcttcgacaaggtgttcatgtacctgagcgacagcagatgcagcggcttcaacgacagagacaacagagactgggtgagcgtggtgacccccgccagagacggcccctgcggcaccgtgctgaccagaaacgagacccacgccacctacagcaacaccctgtacctggccgacgagatcatcatcagagacctgaacatcaagatcaacttcgcctgcagctaccccctggacatgaaggtgagcctgaagaccgccctgcagcccatggtgagcgccctgaacatcagagtgggcggcaccggcatgttcaccgtgagaatggccctgttccagacccccagctacacccagccctaccagggcagcagcgtgaccctgagcaccgaggccttcctgtacgtgggcaccatgctggacggcggcgacctgagcagattcgccctgctgatgaccaactgctacgccacccccagcagcaacgccaccgaccccctgaagtacttcatcatccaggacagatgcccccacaccagagacagcaccatccaggtggtggagaacggcgagagcagccagggcagattcagcgtgcagatgttcagattcgccggcaactacgacctggtgtacctgcactgcgaggtgtacctgtgcgacaccatgaacgagaagtgcaagcccacctgcagcggcaccagattcagaagcggcagcgtgatcgaccagagcagagtgctgaacctgggccccatcaccagaaagggcgtgcaggccaccgtgagcagagccttcagcagcctgggcctgctgaaggtgtggctgcccctgctgctgagcgccaccctgaccctgaccttccagtag

SEQ ID NO: 104777 - DNA, 1923 bp, Artificial Sequence; identical to SEQ ID NO: 104775
  Description of Artificial Sequence: Synthetic coding sequence

SEQ ID NO: 104778 - DNA, 1923 bp, Artificial Sequence; identical to SEQ ID NO: 104775
  Description of Artificial Sequence: Synthetic coding sequence

SEQ ID NO: 104779 - DNA, 2022 bp, Artificial Sequence; identical to SEQ ID NO: 104776
  Description of Artificial Sequence: Synthetic coding sequence

SEQ ID NO: 104780 - DNA, 1857 bp, Artificial Sequence
  Description of Artificial Sequence: Synthetic coding sequence
atgggccagcccagcctgacctggatgctgatggtggtggtggccagctggttcatcaccaccgccgccaccgacaccagcgaggccagatggtgcagcgagtgccacagcaacgccacctgcaccgaggacgaggccgtgaccacctgcacctgccaggagggcttcaccggcgacggcctgacctgcgtggacctggacgagtgcgccatccccggcgcccacaactgcagcgccaacagcagctgcgtgaacacccccggcagcttcagctgcgtgtgccccgagggcttcagactgagccccggcctgggctgcaccgacgtggacgagtgcgccgagcccggcctgagccactgccacgccctggccacctgcgtgaacgtggtgggcagctgcggccccggcctggactgcgtgcccgagggcgacgccctggtgtgcgccgacccctgccaggcccacagaaccctggacgagtactggagaagcaccgagtacggcgagggctacgcctgcgacaccgacctgagaggctggtacagattcgtgggccagggcggcgccagaatggccgagacctgcgtgcccgtgctgagatgcaacaccgccgcccccatgtggctgaacggcacccaccccagcagcgacgagggcatcgtgagcagaaaggcctgcgcccactggagcggccactgctgcctgtgggacgccagcgtgcaggtgaaggcctgcgccggcggctactacgtgtacaacctgaccgccccccccgagtgccacctggcctactgcaccgaccccagcagcgtggagggcacctgcgaggagtgcagcatcgacgaggactgcaagagcaacaacggcagatggcactgccagtgcaagcaggacttcaacatcaccgacatcagcctgctggagcacagactggagtgcggcgccaacgacatgaaggtgagcctgggcaagtgccagctgaagagcctgggcttcgacaaggtgttcatgtacctgagcgacagcagatgcagcggcttcaacgacagagacaacagagactgggtgagcgtggtgacccccgccagagacggcccctgcggcaccgtgctgaccagaaacgagacccacgccacctacagcaacaccctgtacctggccgacgagatcatcatcagagacctgaacatcaagatcaacttcgcctgcagctaccccctggacatgaaggtgagcctgaagaccgccctgcagcccatggtgagcgccctgaacatcagagtgggcggcaccggcatgttcaccgtgagaatggccctgttccagacccccagctacacccagccctaccagggcagcagcgtgaccctgagcaccgaggccttcctgtacgtgggcaccatgctggacggcggcgacctgagcagattcgccctgctgatgaccaactgctacgccacccccagcagcaacgccaccgaccccctgaagtacttcatcatccaggacagatgcccccacaccagagacagcaccatccaggtggtggagaacggcgagagcagccagggcagattcagcgtgcagatgttcagattcgccggcaactacgacctggtgtacctgcactgcgaggtgtacctgtgcgacaccatgaacgagaagtgcaagcccacctgcagcggcaccagattcagaagcggcagcgtgatcgaccagagcagagtgctgaacctgggccccatcaccagaaagggcgtgcaggccaccgtgagcagagccttcagcagcctgggcctgctgaaggtgtggctgcccctgctgctgagcgccaccctgaccctgaccttccagtag

SEQ ID NO: 104781 - DNA, 759 bp, Artificial Sequence
  Description of Artificial Sequence: Synthetic coding sequence
atggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggactgcccccccgtgagcgactacgtggtgctgaacgtgaccagcgacagcttccaggtgagctggagactgaacagcacccagaaccacaccttccacgtgagagtgtacagaggcatggagctgctgagaagcgccagaacccagagccaggccctggccgtggccggcctggaggccggcgtgctgtacagagtgaagaccagctaccagggctgcggcgccgacgtgagcaccaccctgaccatcaagaccaagtacgtgctggagaagctggacttccagagctag

SEQ ID NO: 104782 - DNA, 555 bp, Artificial Sequence
  Description of Artificial Sequence: Synthetic coding sequence
atggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggccagaggcctggagatccacctggagctgagagccaccagcaccagccacggcacccccctgagcagcgccgagaactgcctgtag

SEQ ID NO: 104783 - DNA, 3741 bp, Artificial Sequence
  Description of Artificial Sequence: Synthetic coding sequence
atggtgtacagaacccagtacctggtggtggaggtgcccgagagcagaaacgtgaccgactgctgcgagggctacgagcagctgggcctgtactgcgtgctgcccctgaaccagagcggccagttcaccagcagacccggcgcctgccccgccgagggccccgagcccagcaccagcccctgcagcctggacatcgactgccccggcctggagaagtgctgcccctggagcggcggcagatactgcatggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggactgcccccccgtgagcgactacgtggtgctgaacgtgaccagcgacagcttccaggtgagctggagactgaacagcacccagaaccacaccttccacgtgagagtgtacagaggcatggagctgctgagaagcgccagaacccagagccaggccctggccgtggccggcctggaggccggcgtgctgtacagagtgaagaccagctaccagggctgcggcgccgacgtgagcaccaccctgaccatcaagaccaacgcccaggtgttcgaggtgaccatcaagatcgtgaaccacaacctgaccgagaagctgctgaacagaagcagcgtggagtaccaggacttcagcagacagctgctgcacgaggtggagagcagcttcccccccgtggtgagcgacctgtacagaagcggcaagctgagaatgcagatcgtgagcctgcaggccggcagcgtggtggtgagactgaagctgaccgtgcaggaccccggcttccccatgggcatcagcaccctggcccccatcctgcagcccctgctggccagcaccgtgttccagatcgacagacagggcaccagagtgcaggactgggacgagtgcgtggacagcgccgagcacgactgcagccccgccgcctggtgcatcaacctggagggcagctacacctgccagtgcagaaccaccagagacgccacccccagcagagccggcagagcctgcgagggcgacctggtgagccccatgggcggcggcctgagcgccgccaccggcgtgaccgtgcccggcctgggcaccggcaccgccgccctgggcctggagaacttcaccctgagccccagccccggctacccccagggcacccccgccgccggccaggcctggacccccgagcccagccccagaagaggcggcagcaacgtggtgggctacgacagaaacaacaccggcaagggcgtggagcaggagctgcagggcaacagcatcatggagccccccagctggcccagccccaccgaggaccccaccggccacttcctgtggcacgccaccagaagcaccagagagaccctgctgaaccccacctggctgagaaacgaggacagcggccccagcggcagcgtggacctgcccctgaccagcaccctgaccgccctgaagacccccgcctgcgtgcccgtgagcatcggcagaatcatggtgagcaacgtgaccagcaccggcttccacctggcctgggaggccgacctggccatggacagcaccttccagctgaccctgaccagcatgtggagccccgccgtggtgctggagacctggaacaccagcgtgaccctgagcggcctggagcccggcgtgctgcacctggtggagatcatggccaaggcctgcggcaaggagggcgccagagcccacctgaaggtgagaaccgccgccagaaagctgatcggcaaggtgagaatcaagaacgtgagatacagcgagagcttcagaaacgccagcagccaggagtacagagacttcctggagctgttcttcagaatggtgagaggcagcctgcccgccaccatgtgccagcacatggacgccggcggcgtgagaatggaggtggtgagcgtgaccaacggcagcatcgtggtggagttccacctgctgatcatcgccgacgtggacgtgcaggaggtgagcgccgccttcctgaccgccttccagaccgtgcccctgctggaggtgatcagaggcgacaccttcatccaggactacgacgagtgcgagagaaaggaggacgactgcgtgcccggcaccagctgcagaaacaccctgggcagcttcacctgcagctgcgagggcggcgcccccgacttccccgtggagtacagcgagagaccctgcgagggcgacagccccggcaacgagacctgggccaccagccccgagagacccctgaccaccgccggcaccaaggccgccttcgtgcagggcaccagccccaccccccagggcctgccccagagactgaacctgaccggcgccgtgagagtgctgtgcgagatcgagaaggtggtggtggccatccagaagagattcctgcagcaggagagcatccccgagagcagcctgtacctgagccaccccagctgcaacgtgagccacagcaacggcacccacgtgctgctggaggccggctggagcgagtgcggcaccctgatgcagagcaacatgaccaacaccgtggtgagaaccaccctgagaaacgacctgagccaggagggcatcatccaccacctgaagatcctgagccccatctactgcgccttccagaacgacctgctgaccagcagcggcttcaccctggagtggggcgtgtacaccatcatcgaggacctgcacggcgccggcaacttcgtgaccgagatgcagctgttcatcggcgacagccccatcccccagaactacagcgtgagcgccagcgacgacgtgagaatcgaggtgggcctgtacagacagaagagcaacctgaaggtggtgctgaccgagtgctgggccacccccagcagcaacgccagagaccccatcaccttcagcttcatcaacaacagctgccccgtgcccaacacctacaccaacgtgatcgagaacggcaacagcaacaaggcccagttcaagctgagaatcttcagcttcatcaacgacagcatcgtgtacctgcactgcaagctgagagtgtgcatggagagccccggcgccacctgcaagatcaactgcaacaacttcagactgctgcagaacagcgagaccagcgccacccaccagatgagctggggccccctgatcagaagcgagggcgagcccccccacgccgaggccggcctgggcgccggctacgtggtgctgatcgtggtggccatcttcgtgctggtggccggcaccgccaccctgctgatcgtgagataccagagaatgaacggcagatacaacttcaagatccagagcaacaacttcagctaccaggtgttctacgagtag

SEQ ID NO: 104784 - DNA, 4125 bp, Artificial Sequence
  Description of Artificial Sequence: Synthetic coding sequence
atggtgtacagaacccagtacctggtggtggaggtgcccgagagcagaaacgtgaccgactgctgcgagggctacgagcagctgggcctgtactgcgtgctgcccctgaaccagagcggccagttcaccagcagacccggcgcctgccccgccgagggccccgagcccagcaccagcccctgcagcctggacatcgactgccccggcctggagaagtgctgcccctggagcggcggcagatactgcatggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggactgcccccccgtgagcgactacgtggtgctgaacgtgaccagcgacagcttccaggtgagctggagactgaacagcacccagaaccacaccttccacgtgagagtgtacagaggcatggagctgctgagaagcgccagaacccagagccaggccctggccgtggccggcctggaggccggcgtgctgtacagagtgaagaccagctaccagggctgcggcgccgacgtgagcaccaccctgaccatcaagaccaacgcccaggtgttcgaggtgaccatcaagatcgtgaaccacaacctgaccgagaagctgctgaacagaagcagcgtggagtaccaggacttcagcagacagctgctgcacgaggtggagagcagcttcccccccgtggtgagcgacctgtacagaagcggcaagctgagaatgcagatcgtgagcctgcaggccggcagcgtggtggtgagactgaagctgaccgtgcaggaccccggcttccccatgggcatcagcaccctggcccccatcctgcagcccctgctggccagcaccgtgttccagatcgacagacagggcaccagagtgcaggactgggacgagtgcgtggacagcgccgagcacgactgcagccccgccgcctggtgcatcaacctggagggcagctacacctgccagtgcagaaccaccagagacgccacccccagcagagccggcagagcctgcgagggcgacctggtgagccccatgggcggcggcctgagcgccgccaccggcgtgaccgtgcccggcctgggcaccggcaccgccgccctgggcctggagaacttcaccctgagccccagccccggctacccccagggcacccccgccgccggccaggcctggacccccgagcccagccccagaagaggcggcagcaacgtggtgggctacgacagaaacaacaccggcaagggcgtggagcaggaggtgcccagcaccgcccccggcctgggcatggaccagggcagccccagccaggtgaaccccagccagggcagccccagccagggcagcctgagacaggagagcaccagccaggccagccccagccagagaagcaccagccagggcagccccagccaggtgaaccccagccagagaagcaccagccacgccaacagcagccagggcagccccagccagggcagccccagccaggagagccccagccagggcagcaccagccaggccagccccagccacagaaacaccatcggcgtgatcggcaccaccagcagccccaaggccaccggcagcacccacagcttcccccccggcgccaccgacggccccctggccctgcccggccagctgcagggcaacagcatcatggagccccccagctggcccagccccaccgaggaccccaccggccacttcctgtggcacgccaccagaagcaccagagagaccctgctgaaccccacctggctgagaaacgaggacagcggccccagcggcagcgtggacctgcccctgaccagcaccctgaccgccctgaagacccccgcctgcgtgcccgtgagcatcggcagaatcatggtgagcaacgtgaccagcaccggcttccacctggcctgggaggccgacctggccatggacagcaccttccagctgaccctgaccagcatgtggagccccgccgtggtgctggagacctggaacaccagcgtgaccctgagcggcctggagcccggcgtgctgcacctggtggagatcatggccaaggcctgcggcaaggagggcgccagagcccacctgaaggtgagaaccgccgccagaaagctgatcggcaaggtgagaatcaagaacgtgagatacagcgagagcttcagaaacgccagcagccaggagtacagagacttcctggagctgttcttcagaatggtgagaggcagcctgcccgccaccatgtgccagcacatggacgccggcggcgtgagaatggaggtggtgagcgtgaccaacggcagcatcgtggtggagttccacctgctgatcatcgccgacgtggacgtgcaggaggtgagcgccgccttcctgaccgccttccagaccgtgcccctgctggaggtgatcagaggcgacaccttcatccaggactacgacgagtgcgagagaaaggaggacgactgcgtgcccggcaccagctgcagaaacaccctgggcagcttcacctgcagctgcgagggcggcgcccccgacttccccgtggagtacagcgagagaccctgcgagggcgacagccccggcaacgagacctgggccaccagccccgagagacccctgaccaccgccggcaccaaggccgccttcgtgcagggcaccagccccaccccccagggcctgccccagagactgaacctgaccggcgccgtgagagtgctgtgcgagatcgagaaggtggtggtggccatccagaagagattcctgcagcaggagagcatccccgagagcagcctgtacctgagccaccccagctgcaacgtgagccacagcaacggcacccacgtgctgctggaggccggctggagcgagtgcggcaccctgatgcagagcaacatgaccaacaccgtggtgagaaccaccctgagaaacgacctgagccaggagggcatcatccaccacctgaagatcctgagccccatctactgcgccttccagaacgacctgctgaccagcagcggcttcaccctggagtggggcgtgtacaccatcatcgaggacctgcacggcgccggcaacttcgtgaccgagatgcagctgttcatcggcgacagccccatcccccagaactacagcgtgagcgccagcgacgacgtgagaatcgaggtgggcctgtacagacagaagagcaacctgaaggtggtgctgaccgagtgctgggccacccccagcagcaacgccagagaccccatcaccttcagcttcatcaacaacagctgccccgtgcccaacacctacaccaacgtgatcgagaacggcaacagcaacaaggcccagttcaagctgagaatcttcagcttcatcaacgacagcatcgtgtacctgcactgcaagctgagagtgtgcatggagagccccggcgccacctgcaagatcaactgcaacaacttcagactgctgcagaacagcgagaccagcgccacccaccagatgagctggggccccctgatcagaagcgagggcgagcccccccacgccgaggccggcctgggcgccggctacgtggtgctgatcgtggtggccatcttcgtgctggtggccggcaccgccaccctgctgatcgtgagataccagagaatgaacggcagatacaacttcaagatccagagcaacaacttcagctaccaggtgttctacgagtag

SEQ ID NO: 104785 - DNA, 3957 bp, Artificial Sequence
  Description of Artificial Sequence: Synthetic coding sequence
atgctgagaaccagcggcctggccctgctggccctggtgagcgccgtgggccccagccaggccagcggcttcaccgagaagggcctgagcctgctgggctaccagctgtgcagccacagagtgacccacaccgtgcagaaggtggaggccgtgcagaccagctacaccagctacgtgagctgcggcggctggatcccctggagaagatgccccaagatggtgtacagaacccagtacctggtggtggaggtgcccgagagcagaaacgtgaccgactgctgcgagggctacgagcagctgggcctgtactgcgtgctgcccctgaaccagagcggccagttcaccagcagacccggcgcctgccccgccgagggccccgagcccagcaccagcccctgcagcctggacatcgactgccccggcctggagaagtgctgcccctggagcggcggcagatactgcatggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggactgcccccccgtgagcgactacgtggtgctgaacgtgaccagcgacagcttccaggtgagctggagactgaacagcacccagaaccacaccttccacgtgagagtgtacagaggcatggagctgctgagaagcgccagaacccagagccaggccctggccgtggccggcctggaggccggcgtgctgtacagagtgaagaccagctaccagggctgcggcgccgacgtgagcaccaccctgaccatcaagaccaacgcccaggtgttcgaggtgaccatcaagatcgtgaaccacaacctgaccgagaagctgctgaacagaagcagcgtggagtaccaggacttcagcagacagctgctgcacgaggtggagagcagcttcccccccgtggtgagcgacctgtacagaagcggcaagctgagaatgcagatcgtgagcctgcaggccggcagcgtggtggtgagactgaagctgaccgtgcaggaccccggcttccccatgggcatcagcaccctggcccccatcctgcagcccctgctggccagcaccgtgttccagatcgacagacagggcaccagagtgcaggactgggacgagtgcgtggacagcgccgagcacgactgcagccccgccgcctggtgcatcaacctggagggcagctacacctgccagtgcagaaccaccagagacgccacccccagcagagccggcagagcctgcgagggcgacctggtgagccccatgggcggcggcctgagcgccgccaccggcgtgaccgtgcccggcctgggcaccggcaccgccgccctgggcctggagaacttcaccctgagccccagccccggctacccccagggcacccccgccgccggccaggcctggacccccgagcccagccccagaagaggcggcagcaacgtggtgggctacgacagaaacaacaccggcaagggcgtggagcaggagctgcagggcaacagcatcatggagccccccagctggcccagccccaccgaggaccccaccggccacttcctgtggcacgccaccagaagcaccagagagaccctgctgaaccccacctggctgagaaacgaggacagcggccccagcggcagcgtggacctgcccctgaccagcaccctgaccgccctgaagacccccgcctgcgtgcccgtgagcatcggcagaatcatggtgagcaacgtgaccagcaccggcttccacctggcctgggaggccgacctggccatggacagcaccttccagctgaccctgaccagcatgtggagccccgccgtggtgctggagacctggaacaccagcgtgaccctgagcggcctggagcccggcgtgctgcacctggtggagatcatggccaaggcctgcggcaaggagggcgccagagcccacctgaaggtgagaaccgccgccagaaagctgatcggcaaggtgagaatcaagaacgtgagatacagcgagagcttcagaaacgccagcagccaggagtacagagacttcctggagctgttcttcagaatggtgagaggcagcctgcccgccaccatgtgccagcacatggacgccggcggcgtgagaatggaggtggtgagcgtgaccaacggcagcatcgtggtggagttccacctgctgatcatcgccgacgtggacgtgcaggaggtgagcgccgccttcctgaccgccttccagaccgtgcccctgctggaggtgatcagaggcgacaccttcatccaggactacgacgagtgcgagagaaaggaggacgactgcgtgcccggcaccagctgcagaaacaccctgggcagcttcacctgcagctgcgagggcggcgcccccgacttccccgtggagtacagcgagagaccctgcgagggcgacagccccggcaacgagacctgggccaccagccccgagagacccctgaccaccgccggcaccaaggccgccttcgtgcagggcaccagccccaccccccagggcctgccccagagactgaacctgaccggcgccgtgagagtgctgtgcgagatcgagaaggtggtggtggccatccagaagagattcctgcagcaggagagcatccccgagagcagcctgtacctgagccaccccagctgcaacgtgagccacagcaacggcacccacgtgctgctggaggccggctggagcgagtgcggcaccctgatgcagagcaacatgaccaacaccgtggtgagaaccaccctgagaaacgacctgagccaggagggcatcatccaccacctgaagatcctgagccccatctactgcgccttccagaacgacctgctgaccagcagcggcttcaccctggagtggggcgtgtacaccatcatcgaggacctgcacggcgccggcaacttcgtgaccgagatgcagctgttcatcggcgacagccccatcccccagaactacagcgtgagcgccagcgacgacgtgagaatcgaggtgggcctgtacagacagaagagcaacctgaaggtggtgctgaccgagtgctgggccacccccagcagcaacgccagagaccccatcaccttcagcttcatcaacaacagctgccccgtgcccaacacctacaccaacgtgatcgagaacggcaacagcaacaaggcccagttcaagctgagaatcttcagcttcatcaacgacagcatcgtgtacctgcactgcaagctgagagtgtgcatggagagccccggcgccacctgcaagatcaactgcaacaacttcagactgctgcagaacagcgagaccagcgccacccaccagatgagctggggccccctgatcagaagcgagggcgagcccccccacgccgaggccggcctgggcgccggctacgtggtgctgatcgtggtggccatcttcgtgctggtggccggcaccgccaccctgctgatcgtgagataccagagaatgaacggcagatacaacttcaagatccagagcaacaacttcagctaccaggtgttctacgagtag

SEQ ID NO: 104786 - DNA, 4341 bp, Artificial Sequence
  Description of Artificial Sequence: Synthetic coding sequence
atgctgagaaccagcggcctggccctgctggccctggtgagcgccgtgggccccagccaggccagcggcttcaccgagaagggcctgagcctgctgggctaccagctgtgcagccacagagtgacccacaccgtgcagaaggtggaggccgtgcagaccagctacaccagctacgtgagctgcggcggctggatcccctggagaagatgccccaagatggtgtacagaacccagtacctggtggtggaggtgcccgagagcagaaacgtgaccgactgctgcgagggctacgagcagctgggcctgtactgcgtgctgcccctgaaccagagcggccagttcaccagcagacccggcgcctgccccgccgagggccccgagcccagcaccagcccctgcagcctggacatcgactgccccggcctggagaagtgctgcccctggagcggcggcagatactgcatggcccccgccccccaggcccccgagagagaccccgtgggcagctggtacaacgtgaccatcctggtgaagatggacttcaaggagctgcagcaggtggaccccagactgctgaaccacatgagactgctgcacagcctggtgaccagcgccctgcagcccatggccagcaccgtgcaccacctgcacagcgcccccggcaacgccagcaccaccgtgagcagactgctgctgggcctgcccagacccctgcccgtggccgacgtgagcaccctgctgggcgacatcgccaagagagtgtacgaggtgatcagcgtgcaggtgcaggacgtgaacgagtgcttctacgaggagctgaacgcctgcagcggcagagagctgtgcgccaacctggagggcagctactggtgcgtgtgccaccaggaggcccccgccaccagccccagaaagctgaacctggagtgggaggactgcccccccgtgagcgactacgtggtgctgaacgtgaccagcgacagcttccaggtgagctggagactgaacagcacccagaaccacaccttccacgtgagagtgtacagaggcatggagctgctgagaagcgccagaacccagagccaggccctggccgtggccggcctggaggccggcgtgctgtacagagtgaagaccagctaccagggctgcggcgccgacgtgagcaccaccctgaccatcaagaccaacgcccaggtgttcgaggtgaccatcaagatcgtgaaccacaacctgaccgagaagctgctgaacagaagcagcgtggagtaccaggacttcagcagacagctgctgcacgaggtggagagcagcttcccccccgtggtgagcgacctgtacagaagcggcaagctgagaatgcagatcgtgagcctgcaggccggcagcgtggtggtgagactgaagctgaccgtgcaggaccccggcttccccatgggcatcagcaccctggcccccatcctgcagcccctgctggccagcaccgtgttccagatcgacagacagggcaccagagtgcaggactgggacgagtgcgtggacagcgccgagcacgactgcagccccgccgcctggtgcatcaacctggagggcagctacacctgccagtgcagaaccaccagagacgccacccccagcagagccggcagagcctgcgagggcgacctggtgagccccatgggcggcggcctgagcgccgccaccggcgtgaccgtgcccggcctgggcaccggcaccgccgccctgggcctggagaacttcaccctgagccccagccccggctacccccagggcacccccgccgccggccaggcctggacccccgagcccagccccagaagaggcggcagcaacgtggtgggctacgacagaaacaacaccggcaagggcgtggagcaggaggtgcccagcaccgcccccggcctgggcatggaccagggcagccccagccaggtgaaccccagccagggcagccccagccagggcagcctgagacaggagagcaccagccaggccagccccagccagagaagcaccagccagggcagccccagccaggtgaaccccagccagagaagcaccagccacgccaacagcagccagggcagccccagccagggcagccccagccaggagagccccagccagggcagcaccagccaggccagccccagccacagaaacaccatcggcgtgatcggcaccaccagcagccccaaggccaccggcagcacccacagcttcccccccggcgccaccgacggccccctggccctgcccggccagctgcagggcaacagcatcatggagccccccagctggcccagccccaccgaggaccccaccggccacttcctgtggcacgccaccagaagcaccagagagaccctgctgaaccccacctggctgagaaacgaggacagcggccccagcggcagcgtggacctgcccctgaccagcaccctgaccgccctgaagacccccgcctgcgtgcccgtgagcatcggcagaatcatggtgagcaacgtgaccagcaccggcttccacctggcctgggaggccgacctggccatggacagcaccttccagctgaccctgaccagcatgtggagccccgccgtggtgctggagacctggaacaccagcgtgaccctgagcggcctggagcccggcgtgctgcacctggtggagatcatggccaaggcctgcggcaaggagggcgccagagcccacctgaaggtgagaaccgccgccagaaagctgatcggcaaggtgagaatcaagaacgtgagatacagcgagagcttcagaaacgccagcagccaggagtacagagacttcctggagctgttcttcagaatggtgagaggcagcctgcccgccaccatgtgccagcacatggacgccggcggcgtgagaatggaggtggtgagcgtgaccaacggcagcatcgtggtggagttccacctgctgatcatcgccgacgtggacgtgcaggaggtgagcgccgccttcctgaccgccttccagaccgtgcccctgctggaggtgatcagaggcgacaccttcatccaggactacgacgagtgcgagagaaaggaggacgactgcgtgcccggcaccagctgcagaaacaccctgggcagcttcacctgcagctgcgagggcggcgcccccgacttccccgtggagtacagcgagagaccctgcgagggcgacagccccggcaacgagacctgggccaccagccccgagagacccctgaccaccgccggcaccaaggccgccttcgtgcagggcaccagccccaccccccagggcctgccccagagactgaacctgaccggcgccgtgagagtgctgtgcgagatcgagaaggtggtggtggccatccagaagagattcctgcagcaggagagcatccccgagagcagcctgtacctgagccaccccagctgcaacgtgagccacagcaacggcacccacgtgctgctggaggccggctggagcgagtgcggcaccctgatgcagagcaacatgaccaacaccgtggtgagaaccaccctgagaaacgacctgagccaggagggcatcatccaccacctgaagatcctgagccccatctactgcgccttccagaacgacctgctgaccagcagcggcttcaccctggagtggggcgtgtacaccatcatcgaggacctgcacggcgccggcaacttcgtgaccgagatgcagctgttcatcggcgacagccccatcccccagaactacagcgtgagcgccagcgacgacgtgagaatcgaggtgggcctgtacagacagaagagcaacctgaaggtggtgctgaccgagtgctgggccacccccagcagcaacgccagagaccccatcaccttcagcttcatcaacaacagctgccccgtgcccaacacctacaccaacgtgatcgagaacggcaacagcaacaaggcccagttcaagctgagaatcttcagcttcatcaacgacagcatcgtgtacctgcactgcaagctgagagtgtgcatggagagccccggcgccacctgcaagatcaactgcaacaacttcagactgctgcagaacagcgagaccagcgccacccaccagatgagctggggccccctgatcagaagcgagggcgagcccccccacgccgaggccggcctgggcgccggctacgtggtgctgatcgtggtggccatcttcgtgctggtggccggcaccgccaccctgctgatcgtgagataccagagaatgaacggcagatacaacttcaagatccagagcaacaacttcagctaccaggtgttctacgagtag

SEQ ID NO: 104787 - DNA, 234 bp, Artificial Sequence
  Description of Artificial Sequence: Synthetic coding sequence
cccgtgggcagctggtacaacgtgaccatcctggtgaagatggacttcaaggagctgcagcaggtggaccccagactgctgaaccacatgagactgctgcacagcctgatgagcatgagcgtgagcatgagaagcagcatgcccgccctggagggcaactgcgcccagacctggagagccagaaccggcgccagcgtgaccagaaagctgcagcccagactgcacggcagctag

SEQ ID NO: 104788 - DNA, 411 bp, Artificial Sequence
  Description of Artificial Sequence: Synthetic coding sequence
atgcagctgttcatcggcgacagccccatcccccagaactacagcgtgagcgccagcgacgacgtgagaatcgaggtgggcctgtacagacagaagagcaacctgaaggtggtgctgaccgagtgctgggccacccccagcagcaacgccagagaccccatcaccttcagcttcatcaacaacagctgccccgtgcccaacacctacaccaacgtgatcgagaacggcaacagcaacaaggcccagttcaagctgagaatcttcagcttcatcaacgacagcatcgtgtacctgcactgcaagctgagagtgtgcatggagagccccggcgccacctgcaagatcgccgccctgggcagaagaacccacgtggactggtgggccttccccatcagccagtggctgagctag

SEQ ID NO: 104789 - DNA, 1221 bp, Artificial Sequence
  Description of Artificial Sequence: Synthetic coding sequence
atgaagaagaagcagcagcaccccggcggcggcgccgacccctggccccacggcgcccccatgggcggcgccccccccggcctgggcagctggaagagaagagtgcccctgctgcccttcctgagattcagcctgagagactacggcttctgcatggccaccctgctggtgttctgcctgggcagcctgctgtaccagctgagcggcggcccccccagattcctgctggacctgagacagtacctgggcaacagcacctacctggacgaccacggccccccccccagcaaggtgctgcccttccccagccaggtggtgtacaacagagtgggcaagtgcggcagcagaaccgtggtgctgctgctgagaatcctgagcgagaagcacggcttcaacctggtgaccagcgacatccacaacaagaccagactgaccaagaacgagcagatggagctgatcaagaacatcagcaccgccgagcagccctacctgttcaccagacacgtgcacttcctgaacttcagcagattcggcggcgaccagcccgtgtacatcaacatcatcagagaccccgtgaacagattcctgagcaactacttcttcagaagattcggcgactggagaggcgagcagaaccacatgatcagaacccccagcatgagacaggaggagagatacctggacatcaacgagtgcatcctggagaactaccccgagtgcagcaaccccagactgttctacatcatcccctacttctgcggccagcaccccagatgcagagagcccggcgagtgggccctggagagagccaagctgaacgtgaacgagaacttcctgctggtgggcatcctggaggagctggaggacgtgctgctgctgctggagagattcctgccccactacttcaagggcgtgctgagcatctacaaggaccccgagcacagaaagctgggcaacatgaccgtgaccgtgaagaagaccgtgcccagccccgaggccgtgcagatcctgtaccagagaatgagatacgagtacgagttctaccactacgtgaaggagcagttccacctgctgaagagaaagttcggcctgaagagccacgtgagcaagccccccctgagaccccacttcttcatccccacccccctggagaccgaggagcccatcgacgacgaggagcaggacgacgagaagtggctggaggacatctacaagagatag

SEQ ID NO: 104790 - DNA, 2274 bp, Artificial Sequence
  Description of Artificial Sequence: Synthetic coding sequence
atggtgcccgacaccgcctgcgtgctgctgctgaccctggccgccctgggcgccagcggccagggccagagccccctgggcagcgacctgggcccccagatgctgagagagctgcaggagaccaacgccgccctgcaggacgtgagagagctgctgagacagcaggtgagagagatcaccttcctgaagaacaccgtgatggagtgcgacgcctgcggcatgcagcagagcgtgagaaccggcctgcccagcgtgagacccctgctgcactgcgcccccggcttctgcttccccggcgtggcctgcatccagaccgagagcggcgccagatgcggcccctgccccgccggcttcaccggcaacggcagccactgcaccgacgtgaacgagtgcaacgcccacccctgcttccccagagtgagatgcatcaacaccagccccggcttcagatgcgaggcctgcccccccggctacagcggccccacccaccagggcgtgggcctggccttcgccaaggccaacaagcaggtgtgcaccgacatcaacgagtgcgagaccggccagcacaactgcgtgcccaacagcgtgtgcatcaacaccagaggcagcttccagtgcggcccctgccagcccggcttcgtgggcgaccaggccagcggctgccagagaagagcccagagattctgccccgacggcagccccagcgagtgccacgagcacgccgactgcgtgctggagagagacggcagcagaagctgcgtgtgcgccgtgggctgggccggcaacggcatcctgtgcggcagagacaccgacctggacggcttccccgacgagaagctgagatgccccgagagacagtgcagaaaggacaactgcgtgaccgtgcccaacagcggccaggaggacgtggacagagacggcatcggcgacgcctgcgaccccgacgccgacggcgacggcgtgcccaacgagaaggacaactgccccctggtgagaaaccccgaccagagaaacaccgacgaggacaagtggggcgacgcctgcgacaactgcagaagccagaagaacgacgaccagaaggacaccgaccaggacggcagaggcgacgcctgcgacgacgacatcgacggcgacagaatcagaaaccaggccgacaactgccccagagtgcccaacagcgaccagaaggacagcgacggcgacggcatcggcgacgcctgcgacaactgcccccagaagagcaaccccgaccaggccgacgtggaccacgacttcgtgggcgacgcctgcgacagcgaccaggaccaggacggcgacggccaccaggacagcagagacaactgccccaccgtgcccaacagcgcccaggaggacagcgaccacgacggccagggcgacgcctgcgacgacgacgacgacaacgacggcgtgcccgacagcagagacaactgcagactggtgcccaaccccggccaggaggacgccgacagagacggcgtgggcgacgtgtgccaggacgacttcgacgccgacaaggtggtggacaagatcgacgtgtgccccgagaacgccgaggtgaccctgaccgacttcagagccttccagaccgtggtgctggaccccgagggcgacgcccagatcgaccccaactgggtggtgctgaaccagggcagagagatcgtgcagaccatgaacagcgaccccggcctggccgtgggctacaccgccttcaacggcgtggacttcgagggcaccttccacgtgaacaccgtgaccgacgacgactacgccggcttcatcttcggctaccaggacagcagcagcttctacgtggtgatgtggaagcagatggagcagacctactggcaggccaaccccttcagagccgtggccgagcccggcatccagctgaaggccgtgaagagcagcaccggccccggcgagcagctgagaaacgccctgtggcacaccggcgacaccgagagccaggtgagactgctgtggaaggaccccagaaacgtgggctggaaggacaagaagagctacagatggttcctgcagcacagaccccaggtgggctacatcagagtgagattctacgagggccccgagctggtggccgacagcaacgtggtgctggacaccaccatgagaggcggcagactgggcgtgttctgcttcagccaggagaacatcatctgggccaacctgagatacagatgcaacgacaccatccccgaggactacgagacccaccagctgagacaggcctag

SEQ ID NO: 104791 - DNA, 822 bp, Artificial Sequence
  Description of Artificial Sequence: Synthetic coding sequence
atggccagcgccgccgccgccgaggccgagaagggcagccccgtggtggtgggcctgctggtggtgggcaacatcatcatcctgctgagcggcctgagcctgttcgccgagaccatctgggtgaccgccgaccagtacagagtgtaccccctgatgggcgtgagcggcaaggacgacgtgttcgccggcgcctggatcgccatcttctgcggcttcagcttcttcatggtggccagcttcggcgtgggcgccgccctgtgcagaagaagaagcatggtgctgacctacctggtgctgatgctgatcgtgtacatcttcgagtgcgccagctgcatcaccagctacacccacagagactacatggtgagcaaccccagcctgatcaccaagcagatgctgaccttctacagcgccgacaccgaccagggccaggagctgaccagactgtgggacagagtgatgatcgagcaggagtgctgcggcaccagcggccccatggactgggtgaacttcaccagcgccttcagagccgccacccccgaggtggtgttcccctggccccccctgtgctgcagaagaaccggcaacttcatccccctgaacgaggagggctgcagactgggccacatggactacctgttcaccaaggccggcgtgcagtggcacaacctgagcagcctgcagagactgccccccggcttcaagggcttcagccacctgagcttccagagcagctgggactacagagccgccagcaacaccagcgccacccccagcaccgccaccagaggcgtgagcagaggcctgggcctgcccagctag

SEQ ID NO: 104792 - DNA, 783 bp, Artificial Sequence
  Description of Artificial Sequence: Synthetic coding sequence
atggccaaggacaacagcaccgtgagatgcttccagggcctgctgatcttcggcaacgtgatcatcggctgctgcggcatcgccctgaccgccgagtgcatcttcttcgtgagcgaccagcacagcctgtaccccctgctggaggccaccgacaacgacgacatctacggcgccgcctggatcggcatcttcgtgggcatctgcctgttctgcctgagcgtgctgggcatcgtgggcatcatgaagagcagcagaaagatcctgctggcctacttcatcctgatgttcatcgtgtacgccttcgaggtggccagctgcatcaccgccgccacccagcaggacttcttcacccccaacctgttcctgaagcagatgctggagagataccagaacaacagcccccccaacaacgacgaccagtggaagaacaacggcgtgaccaagacctgggacagactgatgctgcaggacaactgctgcggcgtgaacggccccagcgactggcagaagtacaccagcgccttcagaaccgagaacaacgacgccgactacccctggcccagacagtgctgcgtgatgaacaacctgaaggagcccctgaacctggaggcctgcaagctgggcgtgcccggcttctaccacaaccagggctgctacgagctgatcagcggccccatgaacagacacgcctggggcgtggcctggttcggcttcgccatcctgtgctggaccttctgggtgctgctgggcaccatgttctactggagcagaatcgagtactag

SEQ ID NO: 104793 - DNA, 510 bp, Artificial Sequence
  Description of Artificial Sequence: Synthetic coding sequence
atggccaaggacaacagcaccgtgagatgcttccagggcctgctgatcttcggcaacgtgatcatcggctgctgcggcatcgccctgaccgccgagtgcatcttcttcgtgagcgaccagcacagcctgtaccccctgctggaggccaccgacaacgacgacatctacggcgccgcctggatcggcatcttcgtgggcatctgcctgttctgcctgagcgtgctgggcatcgtgggcatcatgaagagcagcagaaagatcctgctggcctacttcatcctgatgttcatcgtgtacgccttcgaggtggccagctgcatcaccgccgccacccagcaggacttcttcacccccaacctgttcctgaagcagatgctggagagataccagaacaacagcccccccaacaacgacgaccagtggaagaacaacggcgtgaccaagacctgggacagactgatgctgcaggacaactgctgcggcgtgaacggccccagcgactggcagtag

SEQ ID NO: 104794 - DNA, 570 bp, Artificial Sequence
  Description of Artificial Sequence: Synthetic coding sequence
atggccaaggacaacagcaccgtgagatgcttccagggcctgctgatcttcggcaacgtgatcatcggctgctgcggcatcgccctgaccgccgagtgcatcttcttcgtgagcgaccagcacagcctgtaccccctgctggaggccaccgacaacgacgacatctacggcgccgcctggatcggcatcttcgtgggcatctgcctgttctgcctgagcgtgctgggcatcgtgggcatcatgaagagcagcagaaagatcctgctggcctacttcatcctgatgttcatcgtgtacgccttcgaggtggccagctgcatcaccgccgccacccagcaggacttcttcacccccaacctgttcctgaagcagatgctggagagataccagaacaacagcccccccaacaacgacgaccagtggaagaacaacggcgtgaccaagacctgggacagactgatgctgcaggacaactgctgcggcgtgaacggccccagcgactggcagaagtacaccagcgccttcagaaccgagaacaacgacgccgactacccctggcccagacagtag

SEQ ID NO: 104795 - DNA, 555 bp, Artificial Sequence
  Description of Artificial Sequence: Synthetic coding sequence
atggcccccctgctgcccatcagaaccctgcccctgatcctgatcctgctggccctgctgagccccggcgccgccgacttcaacatcagcagcctgagcggcctgctgagccccgccctgaccgagagcctgctggtggccctgcccccctgccacctgaccggcggcaacgccaccctgatggtgagaagagccaacgacagcaaggtggtgaccagcagcttcgtggtgcccccctgcagaggcagaagagagctggtgagcgtggtggacagcggcgccggcttcaccgtgaccagactgagcgcctaccaggtgaccaacctggtgcccggcaccaagttctacatcagctacctggtgaagaagggcaccgccaccgagagcagcagagagatccccatgagcaccctgcccagaagaaacatggagagcatcggcctgggcatggccagaaccggcggcatggtggtgatcaccgtgctgctgagcgtggccatgttcctgctggtgctgggcttcatcatcgccctggccctgggcagcagaaagtag

SEQ ID NO: 104796 - DNA, 333 bp, Artificial Sequence; identical to SEQ ID NO: 92518
  Description of Artificial Sequence: Synthetic coding sequence

SEQ ID NO: 104797 - DNA, 501 bp, Artificial Sequence
  Description of Artificial Sequence: Synthetic coding sequence
atgccccccctgtgggccctgctggccctgggctgcctgagattcggcagcgccgtgaacctgcagccccagctggccagcgtgaccttcgccaccaacaaccccaccctgaccaccgtggccctggagaagcccctgtgcatgttcgacagcaaggaggccctgaccggcacccacgaggtgtacctgtacgtgctggtggacagcgtgaccccctacagcaccatcgacacctggcccggcagaagaagcggcggcatgatcgtgatcaccagcatcctgggcagcctgcccttcttcctgctggtgggcttcgccggcgccatcgccctgagcctggtggacatgggcagcagcgacggcgagaccacccacgacagccagatcacccaggaggccgtgcccaagagcctgggcgccagcgagagcagctacaccagcgtgaacagaggcccccccctggacagagccgaggtgtacagcagcaagctgcaggactag

SEQ ID NO: 104798 - DNA, 963 bp, Artificial Sequence
  Description of Artificial Sequence: Synthetic coding sequence
atgggcctgccctggggccagccccacctgggcctgcagatgctgctgctggccctgaactgcctgagacccagcctgagcctgggcgagtggggcagctggatggacgccagcagccagacccagggcgccggcggccccgccggcgtgatcggcccctgggcccccgcccccctgagactgggcgaggccgcccccggcacccccacccccgtgagcgtggcccacctgctgagccccgtggccaccgagctggtgccctacaccccccagatcaccgcctgggacctggagggcaaggtgaccgccaccaccttcagcctggagcagcccagatgcgtgttcgacggcctggccagcgccagcgacaccgtgtggctggtggtggccttcagcaacgccagcagaggcttccagaaccccgagaccctggccgacatccccgccagcccccagctgctgaccgacggccactacatgaccctgcccctgagccccgaccagctgccctgcggcgaccccatggccggcagcggcggcgcccccgtgctgagagtgggccacgaccacggctgccaccagcagcccttctgcaacgcccccctgcccggccccggcccctacagagaggaccccagaatccacagacacctggccagagccgccaagtggcagcacgacagacactacctgcaccccctgttcagcggcagaccccccaccctgggcctgctgggcagcctgtaccacgccctgctgcagcccgtggtggccggcggcggccccggcgccgccgccgacagactgctgcacggccaggccctgcacgaccccccccaccccacccagagaggcagacacaccgccggcggcctgcaggcctggcccggcccccccccccagccccagcccctggcctggcccctgtgcatgggcctgggcgagatgggcagatgggagtag

SEQ ID NO: 104799 - DNA, 831 bp, Artificial Sequence
  Description of Artificial Sequence: Synthetic coding sequence
atgggcctgccctggggccagccccacctgggcctgcagatgctgctgctggccctgaactgcctgagacccagcctgagcctggagctggtgccctacaccccccagatcaccgcctgggacctggagggcaaggtgaccgccaccaccttcagcctggagcagcccagatgcgtgttcgacggcctggccagcgccagcgacaccgtgtggctggtggtggccttcagcaacgccagcagaggcttccagaaccccgagaccctggccgacatccccgccagcccccagctgctgaccgacggccactacatgaccctgcccctgagccccgaccagctgccctgcggcgaccccatggccggcagcggcggcgcccccgtgctgagagtgggccacgaccacggctgccaccagcagcccttctgcaacgcccccctgcccggccccggcccctacagagtgaagttcctgctgatggacaccagaggcagccccagagccgagaccaagtggagcgaccccatcaccctgcaccagggcaagacccccggcagcatcgacacctggcccggcagaagaagcggcagcatgatcgtgatcaccagcatcctgagcagcctggccggcctgctgctgctggccttcctggccgccagcaccatgagattcagcagcctgtggtggcccgaggaggcccccgagcagctgagaatcggcagcttcatgggcaagagatacatgacccaccacatcccccccagagaggccgccaccctgcccgtgggctgcaagcccggcctggaccccctgcccagcctgagcccctag

SEQ ID NO: 104800 - DNA, 963 bp, Artificial Sequence; identical to SEQ ID NO: 104798
  Description of Artificial Sequence: Synthetic coding sequence

SEQ ID NO: 104801 - DNA, 831 bp, Artificial Sequence; identical to SEQ ID NO: 104799
  Description of Artificial Sequence: Synthetic coding sequence

SEQ ID NO: 104802 - DNA, 963 bp, Artificial Sequence; identical to SEQ ID NO: 104798
  Description of Artificial Sequence: Synthetic coding sequence

SEQ ID NO: 104803 - DNA, 1104 bp, Artificial Sequence
  Description of Artificial Sequence: Synthetic coding sequence
atggaggccaacggcctgggcccccagggcttccccgagctgaagaacgacaccttcctgagagccgcctggggcgaggagaccgactacacccccgtgtggtgcatgagacaggccggcagatacctgcccgagttcagagagaccagagccgcccaggacttcttcagcacctgcagaagccccgaggcctgctgcgagctgaccctgcagcccctgagaagattccccctggacgccgccatcatcttcagcgacatcctggtggtgccccaggccctgggcatggaggtgaccatggtgcccggcaagggccccagcttccccgagcccctgagagaggagcaggacctggagagactgagagaccccgaggtggtggccagcgagctgggctacgtgttccaggccatcaccctgaccagacagagactggccggcagagtgcccctgatcggcttcgccggcgccccctggaccctgatgacctacatggtggagggcggcggcagcagcaccatggcccaggccaagagatggctgtaccagagaccccaggccagccaccagctgctgagaatcctgaccgacgccctggtgccctacctggtgggccaggtggtggccggcgcccaggccctgcagctgttcgagagccacgccggccacctgggcccccagctgttcaacaagttcgccctgccctacatcagagacgtggccaagcaggtgaaggccagactgagagaggccggcctggcccccgtgcccatgatcatcttcgccaaggacggccacttcgccctggaggagctggcccaggccggctacgaggtggtgggcctggactggaccgtggcccccaagaaggccagagagtgcgtgggcaagaccgtgaccctgcagggcaacctggacccctgcgccctgtacgccagcgaggaggagatcggccagctggtgaagcagatgctggacgacttcggcccccacagatacatcgccaacctgggccacggcctgtaccccgacatggaccccgagcacgtgggcgccttcgtggacgccgtgcacaagcacagcagactgctgagacagaactag

SEQ ID NO: 104804 - DNA, 582 bp, Artificial Sequence
  Description of Artificial Sequence: Synthetic coding sequence
atggaggccaacggcctgggcccccagggcttccccgagctgaagaacgacaccttcctgagagccgcctggggcgaggagaccgactacacccccgtgtggtgcatgagacaggccggcagatacctgcccgagttcagagagaccagagccgcccaggacttcttcagcacctgcagaagccccgaggcctgctgcgagctgaccctgcaggccctgggcatggaggtgaccatggtgcccggcaagggccccagcttccccgagcccctgagagaggagcaggacctggagagactgagagaccccgaggtggtggccagcgagctgggctacgtgttccaggccatcaccctgaccagacagagactggccggcagagtgcccctgatcggcttcgccggcgccccctggaccctgatgacctacatggtggagggcggcggcagcagcaccatggcccaggccaagagatggctgtaccagagaccccaggccagccaccagctgctgagaatcctgaccgacgccctggtgccctacctggtgggccaggtggtggccggcgcccaggccctgtag

SEQ ID NO: 104805 - DNA, 684 bp, Artificial Sequence
  Description of Artificial Sequence: Synthetic coding sequence
ccccagggcttccccgagctgaagaacgacaccttcctgagagccgcctggggcgaggagaccgactacacccccgtgtggtgcatgagacaggccggcagatacctgcccgagttcagagagaccagagccgcccaggacttcttcagcacctgcagaagccccgaggcctgctgcgagctgaccctgcagcccctgagaagattccccctggacgccgccatcatcttcagcgacatcctggtggtgccccaggccctgggcatggaggtgaccatggtgcccggcaagggccccagcttccccgagcccctgagagaggagcaggacctggagagactgagagaccccgaggtggtggccagcgagctgggctacgtgttccaggccatcaccctgaccagacagagactggccggcagagtgcccctgatcggcttcgccggcgcccccgccctgcagctgttcgagagccacgccggccacctgggcccccagctgttcaacaagttcgccctgccctacatcagagacgtggccaagcaggtgaaggccagactgagagaggccggcctggcccccgtgcccatgatcatcttcgccaaggacggccacttcgccctggaggagctggcccaggccggctacgaggtggtgggcctggactggaccgtggccccctag

SEQ ID NO: 104806 - DNA, 687 bp, Artificial Sequence
  Description of Artificial Sequence: Synthetic coding sequence
tgaccccagggcttccccgagctgaagaacgacaccttcctgagagccgcctggggcgaggagaccgactacacccccgtgtggtgcatgagacaggccggcagatacctgcccgagttcagagagaccagagccgcccaggacttcttcagcacctgcagaagccccgaggcctgctgcgagctgaccctgcagcccctgagaagattccccctggacgccgccatcatcttcagcgacatcctggtggtgccccaggccctgggcatggaggtgaccatggtgcccggcaagggccccagcttccccgagcccctgagagaggagcaggacctggagagactgagagaccccgaggtggtggccagcgagctgggctacgtgttccaggccatcaccctgaccagacagagactggccggcagagtgcccctgatcggcttcgccggcgcccccgccctgcagctgttcgagagccacgccggccacctgggcccccagctgttcaacaagttcgccctgccctacatcagagacgtggccaagcaggtgaaggccagactgagagaggccggcctggcccccgtgcccatgatcatcttcgccaaggacggccacttcgccctggaggagctggcccaggccggctacgaggtggtgggcctggactggaccgtggccccctag

SEQ ID NO: 104807 - DNA, 582 bp, Artificial Sequence; identical to SEQ ID NO: 104804
  Description of Artificial Sequence: Synthetic coding sequence

SEQ ID NO: 104808 - DNA, 402 bp, Artificial Sequence
  Description of Artificial Sequence: Synthetic coding sequence
atgaaggtgctgctgctgaaggacgccaaggaggacgactgcggccaggacccctacatcagagagctgggcctgtacggcctggaggccaccctgatccccgtgctgagcttcgagttcctgagcctgcccagcttcagcgagaagctgagccaccccgaggactacggcggcctgatcttcaccagccccagagccgtggaggccgccgagctgtgcctggagcagaacaacaagaccgaggtgtgggagagaagcctgaaggagaagtggaacgccaagagcgtgtacgtggtgggcaacgccaccgccagcctggtgagcaagatcggcctggacaccgagggcgagacctgcggcaacgccgagaagctggccgagtacatctgcagcagcaagtag

SEQ ID NO: 104809 - DNA, 420 bp, Artificial Sequence
  Description of Artificial Sequence: Synthetic coding sequence
atgaaggtgctgctgctgaaggacgccaaggaggacgactgcggccaggacccctacatcagagagctgggcctgtacggcctggaggccaccctgatccccgtgctgagcttcgagttcctgagcctgcccagcttcagcgagaagctgagccaccccgaggactacggcggcctgatcttcaccagccccagagccgtggaggccgccgagctgtgcctggagcagaacaacaagaccgaggtgtgggagagaagcctgaaggagaagtggaacgccaagagcgtgtacgtggtgggcaacgccaccgccagcctggtgagcaagatcggcctggacaccgagggcgagacctgcggcaacgccgagaagctggccgagtacatctgcagcagcgaggaggtgaagggcatcttctag

SEQ ID NO: 104810 - DNA, 798 bp, Artificial Sequence
  Description of Artificial Sequence: Synthetic coding sequence
atgaaggtgctgctgctgaaggacgccaaggaggacgactgcggccaggacccctacatcagagagctgggcctgtacggcctggaggccaccctgatccccgtgctgagcttcgagttcctgagcctgcccagcttcagcgagaagctgagccaccccgaggactacggcggcctgatcttcaccagccccagagccgtggaggccgccgagctgtgcctggagcagaacaacaagaccgaggtgtgggagagaagcctgaaggagaagtggaacgccaagagcgtgtacgtggtgggcaacgccaccgccagcctggtgagcaagatcggcctggacaccgagggcgagacctgcggcaacgccgagaagctggccgagtacatctgcagcagagagagcagcgccctgcccctgctgttcccctgcggcaacctgaagagagagatcctgcccaaggccctgaaggacaagggcatcgccatggagagcatcaccgtgtaccagaccgtggcccaccccggcatccagggcaacctgaacagctactacagccagcagggcgtgcccgccagcatcaccttcttcagccccagcggcctgacctacagcctgaagcacatccaggagctgagcggcgacaacatcgaccagatcaagttcgccgccatcggccccaccaccgccagagccctggccgcccagggcctgcccgtgagctgcaccgccgagagccccaccccccaggccctggccaccggcatcagaaaggccctgcagccccacggctgctgctag

SEQ ID NO: 104811 - DNA, 798 bp, Artificial Sequence; identical to SEQ ID NO: 104810
  Description of Artificial Sequence: Synthetic coding sequence

SEQ ID NO: 104812 - DNA, 558 bp, Artificial Sequence
  Description of Artificial Sequence: Synthetic coding sequence
atgaaggtgctgctgctgaaggacgccaaggaggacgactgcggccaggacccctacatcagactgagccaccccgaggactacggcggcctgatcttcaccagccccagagccgtggaggccgccgagctgtgcctggagcagaacaacaagaccgaggtgtgggagagaagcctgaaggagaagtggaacgccaagagcgtgtacgtggtgggcaacgccaccgccagcctggtgagcaagatcggcctggacaccgagggcgagacctgcggcaacgccgagaagctggccgagtacatctgcagcagagagagcagcgccctgcccctgctgttcccctgcggcaacctgaagagagagatcctgcccaaggccctgaaggacaagggcatcgccatggagagcatcaccgtgtaccagaccgtggcccaccccggcatccagggcaacctgaacagctactacagccagcagggcgtgcccgccagcatcaccttcttcagccccagcggcctgacctacagcctgaagcacatccaggagctgagcggctag

SEQ ID NO: 104813 - DNA, 2700 bp, Artificial Sequence
  Description of Artificial Sequence: Synthetic coding sequence
atggacagaaaggtggccagagagttcagacacaaggtggacttcctgatcgagaacgacgccgagaaggactacctgtacgacgtgctgagaatgtaccaccagaccatggacgtggccgtgctggtgggcgacctgaagctggtgatcaacgagcccagcagactgcccctgttcgacgccatcagacccctgatccccctgaagcaccaggtggagtacgaccagctgacccccagaagaagcagaaagctgaaggaggtgagactggacagactgcaccccgagggcctgggcctgagcgtgagaggcggcctggagttcggctgcggcctgttcatcagccacctgatcaagggcggccaggccgacagcgtgggcctgcaggtgggcgacgagatcgtgagaatcaacggctacagcatcagcagctgcacccacgaggaggtgatcaacctgatcagaaccaagaagaccgtgagcatcaaggtgagacacatcggcctgatccccgtgaagagcagccccgacgagcccctgacctggcagtacgtggaccagttcgtgagcgagagcggcggcgtgagaggcagcctgggcagccccggcaacagagagaacaaggagaagaaggtgttcatcagcctggtgggcagcagaggcctgggctgcagcatcagcagcggccccatccagaagcccggcatcttcatcagccacgtgaagcccggcagcctgagcgccgaggtgggcctggagatcggcgaccagatcgtggaggtgaacggcgtggacttcagcaacctggaccacaaggaggccgtgaacgtgctgaagagcagcagaagcctgaccatcagcatcgtggccgccgccggcagagagctgttcatgaccgacagagagagactggccgaggccagacagagagagctgcagagacaggagctgctgatgcagaagagactggccatggagagcaacaagatcctgcaggagcagcaggagatggagagacagagaagaaaggagatcgcccagaaggccgccgaggagaacgagagatacagaaaggagatggagcagatcgtggaggaggaggagaagttcaagaagcagtgggaggaggactggggcagcaaggagcagctgctgctgcccaagaccatcaccgccgaggtgcaccccgtgcccctgagaaagcccaagagcttcggctggttctacagatacgacggcaagttccccaccatcagaaagaagggcaaggacaagaagaaggccaagtacggcagcctgcaggacctgagaaagaacaagaaggagctggagttcgagcagaagctgtacaaggagaaggaggagatgctggagaaggagaagcagctgaagatcaacagactggcccaggaggtgagcgagaccgagagagaggacctggaggagagcgagaagatccagtactgggtggagagactgtgccagaccagactggagcagatcagcagcgccgacaacgagatcagcgagatgaccaccggcccccccccccccccccccagcgtgagccccctggccccccccctgagaagattcgccggcggcctgcacctgcacaccaccgacctggacgacatccccctggacatgttctactacccccccaagacccccagcgccctgcccgtgatgccccaccccccccccagcaaccccccccacaaggtgcccgccccccccgtgctgcccctgagcggccacgtgagcgccagcagcagcccctgggtgcagagaacccccccccccatccccatcccccccccccccagcgtgcccacccaggacctgacccccaccagacccctgcccagcgccctggaggaggccctgagcaaccaccccttcagaaccggcgacaccggcaaccccgtggaggactgggaggccaagaaccacagcggcaagcccaccaacagccccgtgcccgagcagagcttcccccccacccccaagaccttctgccccagcccccagccccccagaggccccggcgtgagcaccatcagcaagcccgtgatggtgcaccaggagcccaacttcatctacagacccgccgtgaagagcgaggtgctgccccaggagatgctgaagagaatggtggtgtaccagaccgccttcagacaggacttcagaaagtacgaggagggcttcgacccctacagcatgttcacccccgagcagatcatgggcaaggacgtgagactgctgagaatcaagaaggagggcagcctggacctggccctggagggcggcgtggacagccccatcggcaaggtggtggtgagcgccgtgtacgagagaggcgccgccgagagacacggcggcatcgtgaagggcgacgagatcatggccatcaacggcaagatcgtgaccgactacaccctggccgaggccgaggccgccctgcagaaggcctggaaccagggcggcgactggatcgacctggtggtggccgtgtgcccccccaaggagtacgacgacgagctggccagcctgcccagcagcgtggccgagagcccccagcccgtgagaaagctgctggaggacagagccgccgtgcacagacacggcttcctgctgcagctggagcccaccgacctgctgctgaagagcaagagaggcaaccagatccacagatag

SEQ ID NO: 104814 - DNA, 1659 bp, Artificial Sequence
  Description of Artificial Sequence: Synthetic coding sequence
atggacagaaaggtggccagagagttcagacacaaggtggacttcctgatcgagaacgacgccgagaaggactacctgtacgacgtgctgagaatgtaccaccagaccatggacgtggccgtgctggtgggcgacctgaagctggtgatcaacgagcccagcagactgcccctgttcgacgccatcagacccctgatccccctgaagcaccaggtggagtacgaccagctgacccccagaagaagcagaaagctgaaggaggtgagactggacagactgcaccccgagggcctgggcctgagcgtgagaggcggcctggagttcggctgcggcctgttcatcagccacctgatcaagggcggccaggccgacagcgtgggcctgcaggtgggcgacgagatcgtgagaatcaacggctacagcatcagcagctgcacccacgaggaggtgatcaacctgatcagaaccaagaagaccgtgagcatcaaggtgagacacatcggcctgatccccgtgaagagcagccccgacgagcccctgacctggcagtacgtggaccagttcgtgagcgagagcggcggcgtgagaggcagcctgggcagccccggcaacagagagaacaaggagaagaaggtgttcatcagcctggtgggcagcagaggcctgggctgcagcatcagcagcggccccatccagaagcccggcatcttcatcagccacgtgaagcccggcagcctgagcgccgaggtgggcctggagatcggcgaccagatcgtggaggtgaacggcgtggacttcagcaacctggaccacaaggaggccgtgaacgtgctgaagagcagcagaagcctgaccatcagcatcgtggccgccgccggcagagagctgttcatgaccgacagagagagactggccgaggccagacagagagagctgcagagacaggagctgctgatgcagaagagactggccatggagagcaacaagatcctgcaggagcagcaggagatggagagacagagaagaaaggagatcgcccagaaggccgccgaggagaacgagagatacagaaaggagatggagcagatcgtggaggaggaggagaagttcaagaagcagtgggaggaggactggggcagcaaggagcagctgctgctgcccaagaccatcaccgccgaggtgcaccccgtgcccctgagaaagcccaagtacgaccagggcgtggagcccgagctggagcccgccgacgacctggacggcggcaccgaggagcagggcgagcaggacttcagaaagtacgaggagggcttcgacccctacagcatgttcacccccgagcagatcatgggcaaggacgtgagactgctgagaatcaagaaggagggcagcctggacctggccctggagggcggcgtggacagccccatcggcaaggtggtggtgagcgccgtgtacgagagaggcgccgccgagagacacggcggcatcgtgaagggcgacgagatcatggccatcaacggcaagatcgtgaccgactacaccctggccgaggccgaggccgccctgcagaaggcctggaaccagggcggcgactggatcgacctggtggtggccgtgtgcccccccaaggagtacgacgacgagctgaccttcttctag

SEQ ID NO: 104815 - DNA, 1602 bp, Artificial Sequence
  Description of Artificial Sequence: Synthetic coding sequence
atggacagaaaggtggccagagagttcagacacaaggtggacttcctgatcgagaacgacgccgagaaggactacctgtacgacgtgctgagaatgtaccaccagaccatggacgtggccgtgctggtgggcgacctgaagctggtgatcaacgagcccagcagactgcccctgttcgacgccatcagacccctgatccccctgaagcaccaggtggagtacgaccagctgacccccagaagaagcagaaagctgaaggaggtgagactggacagactgcaccccgagggcctgggcctgagcgtgagaggcggcctggagttcggctgcggcctgttcatcagccacctgatcaagggcggccaggccgacagcgtgggcctgcaggtgggcgacgagatcgtgagaatcaacggctacagcatcagcagctgcacccacgaggaggtgatcaacctgatcagaaccaagaagaccgtgagcatcaaggtgagacacatcggcctgatccccgtgaagagcagccccgacgagcccctgacctggcagtacgtggaccagttcgtgagcgagagcggcggcgtgagaggcagcctgggcagccccggcaacagagagaacaaggagaagaaggtgttcatcagcctggtgggcagcagaggcctgggctgcagcatcagcagcggccccatccagaagcccggcatcttcatcagccacgtgaagcccggcagcctgagcgccgaggtgggcctggagatcggcgaccagatcgtggaggtgaacggcgtggacttcagcaacctggaccacaaggagggcagagagctgttcatgaccgacagagagagactggccgaggccagacagagagagctgcagagacaggagctgctgatgcagaagagactggccatggagagcaacaagatcctgcaggagcagcaggagatggagagacagagaagaaaggagatcgcccagaaggccgccgaggagaacgagagatacagaaaggagatggagcagatcgtggaggaggaggagaagttcaagaagcagtgggaggaggactggggcagcaaggagcagctgctgctgcccaagaccatcaccgccgaggtgcaccccgtgcccctgagaaagcccaagtacgaccagggcgtggagcccgagctggagcccgccgacgacctggacggcggcaccgaggagcagggcgagcaggacttcagaaagtacgaggagggcttcgacccctacagcatgttcacccccgagcagatcatgggcaaggacgtgagactgctgagaatcaagaaggagggcagcctggacctggccctggagggcggcgtggacagccccatcggcaaggtggtggtgagcgccgtgtacgagagaggcgccgccgagagacacggcggcatcgtgaagggcgacgagatcatggccatcaacggcaagatcgtgaccgactacaccctggccgaggccgaggccgccctgcagaaggcctggaaccagggcggcgactggatcgacctggtggtggccgtgtgcccccccaaggagtacgacgacgagctgaccttcttctag

SEQ ID NO: 104816 - DNA, 1566 bp, Artificial Sequence
  Description of Artificial Sequence: Synthetic coding sequence
atgtaccaccagaccatggacgtggccgtgctggtgggcgacctgaagctggtgatcaacgagcccagcagactgcccctgttcgacgccatcagacccctgatccccctgaagcaccaggtggagtacgaccagctgacccccagaagaagcagaaagctgaaggaggtgagactggacagactgcaccccgagggcctgggcctgagcgtgagaggcggcctggagttcggctgcggcctgttcatcagccacctgatcaagggcggccaggccgacagcgtgggcctgcaggtgggcgacgagatcgtgagaatcaacggctacagcatcagcagctgcacccacgaggaggtgatcaacctgatcagaaccaagaagaccgtgagcatcaaggtgagacacatcggcctgatccccgtgaagagcagccccgacgagcccctgacctggcagtacgtggaccagttcgtgagcgagagcggcggcgtgagaggcagcctgggcagccccggcaacagagagaacaaggagaagaaggtgttcatcagcctggtgggcagcagaggcctgggctgcagcatcagcagcggccccatccagaagcccggcatcttcatcagccacgtgaagcccggcagcctgagcgccgaggtgggcctggagatcggcgaccagatcgtggaggtgaacggcgtggacttcagcaacctggaccacaaggaggccgtgaacgtgctgaagagcagcagaagcctgaccatcagcatcgtggccgccgccggcagagagctgttcatgaccgacagagagagactggccgaggccagacagagagagctgcagagacaggagctgctgatgcagaagagactggccatggagagcaacaagatcctgcaggagcagcaggagatggagagacagagaagaaaggagatcgcccagaaggccgccgaggagaacgagagatacagaaaggagatggagcagatcgtggaggaggaggagaagttcaagaagcagtgggaggaggactggggcagcaaggagcagctgctgctgcccaagaccatcaccgccgaggtgcaccccgtgcccctgagaaagcccaagtacgaccagggcgtggagcccgagctggagcccgccgacgacctggacggcggcaccgaggagcagggcgagcaggacttcagaaagtacgaggagggcttcgacccctacagcatgttcacccccgagcagatcatgggcaaggacgtgagactgctgagaatcaagaaggagggcagcctggacctggccctggagggcggcgtggacagccccatcggcaaggtggtggtgagcgccgtgtacgagagaggcgccgccgagagacacggcggcatcgtgaagggcgacgagatcatggccatcaacggcaagatcgtgaccgactacaccctggccgaggccgaggccgccctgcagaaggcctggaaccagggcggcgactggatcgacctggtggtggccgtgtgcccccccaaggagtacgacgacgagctgaccttcttctag

SEQ ID NO: 104817 - DNA, 2112 bp, Artificial Sequence
  Description of Artificial Sequence: Synthetic coding sequence
atgagcgccagagccaccagacccagaagcagaagaggcagacacgccccccccggcgagctggaccccgtggccgagagcagcgaggaggtggaggccgccagcggcagcagcaagcccagcttcgcccccccccccgtgagcagcggcctggagcagctgggccccatggaggaggtgagcggccagggcctgggcagcagaaccgacaagaagatggacggcggcagcggcagagagctggccagcgcccccgaggtgccccacaagcccgccgtggaggcccaccaggcccccgaggccgccctgcagtacaaggagaccgtgccccccggcaacggcgcccccgacgtgttccagaccctgcagcacaccctgagcagcctggaggccgccgccgccgcctggagacaccagccccccagccacagcggccccatggagttcgagggcaccagcgagggcggcgccggcagcctgggcaagcaggagggcgccggcagctgccagagagaggccgccagactggccgagagaaacgcctggctgagactggccctgagcagcagagaggacgagctggtgagaacccaggccagcctggaggccatcagagccgagaaggagaccctgcagaaggaggtgcaggagctgcaggacagcctgctgagactggagccctgcccccacctgagccacaaccaggccggcggcagcggcagcggcagcagcagcagcgaggccgacagagagccctgggagacccaggacagcttcagcctggcccaccccctgctgagaagactgagaagccacagcagcacccagatcctgggcagcctgcccaaccagcccctgagccccgagatgcacatcatggaggcccagatggagcagctgagaggcagcatcgagaagctgaagtgcttcaacagactgctgagcgccgtgctgcagggctacaagggcagatgcgagggcctgagcatgcagctgggccagagagaggccgaggccaccgccctgcacctggccctgcagtacagcgagcactgcgaggaggcctacagagtgctgctggccctgagagaggccgacagcggcgccggcgacgaggcccccatgagcgacctgcaggccgccgagaaggaggcctggagactgctggcccaggaggaggccgccatggacgccggcgcccagcagaacccccagcccagccccgagggcagcagcgtggacaagcccaccccccaggaggtggccttccagctgagaagctacgtgcagagactgcaggagagaagaagcctgatgaagatcctgagcgagcccggccccaccctggcccccatgcccaccgtgcccagagccgaggccatggtgcaggccatcctgggcacccaggccggccccgccctgcccagactggagaagacccagatccagcaggacctggtggccgccagagaggccctggccgacctgatgctgagactgcagctggtgagaagagagaagagaggcctggagctgagagaggccgccctgagagccctgggccccgcccacgtgctgctgctggagcagctgagatgggagagagccgagctgcaggccggcggcgccaacagcagcggcggccacagcagcggcggcggcagcagcggcgacgaggaggagtggtaccagggcctgcccgccgtgcccggcggcaccagcggcatcgacggcggccaggtgggcagagcctgggaccccgagaagctggcccaggagctggccgccagcctgaccagaaccctggacctgcaggagcagctgcagagcctgagaagagagctggagcaggtggcccagaagggcagagccagaagaagccagagcgccgagctgaacagagacctgtgcaaggcccacagcgccctggtgctggccttcagaggcgcccacagaaagcaggaggagcagagaagaaagctggagcagcagatggccctgatggaggcccagcaggccgaggaggtggccgtgctggaggccaccgccagagccctgggcaagcccagaccccccctgccccccccccagctgggcgacaccttcctgtag

SEQ ID NO: 104818 - DNA, 1152 bp, Artificial Sequence
  Description of Artificial Sequence: Synthetic coding sequence
atgagcgccagagccaccagacccagaagcagaagaggcagacacgccccccccggcgagctggaccccgtggccgagagcagcgaggaggtggaggccgccagcggcagcagcaagcccagcttcgcccccccccccgtgagcagcggcctggagcagctgggccccatggaggaggtgagcggccagggcctgggcagcagaaccgacaagaagatggacggcggcagcggcagagagctggccagcgcccccgaggtgccccacaagcccgccgtggaggcccaccaggcccccgaggccgccctgcagtacaaggagaccgtgccccccggcaacggcgcccccgacgtgttccagaccctgcagcacaccctgagcagcctggaggccgccgccgccgcctggagacaccagccccccagccacagcggccccatggagttcgagggcaccagcgagggcggcgccggcagcctgggcaagcaggagggcgccggcagctgccagagagaggccgccagactggccgagagaaacgcctggctgagactggccctgagcagcagagaggacgagctggtgagaacccaggccagcctggaggccatcagagccgagaaggagaccctgcagaaggaggtgcaggagctgcaggacagcctgctgagactggagccctgcccccacctgagccacaaccaggccggcggcagcggcagcggcagcagcagcagcgaggccgacagagagccctgggagacccaggacagcttcagcctggcccaccccctgctgagaagactgagaagccacagcagcacccagatcctgggcagcctgcccaaccagcccctgagccccgagatgcacatcatggaggcccagatggagcagctgagaggcagcatcgagaagctgaagtgcttcaacagactgctgagcgccgtgctgcagggctacaagggcagatgcgagggcctgagcatgcagctgggccagagagaggccgaggccaccgccctgcacctggccctgcagtacagagtgctgctgtgccaccccggctggagcgccgtggtgcccagctggctgaccgccaccagcgccagccccgtgcaggtgatcctgctgccccagccccccgagtag

SEQ ID NO: 104819 - DNA, 1920 bp, Artificial Sequence
  Description of Artificial Sequence: Synthetic coding sequence
atgctgcaccccaccgacaagaagatggacggcggcagcggcagagagctggccagcgcccccgaggtgccccacaagcccgccgtggaggcccaccaggcccccgaggccgccctgcagtacaaggagaccgtgccccccggcaacggcgcccccgacgtgttccagaccctgcagcacaccctgagcagcctggaggccgccgccgccgcctggagacaccagccccccagccacagcggccccatggagttcgagggcaccagcgagggcggcgccggcagcctgggcaagcaggagggcgccggcagctgccagagagaggccgccagactggccgagagaaacgcctggctgagactggccctgagcagcagagaggacgagctggtgagaacccaggccagcctggaggccatcagagccgagaaggagaccctgcagaaggaggtgcaggagctgcaggacagcctgctgagactggagccctgcccccacctgagccacaaccaggccggcggcagcggcagcggcagcagcagcagcgaggccgacagagagccctgggagacccaggacagcttcagcctggcccaccccctgctgagaagactgagaagccacagcagcacccagatcctgggcagcctgcccaaccagcccctgagccccgagatgcacatcatggaggcccagatggagcagctgagaggcagcatcgagaagctgaagtgcttcaacagactgctgagcgccgtgctgcagggctacaagggcagatgcgagggcctgagcatgcagctgggccagagagaggccgaggccaccgccctgcacctggccctgcagtacagcgagcactgcgaggaggcctacagagtgctgctggccctgagagaggccgacagcggcgccggcgacgaggcccccatgagcgacctgcaggccgccgagaaggaggcctggagactgctggcccaggaggaggccgccatggacgccggcgcccagcagaacccccagcccagccccgagggcagcagcgtggacaagcccaccccccaggaggtggccttccagctgagaagctacgtgcagagactgcaggagagaagaagcctgatgaagatcctgagcgagcccggccccaccctggcccccatgcccaccgtgcccagagccgaggccatggtgcaggccatcctgggcacccaggccggccccgccctgcccagactggagaagacccagatccagcaggacctggtggccgccagagaggccctggccgacctgatgctgagactgcagctggtgagaagagagaagagaggcctggagctgagagaggccgccctgagagccctgggccccgcccacgtgctgctgctggagcagctgagatgggagagagccgagctgcaggccggcggcgccaacagcagcggcggccacagcagcggcggcggcagcagcggcgacgaggaggagtggtaccagggcctgcccgccgtgcccggcggcaccagcggcatcgacggcggccaggtgggcagagcctgggaccccgagaagctggcccaggagctggccgccagcctgaccagaaccctggacctgcaggagcagctgcagagcctgagaagagagctggagcaggtggcccagaagggcagagccagaagaagccagagcgccgagctgaacagagacctgtgcaaggcccacagcgccctggtgctggccttcagaggcgcccacagaaagcaggaggagcagagaagaaagctggagcagcagatggccctgatggaggcccagcaggccgaggaggtggccgtgctggaggccaccgccagagccctgggcaagcccagaccccccctgccccccccccagctgggcgacaccttcctgtag

SEQ ID NO: 104820 - DNA, 1386 bp, Artificial Sequence
  Description of Artificial Sequence: Synthetic coding sequence
atgaacgaccagtaccacagagccgccagagacggctacctggagctgctgaaggaggccaccagaaaggagctgaacgcccccgacgaggacggcatgacccccaccctgtgggccgcctaccacggcaacctggagagcctgagactgatcgtgagcagaggcggcgaccccgacaagtgcgacatctggggcaacacccccctgcacctggccgccagcaacggccacctgcactgcctgagcttcctggtgagcttcggcgccaacatctggtgcctggacaacgactaccacacccccctggacatggccgccatgaagggccacatggagtgcgtgagatacctggacagcatcgccgccaagcagagcagcctgaaccccaagctggtgggcaagctgaaggacaaggccttcagagaggccgagagaagaatcagagagtgcgccaagctgcagagaagacaccacgagagaatggagagaagatacagaagagagctggccgagagaagcgacaccctgagcttcagcagcctgaccagcagcaccctgagcagaagactgcagcacctggccctgggcagccacctgccctacagccaggccaccctgcacggcaccgccagaggcaagaccaagatgcagaagaagctggagagaagaaagcagggcggcgagggcaccttcaaggtgagcgaggacggcagaaagagcgccagaagcctgagcggcctgcagctgggcagcgacgtgatgttcgtgagacagggcacctacgccaaccccaaggagtggggcagagcccccctgagagacatgttcctgagcgacgaggacagcgtgagcagagccaccctggccgccgagcccgcccacagcgaggtgagcaccgacagcggccacgacagcctgttcaccagacccggcctgggcaccatggtgttcagaagaaactacctgagcagcggcctgcacggcctgggcagagaggacggcggcctggacggcgtgggcgcccccagaggcagactgcagagcagccccagcctggacgacgacagcctgggcagcgccaacagcctgcaggacagaagctgcggcgaggagctgccctgggacgagctggacctgggcctggacgaggacctggagcccgagaccagccccctggagaccttcctggccagcctgcacatggaggacttcgccgccctgctgagacaggagaagatcgacctggaggccctgatgctgtgcagcgacctggacctgagaagcatcagcgtgcccctgggccccagaaagaagatcctgggcgccgtgagaagaagaagacaggccatggagagaccccccgccctggaggacaccgagctgtag

SEQ ID NO: 104821 - DNA, 15609 bp, Artificial Sequence
  Description of Artificial Sequence: Synthetic coding sequence
atgaactgccccgtgctgagcctgggcagcggcttcctgttccaggtgatcgagatgctgatcttcgcctacttcgccagcatcagcctgaccgagagcagaggcctgttccccagactggagaacgtgggcgccttcaagaaggtgagcatcgtgcccacccaggccgtgtgcggcctgcccgacagaagcaccttctgccacagcagcgccgccgccgagagcatccagttctgcacccagagattctgcatccaggactgcccctacagaagcagccaccccacctacaccgccctgttcagcgccggcctgagcagctgcatcacccccgacaagaacgacctgcaccccaacgcccacagcaacagcgccagcttcatcttcggcaaccacaagagctgcttcagcagcccccccagccccaagctgatggccagcttcaccctggccgtgtggctgaagcccgagcagcagggcgtgatgtgcgtgatcgagaagaccgtggacggccagatcgtgttcaagctgaccatcagcgagaaggagaccatgttctactacagaaccgtgaacggcctgcagccccccatcaaggtgatgaccctgggcagaatcctggtgaagaagtggatccacctgagcgtgcaggtgcaccagaccaagatcagcttcttcatcaacggcgtggagaaggaccacacccccttcaacgccagaaccctgagcggcagcatcaccgacttcgccagcggcaccgtgcagatcggccagagcctgaacggcctggagcagttcgtgggcagaatgcaggacttcagactgtaccaggtggccctgaccaacagagagatcctggaggtgttcagcggcgacctgctgagactgcacgcccagagccactgcagatgccccggcagccaccccagagtgcaccccctggcccagagatactgcatccccaacgacgccggcgacaccgccgacaacagagtgagcagactgaaccccgaggcccaccccctgagcttcgtgaacgacaacgacgtgggcaccagctgggtgagcaacgtgttcaccaacatcacccagctgaaccagggcgtgaccatcagcgtggacctggagaacggccagtaccaggtgttctacatcatcatccagttcttcagcccccagcccaccgagatcagaatccagagaaagaaggagaacagcctggactgggaggactggcagtacttcgccagaaactgcggcgccttcggcatgaagaacaacggcgacctggagaagcccgacagcgtgaactgcctgcagctgagcaacttcaccccctacagcagaggcaacgtgaccttcagcatcctgacccccggccccaactacagacccggctacaacaacttctacaacacccccagcctgcaggagttcgtgaaggccacccagatcagattccacttccacggccagtactacaccaccgagaccgccgtgaacctgagacacagatactacgccgtggacgagatcaccatcagcggcagatgccagtgccacggccacgccgacaactgcgacaccaccagccagccctacagatgcctgtgcagccaggagagcttcaccgagggcctgcactgcgacagatgcctgcccctgtacaacgacaagcccttcagacagggcgaccaggtgtacgccttcaactgcaagccctgccagtgcaacagccacagcaagagctgccactacaacatcagcgtggaccccttccccttcgagcacttcagaggcggcggcggcgtgtgcgacgactgcgagcacaacaccaccggcagaaactgcgagctgtgcaaggactacttcttcagacaggtgggcgccgaccccagcgccatcgacgtgtgcaagccctgcgactgcgacaccgtgggcaccagaaacggcagcatcctgtgcgaccagatcggcggccagtgcaactgcaagagacacgtgagcggcagacagtgcaaccagtgccagaacggcttctacaacctgcaggagctggaccccgacggctgcagcccctgcaactgcaacaccagcggcaccgtggacggcgacatcacctgccaccagaacagcggccagtgcaagtgcaaggccaacgtgatcggcctgagatgcgaccactgcaacttcggcttcaagttcctgagaagcttcaacgacgtgggctgcgagccctgccagtgcaacctgcacggcagcgtgaacaagttctgcaacccccacagcggccagtgcgagtgcaagaaggaggccaagggcctgcagtgcgacacctgcagagagaacttctacggcctggacgtgaccaactgcaaggcctgcgactgcgacaccgccggcagcctgcccggcaccgtgtgcaacgccaagaccggccagtgcatctgcaagcccaacgtggagggcagacagtgcaacaagtgcctggagggcaacttctacctgagacagaacaacagcttcctgtgcctgccctgcaactgcgacaagaccggcaccatcaacggcagcctgctgtgcaacaagagcaccggccagtgcccctgcaagctgggcgtgaccggcctgagatgcaaccagtgcgagccccacagatacaacctgaccatcgacaacttccagcactgccagatgtgcgagtgcgacagcctgggcaccctgcccggcaccatctgcgaccccatcagcggccagtgcctgtgcgtgcccaacagacagggcagaagatgcaaccagtgccagcccggcttctacatcagccccggcaacgccaccggctgcctgccctgcagctgccacaccaccggcgccgtgaaccacatctgcaacagcctgaccggccagtgcgtgtgccaggacgccagcatcgccggccagagatgcgaccagtgcaaggaccactacttcggcttcgacccccagaccggcagatgccagccctgcaactgccacctgagcggcgccctgaacgagacctgccacctggtgaccggccagtgcttctgcaagcagttcgtgaccggcagcaagtgcgacgcctgcgtgcccagcgccagccacctggacgtgaacaacctgctgggctgcagcaagacccccttccagcagcccccccccagaggccaggtgcagagcagcagcgccatcaacctgagctggagcccccccgacagccccaacgcccactggctgacctacagcctgctgagagacggcttcgagatctacaccaccgaggaccagtacccctacagcatccagtacttcctggacaccgacctgctgccctacaccaagtacagctactacatcgagaccaccaacgtgcacggcagcaccagaagcgtggccgtgacctacaagaccaagcccggcgtgcccgagggcaacctgaccctgagctacatcatccccatcggcagcgacagcgtgaccctgacctggaccaccctgagcaaccagagcggccccatcgagaagtacatcctgagctgcgcccccctggccggcggccagccctgcgtgagctacgagggccacgagaccagcgccaccatctggaacctggtgcccttcgccaagtacgacttcagcgtgcaggcctgcaccagcggcggctgcctgcacagcctgcccatcaccgtgaccaccgcccaggcccccccccagagactgagcccccccaagatgcagaagatcagcagcaccgagctgcacgtggagtggagcccccccgccgagctgaacggcatcatcatcagatacgagctgtacatgagaagactgagaagcaccaaggagaccaccagcgaggagagcagagtgttccagagcagcggctggctgagcccccacagcttcgtggagagcgccaacgagaacgccctgaagcccccccagaccatgaccaccatcaccggcctggagccctacaccaagtacgagttcagagtgctggccgtgaacatggccggcagcgtgagcagcgcctgggtgagcgagagaaccggcgagagcgcccccgtgttcatgatcccccccagcgtgttccccctgagcagctacagcctgaacatcagctgggagaagcccgccgacaacgtgaccagaggcaaggtggtgggctacgacatcaacatgctgagcgagcagagcccccagcagagcatccccatggccttcagccagctgctgcacaccgccaagagccaggagctgagctacaccgtggagggcctgaagccctacagaatctacgagttcaccatcaccctgtgcaacagcgtgggctgcgtgaccagcgccagcggcgccggccagaccctggccgccgcccccgcccagctgagaccccccctggtgaagggcatcaacagcaccaccatccacctgagatggttcccccccgaggagctgaacggccccagccccatctaccagctggagagaagagagagcagcctgcccgccctgatgaccaccatgatgaagggcatcagattcatcggcaacggctactgcaagttccccagcagcacccaccccgtgaacaccgacttcaccggcatcaaggccagcttcagaaccaaggtgcccgagggcctgatcgtgttcgccgccagccccggcaaccaggaggagtacttcgccctgcagctgaagaagggcagactgtacttcctgttcgacccccagggcagccccgtggaggtgaccaccaccaacgaccacggcaagcagtacagcgacggcaagtggcacgagatcatcgccatcagacaccaggccttcggccagatcaccctggacggcatctacaccggcagcagcgccatcctgaacggcagcaccgtgatcggcgacaacaccggcgtgttcctgggcggcctgcccagaagctacaccatcctgagaaaggaccccgagatcatccagaagggcttcgtgggctgcctgaaggacgtgcacttcatgaagaactacaaccccagcgccatctgggagcccctggactggcagagcagcgaggagcagatcaacgtgtacaacagctgggagggctgccccgccagcctgaacgagggcgcccagttcctgggcgccggcttcctggagctgcacccctacatgttccacggcggcatgaacttcgagatcagcttcaagttcagaaccgaccagctgaacggcctgctgctgttcgtgtacaacaaggacggccccgacttcctggccatggagctgaagagcggcatcctgaccttcagactgaacaccagcctggccttcacccaggtggacctgctgctgggcctgagctactgcaacggcaagtggaacaaggtgatcatcaagaaggagggcagcttcatcagcgccagcgtgaacggcctgatgaagcacgccagcgagagcggcgaccagcccctggtggtgaacagccccgtgtacgtgggcggcatcccccaggagctgctgaacagctaccagcacctgtgcctggagcagggcttcggcggctgcatgaaggacgtgaagttcaccagaggcgccgtggtgaacctggccagcgtgagcagcggcgccgtgagagtgaacctggacggctgcctgagcaccgacagcgccgtgaactgcagaggcaacgacagcatcctggtgtaccagggcaaggagcagagcgtgtacgagggcggcctgcagcccttcaccgagtacctgtacagagtgatcgccagccacgagggcggcagcgtgtacagcgactggagcagaggcagaaccaccggcgccgccccccagagcgtgcccacccccagcagagtgagaagcctgaacggctacagcatcgaggtgacctgggacgagcccgtggtgagaggcgtgatcgagaagtacatcctgaaggcctacagcgaggacagcaccagaccccccagaatgcccagcgccagcgccgagttcgtgaacaccagcaacctgaccggcatcctgaccggcctgctgcccttcaagaactacgccgtgaccctgaccgcctgcaccctggccggctgcaccgagagcagccacgccctgaacatcagcaccccccaggaggccccccaggaggtgcagccccccgtggccaagagcctgcccagcagcctgctgctgagctggaacccccccaagaaggccaacggcatcatcacccagtactgcctgtacatggacggcagactgatctacagcggcagcgaggagaactacatcgtgaccgacctggccgtgttcaccccccaccagttcctgctgagcgcctgcacccacgtgggctgcaccaacagcagctgggtgctgctgtacaccgcccagctgccccccgagcacgtggacagccccgtgctgaccgtgctggacagcagaaccatccacatccagtggaagcagcccagaaagatcagcggcatcctggagagatacgtgctgtacatgagcaaccacacccacgacttcaccatctggagcgtgatctacaacagcaccgagctgttccaggaccacatgctgcagtacgtgctgcccggcaacaagtacctgatcaagctgggcgcctgcaccggcggcggctgcaccgtgagcgaggccagcgaggccctgaccgacgaggacatccccgagggcgtgcccgcccccaaggcccacagctacagccccgacagcttcaacgtgagctggaccgagcccgagtaccccaacggcgtgatcaccagctacggcctgtacctggacggcatcctgatccacaacagcagcgagctgagctacagagcctacggcttcgccccctggagcctgcacagcttcagagtgcaggcctgcaccgccaagggctgcgccctgggccccctggtggagaacagaaccctggaggccccccccgagggcaccgtgaacgtgttcgtgaagacccagggcagcagaaaggcccacgtgagatgggaggcccccttcagacccaacggcctgctgacccacagcgtgctgttcaccggcatcttctacgtggaccccgtgggcaacaactacaccctgctgaacgtgaccaaggtgatgtacagcggcgaggagaccaacctgtgggtgctgatcgacggcctggtgcccttcaccaactacaccgtgcaggtgaacatcagcaacagccagggcagcctgatcaccgaccccatcaccatcgccatgccccccggcgcccccgacggcgtgctgccccccagactgagcagcgccacccccaccagcctgcaggtggtgtggagcacccccgccagaaacaacgcccccggcagccccagataccagctgcagatgagaagcggcgacagcacccacggcttcctggagctgttcagcaaccccagcgccagcctgagctacgaggtgagcgacctgcagccctacaccgagtacatgttcagactggtggccagcaacggcttcggcagcgcccacagcagctggatccccttcatgaccgccgaggacaagcccggccccgtggtgccccccatcctgctggacgtgaagagcagaatgatgctggtgacctggcagcaccccagaaagagcaacggcgtgatcacccactacaacatctacctgcacggcagactgtacctgagaacccccggcaacgtgaccaactgcaccgtgatgcacctgcacccctacaccgcctacaagttccaggtggaggcctgcaccagcaagggctgcagcctgagccccgagagccagaccgtgtggaccctgcccggcgcccccgagggcatccccagccccgagctgttcagcgacacccccaccagcgtgatcatcagctggcagccccccacccaccccaacggcctggtggagaacttcaccatcgagagaagagtgaagggcaaggaggaggtgaccaccctggtgaccctgcccagaagccacagcatgagattcatcgacaagaccagcgccctgagcccctggaccaagtacgagtacagagtgctgatgagcaccctgcacggcggcaccaacagcagcgcctgggtggaggtgaccaccagacccagcagacccgccggcgtgcagccccccgtggtgaccgtgctggagcccgacgccgtgcaggtgacctggaagccccccctgatccagaacggcgacatcctgagctacgagatccacatgcccgacccccacatcaccctgaccaacgtgaccagcgccgtgctgagccagaaggtgacccacctgatccccttcaccaactacagcgtgaccatcgtggcctgcagcggcggcaacggctacctgggcggctgcaccgagagcctgcccacctacgtgaccacccaccccaccgtgccccagaacgtgggccccctgagcgtgatccccctgagcgagagctacgtggtgatcagctggcagccccccagcaagcccaacggccccaacctgagatacgagctgctgagaagaaagatccagcagcccctggccagcaacccccccgaggacctgaacagatggcacaacatctacagcggcacccagtggctgtacgaggacaagggcctgagcagattcaccacctacgagtacatgctgttcgtgcacaacagcgtgggcttcacccccagcagagaggtgaccgtgaccaccctggccggcctgcccgagagaggcgccaacctgaccgccagcgtgctgaaccacaccgccatcgacgtgagatgggccaagcccaccgtgcaggacctgcagggcgaggtggagtactacaccctgttctggagcagcgccaccagcaacgacagcctgaagatcctgcccgacgtgaacagccacgtgatcggccacctgaagcccaacaccgagtactggatcttcatcagcgtgttcaacggcgtgcacagcatcaacagcgccggcctgcacgccaccacctgcgacggcgagccccagggcatgctgccccccgaggtggtgatcatcaacagcaccgccgtgagagtgatctggaccagccccagcaaccccaacggcgtggtgaccgagtacagcatctacgtgaacaacaagctgtacaagaccggcatgaacgtgcccggcagcttcatcctgagagacctgagccccttcaccatctacgacatccaggtggaggtgtgcaccatctacgcctgcgtgaagagcaacggcacccagatcaccaccgtggaggacacccccagcgacatccccacccccaccatcagaggcatcaccagcagaagcctgcagatcgactgggtgagccccagaaagcccaacggcatcatcctgggctacgacctgctgtggaagacctggtacccctgcgccaagacccagaagctggtgcaggaccagagcgacgagctgtgcaaggccgtgagatgccagaagcccgagagcatctgcggccacatctgctacagcagcgaggccaaggtgtgctgcaacggcgtgctgtacaaccccaagcccggccacagatgctgcgaggagaagtacatccccttcgtgctgaacagcaccggcgtgtgctgcggcggcagaatccaggaggcccagcccaaccaccagtgctgcagcggctactacgccagaatcctgcccggcgaggtgtgctgccccgacgagcagcacaacagagtgagcgtgggcatcggcgacagctgctgcggcagaatgccctacagcaccagcggcaaccagatctgctgcgccggcagactgcacgacggccacggccagaagtgctgcggcagacagatcgtgagcaacgacctggagtgctgcggcggcgaggagggcgtggtgtacaacagactgcccggcatgttctgctgcggccaggactacgtgaacatgagcgacaccatctgctgcagcgccagcagcggcgagagcaaggcccacatcaagaagaacgaccccgtgcccgtgaagtgctgcgagaccgagctgatccccaagagccagaagtgctgcaacggcgtgggctacaaccccctgaagtacgtgtgcagcgacaagatcagcaccggcatgatgatgaaggagaccaaggagtgcagaatcctgtgccccgccagcatggaggccaccgagcactgcggcagatgcgacttcaacttcaccagccacatctgcaccgtgatcagaggcagccacaacagcaccggcaaggccagcatcgaggagatgtgcagcagcgccgaggagaccatccacaccggcagcgtgaacacctacagctacaccgacgtgaacctgaagccctacatgacctacgagtacagaatcagcgcctggaacagctacggcagaggcctgagcaaggccgtgagagccagaaccaaggaggacgtgccccagggcgtgagcccccccacctggaccaagatcgacaacctggaggacaccatcgtgctgaactggagaaagcccatccagagcaacggccccatcatctactacatcctgctgagaaacggcatcgagagattcagaggcaccagcctgagcttcagcgacaaggagggcatccagcccttccaggagtacagctaccagctgaaggcctgcaccgtggccggctgcgccaccagcagcaaggtggtggccgccaccacccagggcgtgcccgagagcatcctgccccccagcatcaccgccctgagcgccgtggccctgcacctgagctggagcgtgcccgagaagagcaacggcgtgatcaaggagtaccagatcagacaggtgggcaagggcctgatccacaccgacaccaccgacagaagacagcacaccgtgaccggcctgcagccctacaccaactacagcttcaccctgaccgcctgcaccagcgccggctgcaccagcagcgagcccttcctgggccagaccctgcaggccgcccccgagggcgtgtgggtgacccccagacacatcatcatcaacagcaccaccgtggagctgtactggagcctgcccgagaagcccaacggcctggtgagccagtaccagctgagcagaaacggcaacctgctgttcctgggcggcagcgaggagcagaacttcaccgacaagaacctggagcccaacagcagatacacctacaagctggaggtgaagaccggcggcggcagcagcgccagcgacgactacatcgtgcagacccccatgagcacccccgaggagatctaccccccctacaacatcaccgtgatcggcccctacagcatcttcgtggcctggatcccccccggcatcctgatccccgagatccccgtggagtacaacgtgctgctgaacgacggcagcgtgacccccctggccttcagcgtgggccaccaccagagcaccctgctggagaacctgacccccttcacccagtacgagatcagaatccaggcctgccagaacggcagctgcggcgtgagcagcagaatgttcgtgaagacccccgaggccgcccccatggacctgaacagccccgtgctgaaggccctgggcagcgcctgcatcgagatcaagtggatgccccccgagaagcccaacggcatcatcatcaactacttcatctacagaagacccgccggcatcgaggaggagagcgtgctgttcgtgtggagcgagggcgccctggagttcatggacgagggcgacaccctgagacccttcaccctgtacgagtacagagtgagagcctgcaacagcaagggcagcgtggagagcctgtggagcctgacccagaccctggaggcccccccccaggacttccccgccccctgggcccaggccaccagcgcccacagcgtgctgctgaactggaccaagcccgagagccccaacggcatcatcagccactacagagtggtgtaccaggagagacccgacgaccccaccttcaacagccccaccgtgcacgccttcaccgtgaagggcaccagccaccaggcccacctgtacggcctggagcccttcaccacctacagaatcggcgtggtggccgccaaccacgccggcgagatcctgagcccctggaccctgatccagaccctggagagcagccccagcggcctgagaaacttcatcgtggagcagaaggagaacggcagagccctgctgctgcagtggagcgagcccatgagaaccaacggcgtgatcaagacctacaacatcttcagcgacggcttcctggagtacagcggcctgaacagacagttcctgttcagaagactggaccccttcaccctgtacaccctgaccctggaggcctgcaccagagccggctgcgcccacagcgccccccagcccctgtggaccgacgaggccccccccgacagccagctggcccccaccgtgcacagcgtgaagagcaccagcgtggagctgagctggagcgagcccgtgaaccccaacggcaagatcatcagatacgaggtgatcagaagatgcttcgagggcaaggcctggggcaaccagaccatccaggccgacgagaagatcgtgttcaccgagtacaacaccgagagaaacaccttcatgtacaacgacaccggcctgcagccctggacccagtgcgagtacaagatctacacctggaacagcgccggccacacctgcagcagctggaacgtggtgagaaccctgcaggccccccccgagggcctgagcccccccgtgatcagctacgtgagcatgaacccccagaagctgctgatcagctggatcccccccgagcagagcaacggcatcatccagagctacagactgcagagaaacgagatgctgtaccccttcagcttcgaccccgtgaccttcaactacaccgacgaggagctgctgcccttcagcacctacagctacgccctgcaggcctgcaccagcggcggctgcagcaccagcaagcccaccagcatcaccaccctggaggccgcccccagcgaggtgagcccccccgacctgtgggccgtgagcgccacccagatgaacgtgtgctggagcccccccaccgtgcagaacggcaagatcaccaagtacctggtgagatacgacaacaaggagagcctggccggccagggcctgtgcctgctggtgagccacctgcagccctacagccagtacaacttcagcctggtggcctgcaccaacggcggctgcaccgccagcgtgagcaagagcgcctggaccatggaggccctgcccgagaacatggacagccccaccctgcaggtgaccggcagcgagagcatcgagatcacctggaagccccccagaaaccccaacggccagatcagaagctacgagctgagaagagacggcaccatcgtgtacaccggcctggagaccagatacagagacttcaccctgacccccggcgtggagtacagctacaccgtgaccgccagcaacagccagggcggcatcctgagccccctggtgaaggacagaaccagccccagcgcccccagcggcatggagccccccaagctgcaggccagaggcccccaggagatcctggtgaactgggacccccccgtgagaaccaacggcgacatcatcaactacaccctgttcatcagagagctgttcgagagagagaccaagatcatccacatcaacaccacccacaacagcttcggcatgcagagctacatcgtgaaccagctgaagcccttccacagatacgagatcagaatccaggcctgcaccaccctgggctgcgccagcagcgactggaccttcatccagacccccgagatcgcccccctgatgcagccccccccccacctggaggtgcagatggcccccggcggcttccagcccaccgtgagcctgctgtggaccggccccctgcagcccaacggcaaggtgctgtactacgagctgtacagaagacagatcgccacccagcccagaaagagcaaccccgtgctgatctacaacggcagcagcaccagcttcatcgacagcgagctgctgcccttcaccgagtacgagtaccaggtgtgggccgtgaacagcgccggcaaggcccccagcagctggacctggtgcagaaccggccccgccccccccgagggcctgagagcccccaccttccacgtgatcagcagcacccaggccgtggtgaacatcagcgcccccggcaagcccaacggcatcgtgagcctgtacagactgttcagcagcagcgcccacggcgccgagaccgtgctgagcgagggcatggccacccagcagaccctgcacggcctgcaggccttcaccaactacagcatcggcgtggaggcctgcacctgcttcaactgctgcagcaagggccccaccgccgagctgagaacccaccccgccccccccagcggcctgagcagcccccagatcggcaccctggccagcagaaccgccagcttcagatggagcccccccatgttccccaacggcgtgatccacagctacgagctgcagttccacgtggcctgcccccccgacagcgccctgccctgcacccccagccagatcgagaccaagtacaccggcctgggccagaaggccagcctgggcggcctgcagccctacaccacctacaagctgagagtggtggcccacaacgaggtgggcagcaccgccagcgagtggatcagcttcaccacccagaaggagctgccccagtacagagcccccttcagcgtggacagcaacctgagcgtggtgtgcgtgaactggagcgacaccttcctgctgaacggccagctgaaggagtacgtgctgaccgacggcggcagaagagtgtacagcggcctggacaccaccctgtacatccccagaaccgccgacaagaccttcttcttccaggtgatctgcaccaccgacgagggcagcgtgaagacccccctgatccagtacgacaccagcaccggcctgggcctggtgctgaccacccccggcaagaagaagggcagcagaagcaagagcaccgagttctacagcgagctgtggttcatcgtgctgatggccatgctgggcctgatcctgctggccatcttcctgagcctgatcctgcagagaaagatccacaaggagccctacatcagagagagaccccccctggtgcccctgcagaagagaatgagccccctgaacgtgtacccccccggcgagaaccacatgggcctggccgacaccaagatccccagaagcggcacccccgtgagcatcagaagcaacagaagcgcctgcgtgctgagaatccccagccagaaccagaccagcctgacctacagccagggcagcctgcacagaagcgtgagccagctgatggacatccaggacaagaaggtgctgatggacaacagcctgtgggaggccatcatgggccacaacagcggcctgtacgtggacgaggaggacctgatgaacgccatcaaggacttcagcagcgtgaccaaggagagaaccaccttcaccgacacccacctgtag

SEQ ID NO: 104822 - DNA, 4641 bp, Artificial Sequence
  Description of Artificial Sequence: Synthetic coding sequence
atgaactgccccgtgctgagcctgggcagcggcttcctgttccaggtgatcgagatgctgatcttcgcctacttcgccagcatcagcctgaccgagagcagaggcctgttccccagactggagaacgtgggcgccttcaagaaggtgagcatcgtgcccacccaggccgtgtgcggcctgcccgacagaagcaccttctgccacagcagcgccgccgccgagagcatccagttctgcacccagagattctgcatccaggactgcccctacagaagcagccaccccacctacaccgccctgttcagcgccggcctgagcagctgcatcacccccgacaagaacgacctgcaccccaacgcccacagcaacagcgccagcttcatcttcggcaaccacaagagctgcttcagcagcccccccagccccaagctgatggccagcttcaccctggccgtgtggctgaagcccgagcagcagggcgtgatgtgcgtgatcgagaagaccgtggacggccagatcgtgttcaagctgaccatcagcgagaaggagaccatgttctactacagaaccgtgaacggcctgcagccccccatcaaggtgatgaccctgggcagaatcctggtgaagaagtggatccacctgagcgtgcaggtgcaccagaccaagatcagcttcttcatcaacggcgtggagaaggaccacacccccttcaacgccagaaccctgagcggcagcatcaccgacttcgccagcggcaccgtgcagatcggccagagcctgaacggcctggagcagttcgtgggcagaatgcaggacttcagactgtaccaggtggccctgaccaacagagagatcctggaggtgttcagcggcgacctgctgagactgcacgcccagagccactgcagatgccccggcagccaccccagagtgcaccccctggcccagagatactgcatccccaacgacgccggcgacaccgccgacaacagagtgagcagactgaaccccgaggcccaccccctgagcttcgtgaacgacaacgacgtgggcaccagctgggtgagcaacgtgttcaccaacatcacccagctgaaccagggcgtgaccatcagcgtggacctggagaacggccagtaccaggtgttctacatcatcatccagttcttcagcccccagcccaccgagatcagaatccagagaaagaaggagaacagcctggactgggaggactggcagtacttcgccagaaactgcggcgccttcggcatgaagaacaacggcgacctggagaagcccgacagcgtgaactgcctgcagctgagcaacttcaccccctacagcagaggcaacgtgaccttcagcatcctgacccccggccccaactacagacccggctacaacaacttctacaacacccccagcctgcaggagttcgtgaaggccacccagatcagattccacttccacggccagtactacaccaccgagaccgccgtgaacctgagacacagatactacgccgtggacgagatcaccatcagcggcagatgccagtgccacggccacgccgacaactgcgacaccaccagccagccctacagatgcctgtgcagccaggagagcttcaccgagggcctgcactgcgacagatgcctgcccctgtacaacgacaagcccttcagacagggcgaccaggtgtacgccttcaactgcaagccctgccagtgcaacagccacagcaagagctgccactacaacatcagcgtggaccccttccccttcgagcacttcagaggcggcggcggcgtgtgcgacgactgcgagcacaacaccaccggcagaaactgcgagctgtgcaaggactacttcttcagacaggtgggcgccgaccccagcgccatcgacgtgtgcaagccctgcgactgcgacaccgtgggcaccagaaacggcagcatcctgtgcgaccagatcggcggccagtgcaactgcaagagacacgtgagcggcagacagtgcaaccagtgccagaacggcttctacaacctgcaggagctggaccccgacggctgcagcccctgcaactgcaacaccagcggcaccgtggacggcgacatcacctgccaccagaacagcggccagtgcaagtgcaaggccaacgtgatcggcctgagatgcgaccactgcaacttcggcttcaagttcctgagaagcttcaacgacgtgggctgcgagccctgccagtgcaacctgcacggcagcgtgaacaagttctgcaacccccacagcggccagtgcgagtgcaagaaggaggccaagggcctgcagtgcgacacctgcagagagaacttctacggcctggacgtgaccaactgcaaggcctgcgactgcgacaccgccggcagcctgcccggcaccgtgtgcaacgccaagaccggccagtgcatctgcaagcccaacgtggagggcagacagtgcaacaagtgcctggagggcaacttctacctgagacagaacaacagcttcctgtgcctgccctgcaactgcgacaagaccggcaccatcaacggcagcctgctgtgcaacaagagcaccggccagtgcccctgcaagctgggcgtgaccggcctgagatgcaaccagtgcgagccccacagatacaacctgaccatcgacaacttccagcactgccagatgtgcgagtgcgacagcctgggcaccctgcccggcaccatctgcgaccccatcagcggccagtgcctgtgcgtgcccaacagacagggcagaagatgcaaccagtgccagcccggcttctacatcagccccggcaacgccaccggctgcctgccctgcagctgccacaccaccggcgccgtgaaccacatctgcaacagcctgaccggccagtgcgtgtgccaggacgccagcatcgccggccagagatgcgaccagtgcaaggaccactacttcggcttcgacccccagaccggcagatgccagccctgcaactgccacctgagcggcgccctgaacgagacctgccacctggtgaccggccagtgcttctgcaagcagttcgtgaccggcagcaagtgcgacgcctgcgtgcccagcgccagccacctggacgtgaacaacctgctgggctgcagcaagacccccttccagcagcccccccccagaggccaggtgcagagcagcagcgccatcaacctgagctggagcccccccgacagccccaacgcccactggctgacctacagcctgctgagagacggcttcgagatctacaccaccgaggaccagtacccctacagcatccagtacttcctggacaccgacctgctgccctacaccaagtacagctactacatcgagaccaccaacgtgcacggcagcaccagaagcgtggccgtgacctacaagaccaagcccggcgtgcccgagggcaacctgaccctgagctacatcatccccatcggcagcgacagcgtgaccctgacctggaccaccctgagcaaccagagcggccccatcgagaagtacatcctgagctgcgcccccctggccggcggccagccctgcgtgagctacgagggccacgagaccagcgccaccatctggaacctggtgcccttcgccaagtacgacttcagcgtgcaggcctgcaccagcggcggctgcctgcacagcctgcccatcaccgtgaccaccgcccaggcccccccccagagactgagcccccccaagatgcagaagatcagcagcaccgagctgcacgtggagtggagcccccccgccgagctgaacggcatcatcatcagatacgagctgtacatgagaagactgagaagcaccaaggagaccaccagcgaggagagcagagtgttccagagcagcggctggctgagcccccacagcttcgtggagagcgccaacgagaacgccctgaagcccccccagaccatgaccaccatcaccggcctggagccctacaccaagtacgagttcagagtgctggccgtgaacatggccggcagcgtgagcagcgcctgggtgagcgagagaaccggcgagagcgcccccgtgttcatgatcccccccagcgtgttccccctgagcagctacagcctgaacatcagctgggagaagcccgccgacaacgtgaccagaggcaaggtggtgggctacgacatcaacatgctgagcgagcagagcccccagcagagcatccccatggccttcagccagctgctgcacaccgccaagagccaggagctgagctacaccgtggagggcctgaagccctacagaatctacgagttcaccatcaccctgtgcaacagcgtgggctgcgtgaccagcgccagcggcgccggccagaccctggccgccgcccccgcccagctgagaccccccctggtgaagggcatcaacagcaccaccatccacctgagatggttcccccccgaggagctgaacggccccagccccatctaccagctggagagaagagagagcagcctgcccgccctgatgaccaccatgatgaagggcatcagattcatcggcaacggctactgcaagttccccagcagcacccaccccgtgaacaccgacttcaccggcaagtgcgtgtag

SEQ ID NO: 104823 - DNA, 15681 bp, Artificial Sequence
  Description of Artificial Sequence: Synthetic coding sequence
atgaactgccccgtgctgagcctgggcagcggcttcctgttccaggtgatcgagatgctgatcttcgcctacttcgccagcatcagcctgaccgagagcagaggcctgttccccagactggagaacgtgggcgccttcaagaaggtgagcatcgtgcccacccaggccgtgtgcggcctgcccgacagaagcaccttctgccacagcagcgccgccgccgagagcatccagttctgcacccagagattctgcatccaggactgcccctacagaagcagccaccccacctacaccgccctgttcagcgccggcctgagcagctgcatcacccccgacaagaacgacctgcaccccaacgcccacagcaacagcgccagcttcatcttcggcaaccacaagagctgcttcagcagcccccccagccccaagctgatggccagcttcaccctggccgtgtggctgaagcccgagcagcagggcgtgatgtgcgtgatcgagaagaccgtggacggccagatcgtgttcaagctgaccatcagcgagaaggagaccatgttctactacagaaccgtgaacggcctgcagccccccatcaaggtgatgaccctgggcagaatcctggtgaagaagtggatccacctgagcgtgcaggtgcaccagaccaagatcagcttcttcatcaacggcgtggagaaggaccacacccccttcaacgccagaaccctgagcggcagcatcaccgacttcgccagcggcaccgtgcagatcggccagagcctgaacggcctggagcagttcgtgggcagaatgcaggacttcagactgtaccaggtggccctgaccaacagagagatcctggaggtgttcagcggcgacctgctgagactgcacgcccagagccactgcagatgccccggcagccaccccagagtgcaccccctggcccagagatactgcatccccaacgacgccggcgacaccgccgacaacagagtgagcagactgaaccccgaggcccaccccctgagcttcgtgaacgacaacgacgtgggcaccagctgggtgagcaacgtgttcaccaacatcacccagctgaaccagggcgtgaccatcagcgtggacctggagaacggccagtaccaggtgttctacatcatcatccagttcttcagcccccagcccaccgagatcagaatccagagaaagaaggagaacagcctggactgggaggactggcagtacttcgccagaaactgcggcgccttcggcatgaagaacaacggcgacctggagaagcccgacagcgtgaactgcctgcagctgagcaacttcaccccctacagcagaggcaacgtgaccttcagcatcctgacccccggccccaactacagacccggctacaacaacttctacaacacccccagcctgcaggagttcgtgaaggccacccagatcagattccacttccacggccagtactacaccaccgagaccgccgtgaacctgagacacagatactacgccgtggacgagatcaccatcagcggcagatgccagtgccacggccacgccgacaactgcgacaccaccagccagccctacagatgcctgtgcagccaggagagcttcaccgagggcctgcactgcgacagatgcctgcccctgtacaacgacaagcccttcagacagggcgaccaggtgtacgccttcaactgcaagccctgccagtgcaacagccacagcaagagctgccactacaacatcagcgtggaccccttccccttcgagcacttcagaggcggcggcggcgtgtgcgacgactgcgagcacaacaccaccggcagaaactgcgagctgtgcaaggactacttcttcagacaggtgggcgccgaccccagcgccatcgacgtgtgcaagccctgcgactgcgacaccgtgggcaccagaaacggcagcatcctgtgcgaccagatcggcggccagtgcaactgcaagagacacgtgagcggcagacagtgcaaccagtgccagaacggcttctacaacctgcaggagctggaccccgacggctgcagcccctgcaactgcaacaccagcggcaccgtggacggcgacatcacctgccaccagaacagcggccagtgcaagtgcaaggccaacgtgatcggcctgagatgcgaccactgcaacttcggcttcaagttcctgagaagcttcaacgacgtgggctgcgagccctgccagtgcaacctgcacggcagcgtgaacaagttctgcaacccccacagcggccagtgcgagtgcaagaaggaggccaagggcctgcagtgcgacacctgcagagagaacttctacggcctggacgtgaccaactgcaaggcctgcgactgcgacaccgccggcagcctgcccggcaccgtgtgcaacgccaagaccggccagtgcatctgcaagcccaacgtggagggcagacagtgcaacaagtgcctggagggcaacttctacctgagacagaacaacagcttcctgtgcctgccctgcaactgcgacaagaccggcaccatcaacggcagcctgctgtgcaacaagagcaccggccagtgcccctgcaagctgggcgtgaccggcctgagatgcaaccagtgcgagccccacagatacaacctgaccatcgacaacttccagcactgccagatgtgcgagtgcgacagcctgggcaccctgcccggcaccatctgcgaccccatcagcggccagtgcctgtgcgtgcccaacagacagggcagaagatgcaaccagtgccagcccggcttctacatcagccccggcaacgccaccggctgcctgccctgcagctgccacaccaccggcgccgtgaaccacatctgcaacagcctgaccggccagtgcgtgtgccaggacgccagcatcgccggccagagatgcgaccagtgcaaggaccactacttcggcttcgacccccagaccggcagatgccagccctgcaactgccacctgagcggcgccctgaacgagacctgccacctggtgaccggccagtgcttctgcaagcagttcgtgaccggcagcaagtgcgacgcctgcgtgcccagcgccagccacctggacgtgaacaacctgctgggctgcagcaagacccccttccagcagcccccccccagaggccaggtgcagagcagcagcgccatcaacctgagctggagcccccccgacagccccaacgcccactggctgacctacagcctgctgagagacggcttcgagatctacaccaccgaggaccagtacccctacagcatccagtacttcctggacaccgacctgctgccctacaccaagtacagctactacatcgagaccaccaacgtgcacggcagcaccagaagcgtggccgtgacctacaagaccaagcccggcgtgcccgagggcaacctgaccctgagctacatcatccccatcggcagcgacagcgtgaccctgacctggaccaccctgagcaaccagagcggccccatcgagaagtacatcctgagctgcgcccccctggccggcggccagccctgcgtgagctacgagggccacgagaccagcgccaccatctggaacctggtgcccttcgccaagtacgacttcagcgtgcaggcctgcaccagcggcggctgcctgcacagcctgcccatcaccgtgaccaccgcccaggcccccccccagagactgagcccccccaagatgcagaagatcagcagcaccgagctgcacgtggagtggagcccccccgccgagctgaacggcatcatcatcagatacgagctgtacatgagaagactgagaagcaccaaggagaccaccagcgaggagagcagagtgttccagagcagcggctggctgagcccccacagcttcgtggagagcgccaacgagaacgccctgaagcccccccagaccatgaccaccatcaccggcctggagccctacaccaagtacgagttcagagtgctggccgtgaacatggccggcagcgtgagcagcgcctgggtgagcgagagaaccggcgagagcgcccccgtgttcatgatcccccccagcgtgttccccctgagcagctacagcctgaacatcagctgggagaagcccgccgacaacgtgaccagaggcaaggtggtgggctacgacatcaacatgctgagcgagcagagcccccagcagagcatccccatggccttcagccagctgctgcacaccgccaagagccaggagctgagctacaccgtggagggcctgaagccctacagaatctacgagttcaccatcaccctgtgcaacagcgtgggctgcgtgaccagcgccagcggcgccggccagaccctggccgccgcccccgcccagctgagaccccccctggtgaagggcatcaacagcaccaccatccacctgagatggttcccccccgaggagctgaacggccccagccccatctaccagctggagagaagagagagcagcctgcccgccctgatgaccaccatgatgaagggcatcagattcatcggcaacggctactgcaagttccccagcagcacccaccccgtgaacaccgacttcaccggcatcaaggccagcttcagaaccaaggtgcccgagggcctgatcgtgttcgccgccagccccggcaaccaggaggagtacttcgccctgcagctgaagaagggcagactgtacttcctgttcgacccccagggcagccccgtggaggtgaccaccaccaacgaccacggcaagcagtacagcgacggcaagtggcacgagatcatcgccatcagacaccaggccttcggccagatcaccctggacggcatctacaccggcagcagcgccatcctgaacggcagcaccgtgatcggcgacaacaccggcgtgttcctgggcggcctgcccagaagctacaccatcctgagaaaggaccccgagatcatccagaagggcttcgtgggctgcctgaaggacgtgcacttcatgaagaactacaaccccagcgccatctgggagcccctggactggcagagcagcgaggagcagatcaacgtgtacaacagctgggagggctgccccgccagcctgaacgagggcgcccagttcctgggcgccggcttcctggagctgcacccctacatgttccacggcggcatgaacttcgagatcagcttcaagttcagaaccgaccagctgaacggcctgctgctgttcgtgtacaacaaggacggccccgacttcctggccatggagctgaagagcggcatcctgaccttcagactgaacaccagcctggccttcacccaggtggacctgctgctgggcctgagctactgcaacggcaagtggaacaaggtgatcatcaagaaggagggcagcttcatcagcgccagcgtgaacggcctgatgaagcacgccagcgagagcggcgaccagcccctggtggtgaacagccccgtgtacgtgggcggcatcccccaggagctgctgaacagctaccagcacctgtgcctggagcagggcttcggcggctgcatgaaggacgtgaagttcaccagaggcgccgtggtgaacctggccagcgtgagcagcggcgccgtgagagtgaacctggacggctgcctgagcaccgacagcgccgtgaactgcagaggcaacgacagcatcctggtgtaccagggcaaggagcagagcgtgtacgagggcggcctgcagcccttcaccgagtacctgtacagagtgatcgccagccacgagggcggcagcgtgtacagcgactggagcagaggcagaaccaccggcgccgccccccagagcgtgcccacccccagcagagtgagaagcctgaacggctacagcatcgaggtgacctgggacgagcccgtggtgagaggcgtgatcgagaagtacatcctgaaggcctacagcgaggacagcaccagaccccccagaatgcccagcgccagcgccgagttcgtgaacaccagcaacctgaccggcatcctgaccggcctgctgcccttcaagaactacgccgtgaccctgaccgcctgcaccctggccggctgcaccgagagcagccacgccctgaacatcagcaccccccaggaggccccccaggaggtgcagccccccgtggccaagagcctgcccagcagcctgctgctgagctggaacccccccaagaaggccaacggcatcatcacccagtactgcctgtacatggacggcagactgatctacagcggcagcgaggagaactacatcgtgaccgacctggccgtgttcaccccccaccagttcctgctgagcgcctgcacccacgtgggctgcaccaacagcagctgggtgctgctgtacaccgcccagctgccccccgagcacgtggacagccccgtgctgaccgtgctggacagcagaaccatccacatccagtggaagcagcccagaaagatcagcggcatcctggagagatacgtgctgtacatgagcaaccacacccacgacttcaccatctggagcgtgatctacaacagcaccgagctgttccaggaccacatgctgcagtacgtgctgcccggcaacaagtacctgatcaagctgggcgcctgcaccggcggcggctgcaccgtgagcgaggccagcgaggccctgaccgacgaggacatccccgagggcgtgcccgcccccaaggcccacagctacagccccgacagcttcaacgtgagctggaccgagcccgagtaccccaacggcgtgatcaccagctacggcctgtacctggacggcatcctgatccacaacagcagcgagctgagctacagagcctacggcttcgccccctggagcctgcacagcttcagagtgcaggcctgcaccgccaagggctgcgccctgggccccctggtggagaacagaaccctggaggccccccccgagggcaccgtgaacgtgttcgtgaagacccagggcagcagaaaggcccacgtgagatgggaggcccccttcagacccaacggcctgctgacccacagcgtgctgttcaccggcatcttctacgtggaccccgtgggcaacaactacaccctgctgaacgtgaccaaggtgatgtacagcggcgaggagaccaacctgtgggtgctgatcgacggcctggtgcccttcaccaactacaccgtgcaggtgaacatcagcaacagccagggcagcctgatcaccgaccccatcaccatcgccatgccccccggcgcccccgacggcgtgctgccccccagactgagcagcgccacccccaccagcctgcaggtggtgtggagcacccccgccagaaacaacgcccccggcagccccagataccagctgcagatgagaagcggcgacagcacccacggcttcctggagctgttcagcaaccccagcgccagcctgagctacgaggtgagcgacctgcagccctacaccgagtacatgttcagactggtggccagcaacggcttcggcagcgcccacagcagctggatccccttcatgaccgccgaggacaagcccggccccgtggtgccccccatcctgctggacgtgaagagcagaatgatgctggtgacctggcagcaccccagaaagagcaacggcgtgatcacccactacaacatctacctgcacggcagactgtacctgagaacccccggcaacgtgaccaactgcaccgtgatgcacctgcacccctacaccgcctacaagttccaggtggaggcctgcaccagcaagggctgcagcctgagccccgagagccagaccgtgtggaccctgcccggcgcccccgagggcatccccagccccgagctgttcagcgacacccccaccagcgtgatcatcagctggcagccccccacccaccccaacggcctggtggagaacttcaccatcgagagaagagtgaagggcaaggaggaggtgaccaccctggtgaccctgcccagaagccacagcatgagattcatcgacaagaccagcgccctgagcccctggaccaagtacgagtacagagtgctgatgagcaccctgcacggcggcaccaacagcagcgcctgggtggaggtgaccaccagacccagcagacccgccggcgtgcagccccccgtggtgaccgtgctggagcccgacgccgtgcaggtgacctggaagccccccctgatccagaacggcgacatcctgagctacgagatccacatgcccgacccccacatcaccctgaccaacgtgaccagcgccgtgctgagccagaaggtgacccacctgatccccttcaccaactacagcgtgaccatcgtggcctgcagcggcggcaacggctacctgggcggctgcaccgagagcctgcccacctacgtgaccacccaccccaccgtgccccagaacgtgggccccctgagcgtgatccccctgagcgagagctacgtggtgatcagctggcagccccccagcaagcccaacggccccaacctgagatacgagctgctgagaagaaagatccagcagcccctggccagcaacccccccgaggacctgaacagatggcacaacatctacagcggcacccagtggctgtacgaggacaagggcctgagcagattcaccacctacgagtacatgctgttcgtgcacaacagcgtgggcttcacccccagcagagaggtgaccgtgaccaccctggccggcctgcccgagagaggcgccaacctgaccgccagcgtgctgaaccacaccgccatcgacgtgagatgggccaagcccaccgtgcaggacctgcagggcgaggtggagtactacaccctgttctggagcagcgccaccagcaacgacagcctgaagatcctgcccgacgtgaacagccacgtgatcggccacctgaagcccaacaccgagtactggatcttcatcagcgtgttcaacggcgtgcacagcatcaacagcgccggcctgcacgccaccacctgcgacggcgagccccagggcatgctgccccccgaggtggtgatcatcaacagcaccgccgtgagagtgatctggaccagccccagcaaccccaacggcgtggtgaccgagtacagcatctacgtgaacaacaagctgtacaagaccggcatgaacgtgcccggcagcttcatcctgagagacctgagccccttcaccatctacgacatccaggtggaggtgtgcaccatctacgcctgcgtgaagagcaacggcacccagatcaccaccgtggaggacacccccagcgacatccccacccccaccatcagaggcatcaccagcagaagcctgcagatcgactgggtgagccccagaaagcccaacggcatcatcctgggctacgacctgctgtggaagacctggtacccctgcgccaagacccagaagctggtgcaggaccagagcgacgagctgtgcaaggccgtgagatgccagaagcccgagagcatctgcggccacatctgctacagcagcgaggccaaggtgtgctgcaacggcgtgctgtacaaccccaagcccggccacagatgctgcgaggagaagtacatccccttcgtgctgaacagcaccggcgtgtgctgcggcggcagaatccaggaggcccagcccaaccaccagtgctgcagcggctactacgccagaatcctgcccggcgaggtgtgctgccccgacgagcagcacaacagagtgagcgtgggcatcggcgacagctgctgcggcagaatgccctacagcaccagcggcaaccagatctgctgcgccggcagactgcacgacggccacggccagaagtgctgcggcagacagatcgtgagcaacgacctggagtgctgcggcggcgaggagggcgtggtgtacaacagactgcccggcatgttctgctgcggccaggactacgtgaacatgagcgacaccatctgctgcagcgccagcagcggcgagagcaaggcccacatcaagaagaacgaccccgtgcccgtgaagtgctgcgagaccgagctgatccccaagagccagaagtgctgcaacggcgtgggctacaaccccctgaagtacgtgtgcagcgacaagatcagcaccggcatgatgatgaaggagaccaaggagtgcagaatcctgtgccccgccagcatggaggccaccgagcactgcggcagatgcgacttcaacttcaccagccacatctgcaccgtgatcagaggcagccacaacagcaccggcaaggccagcatcgaggagatgtgcagcagcgccgaggagaccatccacaccggcagcgtgaacacctacagctacaccgacgtgaacctgaagccctacatgacctacgagtacagaatcagcgcctggaacagctacggcagaggcctgagcaaggccgtgagagccagaaccaaggaggacgtgccccagggcgtgagcccccccacctggaccaagatcgacaacctggaggacaccatcgtgctgaactggagaaagcccatccagagcaacggccccatcatctactacatcctgctgagaaacggcatcgagagattcagaggcaccagcctgagcttcagcgacaaggagggcatccagcccttccaggagtacagctaccagctgaaggcctgcaccgtggccggctgcgccaccagcagcaaggtggtggccgccaccacccagggcgtgcccgagagcatcctgccccccagcatcaccgccctgagcgccgtggccctgcacctgagctggagcgtgcccgagaagagcaacggcgtgatcaaggagtaccagatcagacaggtgggcaagggcctgatccacaccgacaccaccgacagaagacagcacaccgtgaccggcctgcagccctacaccaactacagcttcaccctgaccgcctgcaccagcgccggctgcaccagcagcgagcccttcctgggccagaccctgcaggccgcccccgagggcgtgtgggtgacccccagacacatcatcatcaacagcaccaccgtggagctgtactggagcctgcccgagaagcccaacggcctggtgagccagtaccagctgagcagaaacggcaacctgctgttcctgggcggcagcgaggagcagaacttcaccgacaagaacctggagcccaacagcagatacacctacaagctggaggtgaagaccggcggcggcagcagcgccagcgacgactacatcgtgcagacccccatgagcacccccgaggagatctaccccccctacaacatcaccgtgatcggcccctacagcatcttcgtggcctggatcccccccggcatcctgatccccgagatccccgtggagtacaacgtgctgctgaacgacggcagcgtgacccccctggccttcagcgtgggccaccaccagagcaccctgctggagaacctgacccccttcacccagtacgagatcagaatccaggcctgccagaacggcagctgcggcgtgagcagcagaatgttcgtgaagacccccgaggccgcccccatggacctgaacagccccgtgctgaaggccctgggcagcgcctgcatcgagatcaagtggatgccccccgagaagcccaacggcatcatcatcaactacttcatctacagaagacccgccggcatcgaggaggagagcgtgctgttcgtgtggagcgagggcgccctggagttcatggacgagggcgacaccctgagacccttcaccctgtacgagtacagagtgagagcctgcaacagcaagggcagcgtggagagcctgtggagcctgacccagaccctggaggcccccccccaggacttccccgccccctgggcccaggccaccagcgcccacagcgtgctgctgaactggaccaagcccgagagccccaacggcatcatcagccactacagagtggtgtaccaggagagacccgacgaccccaccttcaacagccccaccgtgcacgccttcaccgtgaagggcaccagccaccaggcccacctgtacggcctggagcccttcaccacctacagaatcggcgtggtggccgccaaccacgccggcgagatcctgagcccctggaccctgatccagaccctggagagcagccccagcggcctgagaaacttcatcgtggagcagaaggagaacggcagagccctgctgctgcagtggagcgagcccatgagaaccaacggcgtgatcaagacctacaacatcttcagcgacggcttcctggagtacagcggcctgaacagacagttcctgttcagaagactggaccccttcaccctgtacaccctgaccctggaggcctgcaccagagccggctgcgcccacagcgccccccagcccctgtggaccgacgaggccccccccgacagccagctggcccccaccgtgcacagcgtgaagagcaccagcgtggagctgagctggagcgagcccgtgaaccccaacggcaagatcatcagatacgaggtgatcagaagatgcttcgagggcaaggcctggggcaaccagaccatccaggccgacgagaagatcgtgttcaccgagtacaacaccgagagaaacaccttcatgtacaacgacaccggcctgcagccctggacccagtgcgagtacaagatctacacctggaacagcgccggccacacctgcagcagctggaacgtggtgagaaccctgcaggccccccccgagggcctgagcccccccgtgatcagctacgtgagcatgaacccccagaagctgctgatcagctggatcccccccgagcagagcaacggcatcatccagagctacagactgcagagaaacgagatgctgtaccccttcagcttcgaccccgtgaccttcaactacaccgacgaggagctgctgcccttcagcacctacagctacgccctgcaggcctgcaccagcggcggctgcagcaccagcaagcccaccagcatcaccaccctggaggccgcccccagcgaggtgagcccccccgacctgtgggccgtgagcgccacccagatgaacgtgtgctggagcccccccaccgtgcagaacggcaagatcaccaagtacctggtgagatacgacaacaaggagagcctggccggccagggcctgtgcctgctggtgagccacctgcagccctacagccagtacaacttcagcctggtggcctgcaccaacggcggctgcaccgccagcgtgagcaagagcgcctggaccatggaggccctgcccgagaacatggacagccccaccctgcaggtgaccggcagcgagagcatcgagatcacctggaagccccccagaaaccccaacggccagatcagaagctacgagctgagaagagacggcaccatcgtgtacaccggcctggagaccagatacagagacttcaccctgacccccggcgtggagtacagctacaccgtgaccgccagcaacagccagggcggcatcctgagccccctggtgaaggacagaaccagccccagcgcccccagcggcatggagccccccaagctgcaggccagaggcccccaggagatcctggtgaactgggacccccccgtgagaaccaacggcgacatcatcaactacaccctgttcatcagagagctgttcgagagagagaccaagatcatccacatcaacaccacccacaacagcttcggcatgcagagctacatcgtgaaccagctgaagcccttccacagatacgagatcagaatccaggcctgcaccaccctgggctgcgccagcagcgactggaccttcatccagacccccgagatcgcccccctgatgcagccccccccccacctggaggtgcagatggcccccggcggcttccagcccaccgtgagcctgctgtggaccggccccctgcagcccaacggcaaggtgctgtactacgagctgtacagaagacagatcgccacccagcccagaaagagcaaccccgtgctgatctacaacggcagcagcaccagcttcatcgacagcgagctgctgcccttcaccgagtacgagtaccaggtgtgggccgtgaacagcgccggcaaggcccccagcagctggacctggtgcagaaccggccccgccccccccgagggcctgagagcccccaccttccacgtgatcagcagcacccaggccgtggtgaacatcagcgcccccggcaagcccaacggcatcgtgagcctgtacagactgttcagcagcagcgcccacggcgccgagaccgtgctgagcgagggcatggccacccagcagaccctgcacggcctgcaggccttcaccaactacagcatcggcgtggaggcctgcacctgcttcaactgctgcagcaagggccccaccgccgagctgagaacccaccccgccccccccagcggcctgagcagcccccagatcggcaccctggccagcagaaccgccagcttcagatggagcccccccatgttccccaacggcgtgatccacagctacgagctgcagttccacgtggcctgcccccccgacagcgccctgccctgcacccccagccagatcgagaccaagtacaccggcctgggccagaaggccagcctgggcggcctgcagccctacaccacctacaagctgagagtggtggcccacaacgaggtgggcagcaccgccagcgagtggatcagcttcaccacccagaaggagctgccccagtacagagcccccttcagcgtggacagcaacctgagcgtggtgtgcgtgaactggagcgacaccttcctgctgaacggccagctgaaggagtacgtgctgaccgacggcggcagaagagtgtacagcggcctggacaccaccctgtacatccccagaaccgccgacaagaccttcttcttccaggtgatctgcaccaccgacgagggcagcgtgaagacccccctgatccagtacgacaccagcaccggcctgggcctggtgctgaccacccccggcaagaagaagggcagcagaagcaagagcaccgagttctacagcgagctgtggttcatcgtgctgatggccatgctgggcctgatcctgctggccatcttcctgagcctgatcctgcagagaaagatccacaaggagccctacatcagagagagaccccccctggtgcccctgcagaagagaatgagccccctgaacgtgtacccccccggcgagaaccacatgttcgacagcgtggccgacatcagcgacgtgagcagcaacgtgaccctgaagagctacaccatgcacttcgagggcctggccgacaccaagatccccagaagcggcacccccgtgagcatcagaagcaacagaagcgcctgcgtgctgagaatccccagccagaaccagaccagcctgacctacagccagggcagcctgcacagaagcgtgagccagctgatggacatccaggacaagaaggtgctgatggacaacagcctgtgggaggccatcatgggccacaacagcggcctgtacgtggacgaggaggacctgatgaacgccatcaaggacttcagcagcgtgaccaaggagagaaccaccttcaccgacacccacctgtag

SEQ ID NO: 104824 - DNA, 2538 bp, Artificial Sequence
  Description of Artificial Sequence: Synthetic coding sequence
atgagaaccgaggccgtggtgaacagccagggccagaccgactacctgaccaaggacagcgaccaggacgtggccctgaagctggcccaggagagagccgagatcgtggccaagtacgacagaggcagagagggcgccgagatcgagccctgggaggacgccgactacctggtgtacaaggtgaccgacagattcggcttcctgcacgaggaggagctgcccgaccacaacgtggccgtggagagacagaagcacctggagatcgagagaaccaccaagtggctgaagatgctgaagggctgggagaagtacaagaacaccgagaagttccacagaagaatctacaagggcatccccctgcagctgagaggcgaggtgtgggccctgctgctggagatccccaagatgaaggaggagaccagagacctgtacagcaagctgaagcacagagccagaggctgcagccccgacatcagacagatcgacctggacgtgaacagaaccttcagagaccacatcatgttcagagacagatacggcgtgaagcagcagagcctgttccacgtgctggccgcctacagcatctacaacaccgaggtgggctactgccagggcatgagccagatcaccgccctgctgctgatgtacatgaacgaggaggacgccttctgggccctggtgaagctgttcagcggccccaagcacgccatgcacggcttcttcgtgcagggcttccccaagctgctgagattccaggagcaccacgagaagatcctgaacaagttcctgagcaagctgaagcagcacctggacagccaggagatctacaccagcttctacaccatgaagtggttcttccagtgcttcctggacagaacccccttcaccctgaacctgagaatctgggacatctacatcttcgagggcgagagagtgctgaccgccatgagctacaccatcctgaagctgcacaagaagcacctgatgaagctgagcatggaggagctggtggagttcttccaggagaccctggccaaggacttcttcttcgaggacgacttcgtgatcgagcagctgcagatcagcatgaccgagctgaagagagccaagctggacctgcccgagcccggcaaggaggacgagtaccccaagaagcccctgggccagctgccccccgagctgcagagctggggcgtgcaccacctgagcaacggccagagaagcgtgggcagacccagccccctggccagcggcagaagagagagcggcgccccccacagaagacacgagcacagcccccacccccagagcagaaccggcacccccgagagagcccagccccccagaagaaagagcgtggaggaggagagcaagaagctgaaggacgaggccgacttccagagaaagctgcccagcggcccccaggacagcagcagacagtacaaccacgccgccgccaaccagaacagcaacgccaccagcaacatcagaaaggagttcgtgcccaagtggaacaagcccagcgacgtgagcgccaccgagagaaccgccaagtacaccatggagggcaagggcagagccgcccaccccgccctggccgtgaccgtgcccggccccgccgaggtgagagtgagcaacgtgagacccaagatgaaggccctggacgccgaggacggcaagagaggcagcaccgccagccagtacgacaacgtgcccggccccgagctggacagcggcgccagcgtggaggaggccctggagagagcctacagccagagccccagacacgccctgtacccccccagccccagaaagcacgccgagcccagcagcagccccagcaaggtgagcaacaagttcaccttcaaggtgcagccccccagccacgccagataccccagccagctggacggcgaggccagaggcctggcccacccccccagctacagcaacccccccgtgtaccacggcaacagccccaagcacttccccaccgccaacagcagcttcgccagcccccagttcagccccggcacccagctgaaccccagcagaagaccccacggcagcaccctgagcgtgagcgccagccccgagaagagctacagcagacccagccccctggtgctgcccagcagcagaatcgaggtgctgcccgtggacaccggcgccggcggctacagcggcaacagcggcagccccaagaacggcaagctgatcatcccccccgtggactacctgcccgacaacagaacctggagcgaggtgagctacacctacagacccgagacccagggccagagctggaccagagacgccagcagaggcaacctgcccaagtacagcgccttccagctggcccccttccaggaccacggcctgcccgccgtgagcgtggacagccccgtgagatacaaggccagccccgccgccgaggacgccagccccagcggctacccctacagcggcccccccccccccgcctaccactacagaaacagagacggcctgagcatccaggagagcgtgctgctgtag

SEQ ID NO: 104825 - DNA, 2487 bp, Artificial Sequence
  Description of Artificial Sequence: Synthetic coding sequence
atgaacagcgaccaggacgtggccctgaagctggcccaggagagagccgagatcgtggccaagtacgacagaggcagagagggcgccgagatcgagccctgggaggacgccgactacctggtgtacaaggtgaccgacagattcggcttcctgcacgaggaggagctgcccgaccacaacgtggccgtggagagacagaagcacctggagatcgagagaaccaccaagtggctgaagatgctgaagggctgggagaagtacaagaacaccgagaagttccacagaagaatctacaagggcatccccctgcagctgagaggcgaggtgtgggccctgctgctggagatccccaagatgaaggaggagaccagagacctgtacagcaagctgaagcacagagccagaggctgcagccccgacatcagacagatcgacctggacgtgaacagaaccttcagagaccacatcatgttcagagacagatacggcgtgaagcagcagagcctgttccacgtgctggccgcctacagcatctacaacaccgaggtgggctactgccagggcatgagccagatcaccgccctgctgctgatgtacatgaacgaggaggacgccttctgggccctggtgaagctgttcagcggccccaagcacgccatgcacggcttcttcgtgcagggcttccccaagctgctgagattccaggagcaccacgagaagatcctgaacaagttcctgagcaagctgaagcagcacctggacagccaggagatctacaccagcttctacaccatgaagtggttcttccagtgcttcctggacagaacccccttcaccctgaacctgagaatctgggacatctacatcttcgagggcgagagagtgctgaccgccatgagctacaccatcctgaagctgcacaagaagcacctgatgaagctgagcatggaggagctggtggagttcttccaggagaccctggccaaggacttcttcttcgaggacgacttcgtgatcgagcagctgcagatcagcatgaccgagctgaagagagccaagctggacctgcccgagcccggcaaggaggacgagtaccccaagaagcccctgggccagctgccccccgagctgcagagctggggcgtgcaccacctgagcaacggccagagaagcgtgggcagacccagccccctggccagcggcagaagagagagcggcgccccccacagaagacacgagcacagcccccacccccagagcagaaccggcacccccgagagagcccagccccccagaagaaagagcgtggaggaggagagcaagaagctgaaggacgaggccgacttccagagaaagctgcccagcggcccccaggacagcagcagacagtacaaccacgccgccgccaaccagaacagcaacgccaccagcaacatcagaaaggagttcgtgcccaagtggaacaagcccagcgacgtgagcgccaccgagagaaccgccaagtacaccatggagggcaagggcagagccgcccaccccgccctggccgtgaccgtgcccggccccgccgaggtgagagtgagcaacgtgagacccaagatgaaggccctggacgccgaggacggcaagagaggcagcaccgccagccagtacgacaacgtgcccggccccgagctggacagcggcgccagcgtggaggaggccctggagagagcctacagccagagccccagacacgccctgtacccccccagccccagaaagcacgccgagcccagcagcagccccagcaaggtgagcaacaagttcaccttcaaggtgcagccccccagccacgccagataccccagccagctggacggcgaggccagaggcctggcccacccccccagctacagcaacccccccgtgtaccacggcaacagccccaagcacttccccaccgccaacagcagcttcgccagcccccagttcagccccggcacccagctgaaccccagcagaagaccccacggcagcaccctgagcgtgagcgccagccccgagaagagctacagcagacccagccccctggtgctgcccagcagcagaatcgaggtgctgcccgtggacaccggcgccggcggctacagcggcaacagcggcagccccaagaacggcaagctgatcatcccccccgtggactacctgcccgacaacagaacctggagcgaggtgagctacacctacagacccgagacccagggccagagctggaccagagacgccagcagaggcaacctgcccaagtacagcgccttccagctggcccccttccaggaccacggcctgcccgccgtgagcgtggacagccccgtgagatacaaggccagccccgccgccgaggacgccagccccagcggctacccctacagcggcccccccccccccgcctaccactacagaaacagagacggcctgagcatccaggagagcgtgctgctgtag

SEQ ID NO: 104826 - DNA, 2487 bp, Artificial Sequence; identical to SEQ ID NO: 104825
  Description of Artificial Sequence: Synthetic coding sequence

SEQ ID NO: 104827 - DNA, 762 bp, Artificial Sequence
  Description of Artificial Sequence: Synthetic coding sequence
atggccgccgccttcagaaaggccgccaagagcagacagagagagcacagagagagaagccagcccggcttcagaaagcacctgggcctgctggagaagaagaaggactacaagctgagagccgacgactacagaaagaagcaggagtacctgaaggccctgagaaagaaggccctggagaagaaccccgacgagttctactacaagatgaccagagtgaagctgcaggacggcgtgcacatcatcaaggagaccaaggaggaggtgacccccgagcagctgaagctgatgagaacccaggacgtgaagtacatcgagatgaagagagtggccgaggccaagaagatcgagagactgaagagcgagctgcacctgctggacttccagggcaagcagcagaacaagcacgtgttcttcttcgacaccaagaaggaggtggagcagttcgacgtggccacccacctgcagaccgcccccgagctggtggacagagtgttcaacagacccagaatcgagaccctgcagaaggagaaggtgaagggcgtgaccaaccagaccggcctgaagagaatcgccaaggagagacagaagcagtacaactgcctgacccagagaatcgagagagagaagaagctgttcgtgatcgcccagaagatccagaccagaaaggacctgatggacaagacccagaaggtgaaggtgaagaaggagaccgtgaacagccccgccatctacaagttccagagcagaagaaagagatag

SEQ ID NO: 104828 - DNA, 447 bp, Artificial Sequence
  Description of Artificial Sequence: Synthetic coding sequence
atggccgccgccttcagaaaggccgccaagagcagacagagagagcacagagagagaagccagcccggcttcagaaagcacctgggcctgctggagaagaagaaggactacaagctgagagccgacgactacagaaagaagcaggagtacctgaaggccctgagaaagaaggccctggagaagaaccccgacgagttctactacaagatgaccagagtgaagctgcaggacggcgtgcacatcatcaaggagaccaaggaggaggtgacccccgagcagctgaagctgatgagaacccaggacgtgaagtacatcgagatgaagagagtggccgaggccaagaagatcgagagactgaagagcgagctgcacctgctggacttccagggcaagcagcagaacaagcacgtgttcttcttcgacaccaagaaggaggccaacagctag

SEQ ID NO: 104829 - DNA, 2124 bp, Artificial Sequence
  Description of Artificial Sequence: Synthetic coding sequence
atgcccgaggaggccggcttcccccccgccaagagattcagacccggcagcggcccccccagcagagccggcagcttcccccccggcagacaggtggtgatgctgctgaccgccggcagcggcggcagaggcggcggcggcggcagaagacagcagccccccctggcccagcccagcgccagcccctaccccgaggccgtggagctgcagagaagaagcctgcccatcttccaggccagaggccagctgctggcccagctgagaaacctggacaacgccgtgctgatcggcgagaccggcagcggcaagaccacccagatcccccagtacctgtacgagggcggcatcagcagacagggcatcatcgccgtgacccagcccagaagagtggccgccatcagcctggccaccagagtgagcgacgagaagagaaccgagctgggcaagctggtgggctacaccgtgagattcgacgacgtgaccagcgaggacaccagaatcaagttcctgaccgacggcatgctgctgagagaggccatcagcgacagcctgctgagaaagtacagctgcgtgatcctggacgaggcccacgagagaaccatccacaccgacgtgctgttcggcgtggtgaaggccgcccagaagagaagaaaggagctgggcaagctgcccctgaaggtgatcgtgatgagcgccaccatggacgtggacctgttcagccagtacttcaacggcgcccccgtgctgtacctggagggcagacagcaccccatccaggtgttctacaccaagcagccccagaacgactacctgcacgccgccctggtgagcgtgttccagatccaccaggaggcccccagcagccaggacatcctggtgttcctgaccggccaggaggagatcgaggccatgagcaagacctgcagagacatcgccaagcacctgcccgacggctgccccgccatgctggtgctgcccctgtacgccagcctgccctacgcccagcagctgagagtgttccagggcgcccccaagggctacagaaaggtgatcatcagcaccaacatcgccgagaccagcatcaccatcaccggcatcaagtacgtggtggacaccggcatggtgaaggccaagaagtacaaccccgacagcggcctggaggtgctggccgtgcagagagtgagcaagacccaggcctggcagagaaccggcagagccggcagagaggacagcggcatctgctacagactgtacaccgaggacgagttcgagaagttcgacaagatgaccgtgcccgagatccagagatgcaacctggccagcgtgatgctgcagctgctggccatgaaggtgcccaacgtgctgaccttcgacttcatgagcaagcccagccccgaccacatccaggccgccatcgcccagctggacctgctgggcgccctggagcacaaggacgaccagctgaccctgacccccatgggcagaaagatggccgccttccccctggagcccaagttcgccaagaccatcctgatgagccccaagttccactgcaccgaggagatcctgaccatcgtgagcctgctgagcgtggacagcgtgctgcacaacccccccagcagaagagaggaggtgcagggcgtgagaaagaagttcatcagcagcgagggcgaccacatgaccctgctgaacatctacagaaccttcaagaacctgggcggcaacaaggactggtgcaaggagaacttcgtgaacagcaagaacatgaccctggtggccgaggtgagagcccagctgagagacatctgcctgaagatgagcatgcccatcgccagcagcagaggcgacgtggagagcgtgagaagatgcctggcccacagcctgttcatgagcaccgccgagctgcagcccgacggcacctacgccaccaccgacacccaccagcccgtggccatccaccccagcagcgtgctgttccactgcaagcccgcctgcgtggtgtacaccgagctgctgtacaccaacaagtgctacatgagagacctgtgcgtgatcgacgcccagtggctgtacgaggccgcccccgagtacttcagaagaaagctgagaaccgccagaaactag

SEQ ID NO: 104830 - DNA, 1566 bp, Artificial Sequence
  Description of Artificial Sequence: Synthetic coding sequence
atgagacccgactggaaggccggcgccggccccggcggccccccccagaagcccgcccccagcagccagagaaagccccccgccagacccagcgccgccgccgccgccatcgccgtggccgccgccgaggaggagagaagactgagacagagaaacagactgagactggaggaggacaagcccgccgtggagagatgcctggaggagctggtgttcggcgacgtggagaacgacgaggacgccctgctgagaagactgagaggccccagagtgcaggagcacgaggacagcggcgacagcgaggtggagaacgaggccaagggcaacttccccccccagaagaagcccgtgtgggtggacgaggaggacgaggacgaggagatggtggacatgatgaacaacagattcagaaaggacatgatgaagaacgccagcgagagcaagctgagcaaggacaacctgaagaagagactgaaggaggagttccagcacgccatgggcggcgtgcccgcctgggccgagaccaccaagagaaagaccagcagcgacgacgagagcgaggaggacgaggacgacctgctgcagagaaccggcaacttcatcagcaccagcaccagcctgcccagaggcatcctgaagatgaagaactgccagcacgccaacgccgagagacccaccgtggccagaatcagcagcgtgcagttccaccccggcgcccagatcgtgatggtggccggcctggacaacgccgtgagcctgttccaggtggacggcaagaccaaccccaagatccagagcatctacctggagagattccccatcttcaaggcctgcttcagcgccaacggcgaggaggtgctggccaccagcacccacagcaaggtgctgtacgtgtacgacatgctggccggcaagctgatccccgtgcaccaggtgagaggcctgaaggagaagatcgtgagaagcttcgaggtgagccccgacggcagcttcctgctgatcaacggcatcgccggctacctgcacctgctggccatgaagaccaaggagctgatcggcagcatgaagatcaacggcagagtggccgccagcaccttcagcagcgacagcaagaaggtgtacgccagcagcggcgacggcgaggtgtacgtgtgggacgtgaacagcagaaagtgcctgaacagattcgtggacgagggcagcctgtacggcctgagcatcgccaccagcagaaacggccagtacgtggcctgcggcagcaactgcggcgtggtgaacatctacaaccaggacagctgcctgcaggagaccaaccccaagcccatcaaggccatcatgaacctggtgaccggcgtgaccagcctgaccttcaaccccaccaccgagatcctggccatcgccagcgagaagatgaaggaggccgtgagactggtgcacctgcccagctgcaccgtgttcagcaacttccccgtgatcaagaacaagaacatcagccacgtgcacaccatggacttcagccccagaagcggctacttcgccctgggcaacgagaaggccagaccctag

SEQ ID NO: 104831 - DNA, 8358 bp, Artificial Sequence
  Description of Artificial Sequence: Synthetic coding sequence
atgaagaccaagcccgtgagccacaagaccgagaacacctacagattcctgaccttcgccgagagactgggcaacgtgaacatcgacatcatccacagaatcgacagaaccgccagctacgaggaggaggtggagacctacttcttcgagggcctgctgaagtggagagagctgaacctgaccgagcacttcggcaagttctacaaggaggtgatcgacaagtgccagagcttcaaccagctggtgtaccaccagaacgagatcgtgcagagcctgaagacccacctgcaggtgaagaacagcttcgcctaccagcccctgctggacctggtggtgcagctggccagagacctgcagatggacttctacccccacttccccgagttcttcctgaccatcaccagcatcctggagacccaggacaccgagctgctggagtgggccttcaccagcctgagctacctgtacaagtacctgtggagactgatggtgaaggacatgagcagcatctacagcatgtacagcaccctgctggcccacaagaagctgcacatcagaaacttcgccgccgagagcttcaccttcctgatgagaaaggtgagcgacaagaacgccctgttcaacctgatgttcctggacctggacaagcaccccgagaaggtggagggcgtgggccagctgctgttcgagatgtgcaagggcgtgagaaacatgttccacagctgcaccggccaggccgtgaagctgatcctgagaaagctgggccccgtgaccgagaccgagacccagctgccctggatgctgatcggcgagaccctgaagaacatggtgaagagcaccgtgagctacatcagcaaggagcacttcggcaccttcttcgagtgcctgcaggagagcctgctggacctgcacaccaaggtgaccaagaccaactgctgcgagagcagcgagcagatcaagagactgctggagacctacctgatcctggtgaagcacggcagcggcaccaagatccccacccccgccgacgtgtgcaaggtgctgagccagaccctgcaggtggccagcctgagcaccagctgctgggagaccctgctggacgtgatcagcgccctgatcctgggcgagaacgtgagcctgcccgagaccctgatcaaggagaccatcgagaagatcttcgagagcagattcgagaagagactgatcttcagcttcagcgaggtgatgttcgccatgaagcagttcgagcagctgttcctgcccagcttcctgagctacatcgtgaactgcttcctgatcgacgacgccgtggtgaaggacgaggccctggccatcctggccaagctgatcctgaacaaggccgccccccccaccgccggcagcatggccatcgagaagtaccccctggtgttcagcccccagatggtgggcttctacatcaagcagaagaagaccagaagcaagggcagaaacgagcagttccccgtgctggaccacctgctgagcatcatcaagctgccccccaacaaggacaccacctacctgagccagagctgggccgccctggtggtgctgccccacatcagacccctggagaaggagaaggtgatccccctggtgaccggcttcatcgaggccctgttcatgaccgtggacaagggcagcttcggcaagggcaacctgttcgtgctgtgccaggccgtgaacaccctgctgagcctggaggagagcagcgagctgctgcacctggtgcccgtggagagagtgaagaacctggtgctgaccttccccctggagcccagcgtgctgctgctgaccgacctgtactaccagagactggccctgtgcggctgcaagggccccctgagccaggaggccctgatggagctgttccccaagctgcaggccaacatcagcaccggcgtgagcaagatcagactgctgaccatcagaatcctgaaccacttcgacgtgcagctgcccgagagcatggaggacgacggcctgagcgagagacagagcgtgttcgccatcctgagacaggccgagctggtgcccgccaccgtgaacgactacagagagaagctgctgcacctgagaaagctgagacacgacgtggtgcagaccgccgtgcccgacggccccctgcaggaggtgcccctgagatacctgctgggcatgctgtacatcaacttcagcgccctgtgggaccccgtgatcgagctgatcagcagccacgcccacgagatggagaacaagcagttctggaaggtgtactacgagcacctggagaaggccgccacccacgccgagaaggagctgcagaacgacatgaccgacgagaagagcgtgggcgacgagagctgggagcagacccaggagggcgacgtgggcgccctgtaccacgagcagctggccctgaagaccgactgccaggagagactggaccacaccaacttcagattcctgctgtggagagccctgaccaagttccccgagagagtggagcccagaagcagagagctgagccccctgttcctgagattcatcaacaacgagtactaccccgccgacctgcaggtggcccccacccaggacctgagaagaaagggcaagggcatggtggccgaggagatcgaggaggagcccgccgccggcgacgacgaggagctggaggaggaggccgtgccccaggacgagagcagccagaagaagaagaccagaagagccgccgccaagcagctgatcgcccacctgcaggtgttcagcaagttcagcaaccccagagccctgtacctggagagcaagctgtacgagctgtacctgcagctgctgctgcaccaggaccagatggtgcagaagatcaccctggactgcatcatgacctacaagcacccccacgtgctgccctacagagagaacctgcagagactgctggaggacagaagcttcaaggaggagatcgtgcacttcagcatcagcgaggacaacgccgtggtgaagaccgcccacagagccgacctgttccccatcctgatgagaatcctgtacggcagaatgaagaacaagaccggcagcaagacccagggcaagagcgccagcggcaccagaatggccatcgtgctgagattcctggccggcacccagcccgaggagatccagatcttcctggacctgctgttcgagcccgtgagacacttcaagaacggcgagtgccacagcgccgtgatccaggccgtggaggacctggacctgagcaaggtgctgcccctgggcagacagcacggcatcctgaacagcctggagatcgtgctgaagaacatcagccacctgatcagcgcctacctgcccaagatcctgcagatcctgctgtgcatgaccgccaccgtgagccacatcctggaccagagagagaagatccagctgagattcatcaaccccctgaagaacctgagaagactgggcatcaagatggtgaccgacatcttcctggactgggagagctaccagttcagaaccgaggagatcgacgccgtgttccacggcgccgtgtggccccagatcagcagactgggcagcgagagccagtacagccccacccccctgctgaagctgatcagcatctggagcagaaacgccagatacttccccctgctggccaagcagaagcccggccaccccgagtgcgacatcctgaccaacgtgttcgccatcctgagcgccaagaacctgagcgacgccaccgccagcatcgtgatggacatcgtggacgacctgctgaacctgcccgacttcgagcccaccgagaccgtgctgaacctgctggtgaccggctgcgtgtaccccggcatcgccgagaacatcggcgagagcatcaccatcggcggcagactgatcctgccccacgtgcccgccatcctgcagtacctgagcaagaccaccatcagcgccgagaaggtgaagaagaagaagaacagagcccaggtgagcaaggagctgggcatcctgagcaagatcagcaagttcatgaaggacaaggagcagagcagcgtgctgatcaccctgctgctgcccttcctgcacagaggcaacatcgccgaggacaccgaggtggacatcctggtgaccgtgcagaacctgctgaagcactgcgtggaccccaccagcttcctgaagcccatcgccaagctgttcagcgtgatcaagaacaagctgagcagaaagctgctgtgcaccgtgttcgagaccctgagcgacttcgagagcggcctgaagtacatcaccgacgtggtgaagctgaacgccttcgaccagagacacctggacgacatcaacttcgacgtgagattcgagaccttccagaccatcaccagctacatcaaggagatgcagatcgtggacgtgaactacctgatccccgtgatgcacaactgcttctacaacctggagctgggcgacatgagcctgagcgacaacgccagcatgtgcctgatgagcatcatcaagaagctggccgccctgaacgtgaccgagaaggactacagagagatcatccacagaagcctgctggagaagctgagaaagggcctgaagagccagaccgagagcatccagcaggactacaccaccatcctgagctgcctgatccagaccttccccaaccagctggagttcaaggacctggtgcagctgacccactaccacgaccccgagatggacttcttcgagaacatgaagcacatccagatccacagaagagccagagccctgaagaagctggccaagcagctgatggagggcaaggtggtgctgagcagcaagagcctgcagaactacatcatgccctacgccatgacccccatcttcgacgagaagatgctgaagcacgagaacatcaccaccgccgccaccgagatcatcggcgccatctgcaagcacctgagctggagcgcctacatgtactacctgaagcacttcatccacgtgctgcagaccggccagatcaaccagaagctgggcgtgagcctgctggtgatcgtgctggaggccttccacttcgaccacaagaccctggaggagcagatgggcaagatcgagaacgaggagaacgccatcgaggccatcgagctgcccgagcccgaggccatggagctggagagagtggacgaggaggagaaggagtacacctgcaagagcctgagcgacaacggccagcccggcacccccgaccccgccgacagcggcggcaccagcgccaaggagagcgagtgcatcaccaagcccgtgagcttcctgccccagaacaaggaggagatcgagagaaccatcaagaacatccagggcaccatcaccggcgacatcctgcccagactgcacaagtgcctggccagcaccaccaagagagaggaggagcacaagctggtgaagagcaaggtggtgaacgacgaggaggtggtgagagtgcccctggccttcgccatggtgaagctgatgcagagcctgccccaggaggtgatggaggccaacctgcccagcatcctgctgaaggtgtgcgccctgctgaagaacagagcccaggagatcagagacatcgccagaagcaccctggccaagatcatcgaggacctgggcgtgcacttcctgctgtacgtgctgaaggagctgcagaccaccctggtgagaggctaccaggtgcacgtgctgaccttcaccgtgcacatgctgctgcagggcctgaccaacaagctgcaggtgggcgacctggacagctgcctggacatcatgatcgagatcttcaaccacgagctgttcggcgccgtggccgaggagaaggaggtgaagcagatcctgagcaaggtgatggaggccagaagaagcaagagctacgacagctacgagatcctgggcaagttcgtgggcaaggaccaggtgaccaagctgatcctgcccctgaaggagatcctgcagaacaccaccagcctgaagctggccagaaaggtgcacgagaccctgagaagaatcaccgtgggcctgatcgtgaaccaggagatgaccgccgagagcatcctgctgctgagctacggcctgatcagcgagaacctgcccctgctgaccgagaaggagaagaaccccgtggcccccgcccccgaccccagactgcccccccagagctgcctgctgctgccccccacccccgtgagaggcggccagaaggccgtggtgagcagaaagaccaacatgcacatcttcatcgagagcggcctgagactgctgcacctgagcctgaagaccagcaagatcaagagcagcggcgagtgcgtgctggagatgctggaccccttcgtgagcctgctgatcgactgcctgggcagcatggacgtgaaggtgatcaccggcgccctgcagtgcctgatctgggtgctgagattccccctgcccagcatcgagaccaaggccgagcagctgaccaagcacctgttcctgctgctgaaggactacgccaagctgggcgccgccagaggccagaacttccacctggtggtgaactgcttcaagtgcgtgaccatcctggtgaagaaggtgaagagctaccagatcaccgagaagcagctgcaggtgctgctggcctacgccgaggaggacatctacgacaccagcagacaggccaccgccttcggcctgctgaaggccatcctgagcagaaagctgctggtgcccgagatcgacgaggtgatgagaaaggtgagcaagctggccgtgagcgcccagagcgagcccgccagagtgcagtgcagacaggtgttcctgaagtacatcctggactaccccctgggcgacaagctgagacccaacctggagttcatgctggcccagctgaactacgagcacgagaccggcagagagagcaccctggagatgatcgcctacctgttcgacaccttcccccagggcctgctgcacgagaactgcggcatgttcttcatccccctgtgcctgatgaccatcaacgacgacagcgccacctgcaagaagatggccagcatgaccatcaagagcctgctgggcaagatcagcctggagaagaaggactggctgttcgacatggtgaccacctggttcggcgccaagaagagactgaacagacagctggccgccctgatctgcggcctgttcgtggagagcgagggcgtggacttcgagaagagactgggcaccgtgctgcccgtgatcgagaaggagatcgaccccgagaacttcaaggacatcatggaggagaccgaggagaaggccgccgacagactgctgttcagcttcctgaccctgatcaccaagctgatcaaggagtgcaacatcatccagttcaccaagcccgccgagaccctgagcaagatctggagccacgtgcacagccacctgagacacccccacaactgggtgtggctgaccgccgcccagatcttcggcctgctgttcgccagctgccagcccgaggagctgatccagaagtggaacaccaagaagaccaagaagcacctgcccgagcccgtggccatcaagttcctggccagcgacctggaccagaagatgaagagcatcagcctggccagctgccaccagctgcacagcaagttcctggaccagagcctgggcgagcaggtggtgaagaacctgctgttcgccgccaaggtgctgtacctgctggagctgtactgcgaggacaagcagagcaagatcaaggaggacctggaggagcaggaggccctggaggacggcgtggcctgcgccgacgagaaggccgagagcgacggcgaggagaaggaggaggtgaaggaggagctgggcagacccgccaccctgctgtggctgatccagaagctgagcagaatcgccaagctggaggccgcctacagccccagaaaccccctgaagagaacctgcatcttcaagttcctgggcgccgtggccatggacctgggcatcgacaaggtgaagccctacctgcccatgatcatcgcccccctgttcagagagctgaacagcacctacagcgagcaggaccccctgctgaagaacctgagccaggagatcatcgagctgctgaagaagctggtgggcctggagagcttcagcctggccttcgccagcgtgcagaagcaggccaacgagaagagagccctgagaaagaagagaaaggccctggagttcgtgaccaaccccgacatcgccgccaagaagaagatgaagaagcacaagaacaagagcgaggccaagaagagaaagatcgagttcctgagacccggctacaaggccaagagacagaagagccacagcctgaaggacctggccatggtggagtag

SEQ ID NO: 104832 - DNA, 1440 bp, Artificial Sequence
  Description of Artificial Sequence: Synthetic coding sequence
atggtgggcagaagcagaagaagaggcgccgccaagtgggccgccgtgagagccaaggccggccccaccctgaccgacgagaacggcgacgacctgggcctgccccccagccccggcgacaccagctactaccaggaccaggtggacgacttccacgaggccagaagcagagccgccctggccaagggctggaacgaggtgcagagcggcgacgaggaggacggcgaggaggaggaggaggaggtgctggccctggacatggacgacgaggacgacgaggacggcggcaacgccggcgaggaggaggaggaggagaacgccgacgacgacggcggcagcagcgtgcagagcgaggccgaggccagcgtggaccccagcctgagctggggccagagaaagaagctgtactacgacaccgactacggcagcaagagcagaggcagacagagccagcaggaggccgaggaggaggagagagaggaggaggaggaggcccagatcatccagagaagactggcccaggccctgcaggaggacgacttcggcgtggcctgggtggaggccttcgccaagcccgtgccccaggtggacgaggccgagaccagagtggtgaaggacctggccaaggtgagcgtgaaggagaagctgaagatgctgagaaaggagagccccgagctgctggagctgatcgaggacctgaaggtgaagctgaccgaggtgaaggacgagctggagcccctgctggagctggtggagcagggcatcatcccccccggcaagggcagccagtacctgagaaccaagtacaacctgtacctgaactactgcagcaacatcagcttctacctgatcctgaaggccagaagagtgcccgcccacggccaccccgtgatcgagagactggtgacctacagaaacctgatcaacaagctgagcgtggtggaccagaagctgagcagcgagatcagacacctgctgaccctgaaggacgacgccgtgaagaaggagctgatccccaaggccaagagcaccaagcccaagcccaagagcgtgagcaagaccagcgccgccgcctgcgccgtgaccgacctgagcgacgacagcgacttcgacgagaaggccaagctgaagtactacaaggagatcgaggacagacagaagctgaagagaaagaaggaggagaacagcaccgaggagcaggccctggaggaccagaacgccaagagagccatcacctaccagatcgccaagaacagaggcctgacccccagaagaaagaagatcgacagaaaccccagagtgaagcacagagagaagttcagaagagccaagatcagaagaagaggccaggtgagagaggtgagaaaggaggagcagagatacagcggcgagctgagcggcatcagagccggcgtgaagaagagcatcaagctgaagtag

SEQ ID NO: 104833 - DNA, 756 bp, Artificial Sequence
  Description of Artificial Sequence: Synthetic coding sequence
tgaatcggcctgatgagcctgagcaagggcctgctggaggagaagtacagatacctgttcaaggaggtggccggccccaccgagatgtgcgaccagagacagctgggcctgctgctgcacgacgccatccagatccccagacagctgggcgaggtggccgccttcggcggcagcaacatcgagcccagcgtgagaagctgcttccagcagaacaacaacaagcccgagatcagcgtgaaggagttcatcgactggatgcacctggagccccagagcatggtgtggctgcccgtgctgcacagagtggccgccgccgagaccgccaagcaccaggccaagtgcaacatctgcaaggagtgccccatcgtgggcttcagatacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccagccagagcccccagctgttccacgacgacacccacagcagaatcgagcagtacgccaccagactggcccagatggagagaaccaacggcagcttcctgaccgacagcagcagcaccaccggctag

SEQ ID NO: 104834 - DNA, 201 bp, Artificial Sequence
  Description of Artificial Sequence: Synthetic coding sequence
atgatcggcctgaacttcaacctgagagagctgctgaccaagttcgagaaggacatccaggccgagatcgacgcccacaacgacatcttcaagagcatcgacggcaacagacagaagatggtgaaggccctgggcaacagcgaggaggccaccatgctgcagcacagactggacgacatgaaccagagatggaacgactag

SEQ ID NO: 104835 - DNA, 2967 bp, Artificial Sequence
  Description of Artificial Sequence: Synthetic coding sequence
atgcagatcctgagatgcctgcagaagtgcggcaagctgaagatgatggccgtggtgagaaccagcctgcagaaggtggtggtgctgctgcacagactgcagagaatggccgtgagcagccccagataccagaagctgtgcaaggacatccaggccgagatcgacgcccacaacgacatcttcaagagcatcgacggcaacagacagaagatggtgaaggccctgggcaacagcgaggaggccaccatgctgcagcacagactggacgacatgaaccagagatggaacgacctgaaggccaagagcgccagcatcagagcccacctggaggccagcgccgagaagtggaacagactgctgatgagcctggaggagctgatcaagtggctgaacatgaaggacgaggagctgaagaagcagatgcccatcggcggcgacgtgcccgccctgcagctgcagtacgaccactgcaaggccctgagaagagagctgaaggagaaggagtacagcgtgctgaacgccgtggaccaggccagagtgttcctggccgaccagcccatcgaggcccccgaggagcccagaagaaacctgcagagcaagaccgagctgacccccgaggagagagcccagaagatcgccaaggccatgagaaagcagagcagcgaggtgaaggagaagtgggagagcctgaacgccgtgaccagcaactggcagaagcaggtggacaaggccctggagaagctgagagacctgcagggcgccatggacgacctggacgccgacatgaaggaggccgagagcgtgagaaacggctggaagcccgtgggcgacctgctgatcgacagcctgcaggaccacatcgagaagatcatggccttcagagaggagatcgcccccatcaacttcaaggtgaagaccgtgaacgacctgagcagccagctgagccccctggacctgcaccccagcctgaagatgagcagacagctggacgacctgaacatgagatggaagctgctgcaggtgagcgtggacgacagactgaagcagctgcaggaggcccacagagacttcggccccagcagccagcacttcctgagcaccagcgtgcagctgccctggcagagaagcatcagccacaacaaggtgccctactacatcaaccaccagacccagaccacctgctgggaccaccccaagatgaccgagctgttccagagcctggccgacctgaacaacgtgagattcagcgcctacagaaccgccatcaagatcagaagactgcagaaggccctgtgcctggacctgctggagctgagcaccaccaacgagatcttcaagcagcacaagctgaaccagaacgaccagctgctgagcgtgcccgacgtgatcaactgcctgaccaccacctacgacggcctggagcagatgcacaaggacctggtgaacgtgcccctgtgcgtggacatgtgcctgaactggctgctgaacgtgtacgacaccggcagaaccggcaagatcagagtgcagagcctgaagatcggcctgatgagcctgagcaagggcctgctggaggagaagtacagatacctgttcaaggaggtggccggccccaccgagatgtgcgaccagagacagctgggcctgctgctgcacgacgccatccagatccccagacagctgggcgaggtggccgccttcggcggcagcaacatcgagcccagcgtgagaagctgcttccagcagaacaacaacaagcccgagatcagcgtgaaggagttcatcgactggatgcacctggagccccagagcatggtgtggctgcccgtgctgcacagagtggccgccgccgagaccgccaagcaccaggccaagtgcaacatctgcaaggagtgccccatcgtgggcttcagatacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccatcaccctgatcagcatgtggcccgagcactacgaccccagccagagcccccagctgttccacgacgacacccacagcagaatcgagcagtacgccaccagactggcccagatggagagaaccaacggcagcttcctgaccgacagcagcagcaccaccggcagcgtggaggacgagcacgccctgatccagcagtactgccagaccctgggcggcgagagccccgtgagccagccccagagccccgcccagatcctgaagagcgtggagagagaggagagaggcgagctggagagaatcatcgccgacctggaggaggagcagagaaacctgcaggtggagtacgagcagctgaaggaccagcacctgagaagaggcctgcccgtgggcagcccccccgagagcatcatcagcccccaccacaccagcgaggacagcgagctgatcgccgaggccaagctgctgagacagcacaagggcagactggaggccagaatgcagatcctggaggaccacaacaagcagctggagagccagctgcacagactgagacagctgctggagcagcccgagagcgacagcagaatcaacggcgtgagcccctgggccagcccccagcacagcgccctgagctacagcctggaccccgacgccagcggcccccagttccaccaggccgccggcgaggacctgctggcccccccccacgacaccagcaccgacctgaccgaggtgatggagcagatccacagcaccttccccagctgctgccccaacgtgcccagcagaccccaggccatgtag

SEQ ID NO: 104836 - DNA, 3069 bp, Artificial Sequence
  Description of Artificial Sequence: Synthetic coding sequence
atggccaagtacggcgagcacgaggccagccccgacaacggccagaacgagttcagcgacatcatcaagagcagaagcgacgagcacaacgacgtgcagaagaagaccttcaccaagtggatcaacgccagattcagcaagagcggcaagccccccatcaacgacatgttcaccgacctgaaggacggcagaaagctgctggacctgctggagggcctgaccggcaccagcctgcccaaggagagaggcagcaccagagtgcacgccctgaacaacgtgaacagagtgctgcaggtgctgcaccagaacaacgtggagctggtgaacatcggcggcaccgacatcgtggacggcaaccacaagctgaccctgggcctgctgtggagcatcatcctgcactggcaggtgaaggacgtgatgaaggacgtgatgagcgacctgcagcagaccaacagcgagaagatcctgctgagctgggtgagacagaccaccagaccctacagccaggtgaacgtgctgaacttcaccaccagctggaccgacggcctggccttcaacgccgtgctgcacagacacaagcccgacctgttcagctgggacaaggtggtgaagatgagccccatcgagagactggagcacgccttcagcaaggcccagacctacctgggcatcgagaagctgctggaccccgaggacgtggccgtgcagctgcccgacaagaagagcatcatcatgtacctgaccagcctgttcgaggtgctgccccagcaggtgaccatcgacgccatcagagaggtggagaccctgcccagaaagtacaagaaggagtgcgaggaggaggccatcaacatccagagcaccgcccccgaggaggagcacgagagccccagagccgagacccccagcaccgtgaccgaggtggacatggacctggacagctaccagatcgccctggaggaggtgctgacctggctgctgagcgccgaggacaccttccaggagcaggacgacatcagcgacgacgtggaggaggtgaaggaccagttcgccacccacgaggccttcatgatggagctgaccgcccaccagagcagcgtgggcagcgtgctgcaggccggcaaccagctgatcacccagggcaccctgagcgacgaggaggagttcgagatccaggagcagatgaccctgctgaacgccagatgggaggccctgagagtggagagcatggacagacagagcagactgcacgacgtgctgatggagctgcagaagaagcagctgcagcagctgagcgcctggctgaccctgaccgaggagagaatccagaagatggagacctgccccctggacgacgacgtgaagagcctgcagaagctgctggaggagcacaagagcctgcagagcgacctggaggccgagcaggtgaaggtgaacagcctgacccacatggtggtgatcgtggacgagaacagcggcgagagcgccaccgccatcctggaggaccagctgcagaagctgggcgagagatggaccgccgtgtgcagatggaccgaggagagatggaacagactgcaggagatcaacatcctgtggcaggagctgctggaggagcagtgcctgctgaaggcctggctgaccgagaaggaggaggccctgaacaaggtgcagaccagcaacttcaaggaccagaaggagctgagcgtgagcgtgagaagactggccatcctgaaggaggacatggagatgaagagacagaccctggaccagctgagcgagatcggccaggacgtgggccagctgctggacaacagcaaggccagcaagaagatcaacagcgacagcgaggagctgacccagagatgggacagcctggtgcagagactggaggacagcagcaaccaggtgacccaggccgtggccaagctgggcatgagccagatcccccagaaggacctgctggagaccgtgagagtgagagagcaggccatcaccaagaagagcaagcaggagctgccccccccccccccccccaagaagagacagatccacgtggacatcgaggccaagaagaagttcgacgccatcagcgccgagctgctgaactggatcctgaagtggaagaccgccatccagaccaccgagatcaaggagtacatgaagatgcaggacaccagcgagatgaagaagaagctgaaggccctggagaaggagcagagagagagaatccccagagccgacgagctgaaccagaccggccagatcctggtggagcagatgggcaaggagggcctgcccaccgaggagatcaagaacgtgctggagaaggtgagcagcgagtggaagaacgtgagccagcacctggaggacctggagagaaagatccagctgcaggaggacatcaacgcctacttcaagcagctggacgagctggagaaggtgatcaagaccaaggaggagtgggtgaagcacaccagcatcagcgagagcagcagacagagcctgcccagcctgaaggacagctgccagagagagctgaccaacctgctgggcctgcaccccaagatcgagatggccagagccagctgcagcgccctgatgagccagcccagcgcccccgacttcgtgcagagaggcttcgacagcttcctgggcagataccaggccgtgcaggaggccgtggaggacagacagcagcacctggagaacgagctgaagggccagcccggccacgcctacctggagaccctgaagaccctgaaggacgtgctgaacgacagcgagaacaaggcccaggtgagcctgaacgtgctgaacgacctggccaaggtggagaaggccctgcaggagaagaagaccctggacgagatcctggagaaccagaagcccgccctgcacaagctggccgaggagaccaaggccctggagaagaacgtgcaccccgacgtggagaagctgtacaagcaggagttcgacgacgtgcagggcaagtggaacaagctgaaggtgctggtgagcaaggacctgcacctgctggaggagatcgccctgaccctgagagccttcgagtag

SEQ ID NO: 104837 - DNA, 10302 bp, Artificial Sequence
  Description of Artificial Sequence: Synthetic coding sequence
atggccaagtacggcgagcacgaggccagccccgacaacggccagaacgagttcagcgacatcatcaagagcagaagcgacgagcacaacgacgtgcagaagaagaccttcaccaagtggatcaacgccagattcagcaagagcggcaagccccccatcaacgacatgttcaccgacctgaaggacggcagaaagctgctggacctgctggagggcctgaccggcaccagcctgcccaaggagagaggcagcaccagagtgcacgccctgaacaacgtgaacagagtgctgcaggtgctgcaccagaacaacgtggagctggtgaacatcggcggcaccgacatcgtggacggcaaccacaagctgaccctgggcctgctgtggagcatcatcctgcactggcaggtgaaggacgtgatgaaggacgtgatgagcgacctgcagcagaccaacagcgagaagatcctgctgagctgggtgagacagaccaccagaccctacagccaggtgaacgtgctgaacttcaccaccagctggaccgacggcctggccttcaacgccgtgctgcacagacacaagcccgacctgttcagctgggacaaggtggtgaagatgagccccatcgagagactggagcacgccttcagcaaggcccagacctacctgggcatcgagaagctgctggaccccgaggacgtggccgtgcagctgcccgacaagaagagcatcatcatgtacctgaccagcctgttcgaggtgctgccccagcaggtgaccatcgacgccatcagagaggtggagaccctgcccagaaagtacaagaaggagtgcgaggaggaggccatcaacatccagagcaccgcccccgaggaggagcacgagagccccagagccgagacccccagcaccgtgaccgaggtggacatggacctggacagctaccagatcgccctggaggaggtgctgacctggctgctgagcgccgaggacaccttccaggagcaggacgacatcagcgacgacgtggaggaggtgaaggaccagttcgccacccacgaggccttcatgatggagctgaccgcccaccagagcagcgtgggcagcgtgctgcaggccggcaaccagctgatcacccagggcaccctgagcgacgaggaggagttcgagatccaggagcagatgaccctgctgaacgccagatgggaggccctgagagtggagagcatggacagacagagcagactgcacgacgtgctgatggagctgcagaagaagcagctgcagcagctgagcgcctggctgaccctgaccgaggagagaatccagaagatggagacctgccccctggacgacgacgtgaagagcctgcagaagctgctggaggagcacaagagcctgcagagcgacctggaggccgagcaggtgaaggtgaacagcctgacccacatggtggtgatcgtggacgagaacagcggcgagagcgccaccgccatcctggaggaccagctgcagaagctgggcgagagatggaccgccgtgtgcagatggaccgaggagagatggaacagactgcaggagatcaacatcctgtggcaggagctgctggaggagcagtgcctgctgaaggcctggctgaccgagaaggaggaggccctgaacaaggtgcagaccagcaacttcaaggaccagaaggagctgagcgtgagcgtgagaagactggccatcctgaaggaggacatggagatgaagagacagaccctggaccagctgagcgagatcggccaggacgtgggccagctgctggacaacagcaaggccagcaagaagatcaacagcgacagcgaggagctgacccagagatgggacagcctggtgcagagactggaggacagcagcaaccaggtgacccaggccgtggccaagctgggcatgagccagatcccccagaaggacctgctggagaccgtgagagtgagagagcaggccatcaccaagaagagcaagcaggagctgccccccccccccccccccaagaagagacagatccacgtggacatcgaggccaagaagaagttcgacgccatcagcgccgagctgctgaactggatcctgaagtggaagaccgccatccagaccaccgagatcaaggagtacatgaagatgcaggacaccagcgagatgaagaagaagctgaaggccctggagaaggagcagagagagagaatccccagagccgacgagctgaaccagaccggccagatcctggtggagcagatgggcaaggagggcctgcccaccgaggagatcaagaacgtgctggagaaggtgagcagcgagtggaagaacgtgagccagcacctggaggacctggagagaaagatccagctgcaggaggacatcaacgcctacttcaagcagctggacgagctggagaaggtgatcaagaccaaggaggagtgggtgaagcacaccagcatcagcgagagcagcagacagagcctgcccagcctgaaggacagctgccagagagagctgaccaacctgctgggcctgcaccccaagatcgagatggccagagccagctgcagcgccctgatgagccagcccagcgcccccgacttcgtgcagagaggcttcgacagcttcctgggcagataccaggccgtgcaggaggccgtggaggacagacagcagcacctggagaacgagctgaagggccagcccggccacgcctacctggagaccctgaagaccctgaaggacgtgctgaacgacagcgagaacaaggcccaggtgagcctgaacgtgctgaacgacctggccaaggtggagaaggccctgcaggagaagaagaccctggacgagatcctggagaaccagaagcccgccctgcacaagctggccgaggagaccaaggccctggagaagaacgtgcaccccgacgtggagaagctgtacaagcaggagttcgacgacgtgcagggcaagtggaacaagctgaaggtgctggtgagcaaggacctgcacctgctggaggagatcgccctgaccctgagagccttcgaggccgacagcaccgtgatcgagaagtggatggacggcgtgaaggacttcctgatgaagcagcaggccgcccagggcgacgacgccggcctgcagagacagctggaccagtgcagcgccttcgtgaacgagatcgagaccatcgagagcagcctgaagaacatgaaggagatcgagaccaacctgagaagcggccccgtggccggcatcaagacctgggtgcagaccagactgggcgactaccagacccagctggagaagctgagcaaggagatcgccacccagaagagcagactgagcgagagccaggagaaggccgccaacctgaagaaggacctggccgagatgcaggagtggatgacccaggccgaggaggagtacctggagagagacttcgagtacaagagccccgaggagctggagagcgccgtggaggagatgaagagagccaaggaggacgtgctgcagaaggaggtgagagtgaagatcctgaaggacaacatcaagctgctggccgccaaggtgcccagcggcggccaggagctgaccagcgagctgaacgtggtgctggagaactaccagctgctgtgcaacagaatcagaggcaagtgccacaccctggaggaggtgtggagctgctggatcgagctgctgcactacctggacctggagaccacctggctgaacaccctggaggagagaatgaagagcaccgaggtgctgcccgagaagaccgacgccgtgaacgaggccctggagagcctggagagcgtgctgagacaccccgccgacaacagaacccagatcagagagctgggccagaccctgatcgacggcggcatcctggacgacatcatcagcgagaagctggaggccttcaacagcagatacgaggacctgagccacctggccgagagcaagcagatcagcctggagaagcagctgcaggtgctgagagagaccgaccagatgctgcaggtgctgcaggagagcctgggcgagctggacaagcagctgaccacctacctgaccgacagaatcgacgccttccaggtgccccaggaggcccagaagatccaggccgagatcagcgcccacgagctgaccctggaggagctgagaagaaacatgagaagccagcccctgaccagccccgagagcagaaccgccagaggcggcagccagatggacgtgctgcagagaaagctgagagaggtgagcaccaagttccagctgttccagaagcccgccaacttcgagcagagaatgctggactgcaagagagtgctggacggcgtgaaggccgagctgcacgtgctggacgtgaaggacgtggaccccgacgtgatccagacccacctggacaagtgcatgaagctgtacaagaccctgagcgaggtgaagctggaggtggagaccgtgatcaagaccggcagacacatcgtgcagaagcagcagaccgacaaccccaagggcatggacgagcagctgaccagcctgaaggtgctgtacaacgacctgggcgcccaggtgaccgagggcaagcaggacctggagagagccagccagctggccagaaagatgaagaaggaggccgccagcctgagcgagtggctgagcgccaccgagaccgagctggtgcagaagagcaccagcgagggcctgctgggcgacctggacaccgagatcagctgggccaagaacgtgctgaaggacctggagaagagaaaggccgacctgaacaccatcaccgagagcagcgccgccctgcagaacctgatcgagggcagcgagcccatcctggaggagagactgtgcgtgctgaacgccggctggagcagagtgagaacctggaccgaggactggtgcaacaccctgatgaaccaccagaaccagctggagatcttcgacggcaacgtggcccacatcagcacctggctgtaccaggccgaggccctgctggacgagatcgagaagaagcccaccagcaagcaggaggagatcgtgaagagactggtgagcgagctggacgacgccaacctgcaggtggagaacgtgagagaccaggccctgatcctgatgaacgccagaggcagcagcagcagagagctggtggagcccaagctggccgagctgaacagaaacttcgagaaggtgagccagcacatcaagagcgccaagctgctgatcgcccaggagcccctgtaccagtgcctggtgaccaccgagaccttcgagaccggcgtgcccttcagcgacctggagaagctggagaacgacatcgagaacatgctgaagttcgtggagaagcacctggagagcagcgacgaggacgagaagatggacgaggagagcgcccagatcgaggaggtgctgcagagaggcgaggagatgctgcaccagcccatggaggacaacaagaaggagaagatcagactgcagctgctgctgctgcacaccagatacaacaagatcaaggccatccccatccagcagagaaagatgggccagctggccagcggcatcagaagcagcctgctgcccaccgactacctggtggagatcaacaagatcctgctgtgcatggacgacgtggagctgagcctgaacgtgcccgagctgaacaccgccatctacgaggacttcagcttccaggaggacagcctgaagaacatcaaggaccagctggacaagctgggcgagcagatcgccgtgatccacgagaagcagcccgacgtgatcctggaggccagcggccccgaggccatccagatcagagacaccctgacccagctgaacgccaagtgggacagaatcaacagaatgtacagcgacagaaagggctgcttcgacagagccatggaggagtggagacagttccactgcgacctgaacgacctgacccagtggatcaccgaggccgaggagctgctggtggacacctgcgcccccggcggcagcctggacctggagaaggccagaatccaccagcaggagctggaggtgggcatcagcagccaccagcccagcttcgccgccctgaacagaaccggcgacggcatcgtgcagaagctgagccaggccgacggcagcttcctgaaggagaagctggccggcctgaaccagagatgggacgccatcgtggccgaggtgaaggacagacagcccagactgaagggcgagagcaagcaggtgatgaagtacagacaccagctggacgagatcatctgctggctgaccaaggccgagcacgccatgcagaagagaagcaccaccgagctgggcgagaacctgcaggagctgagagacctgacccaggagatggaggtgcacgccgagaagctgaagtggctgaacagaaccgagctggagatgctgagcgacaagagcctgagcctgcccgagagagacaagatcagcgagagcctgagaaccgtgaacatgacctggaacaagatctgcagagaggtgcccaccaccctgaaggagtgcatccaggagcccagcagcgtgagccagaccagaatcgccgcccaccccaacgtgcagaaggtggtgctggtgagcagcgccagcgacatccccgtgcagagccacagaaccagcgagatcagcatccccgccgacctggacaagaccatcaccgagctggccgactggctggtgctgatcgaccagatgctgaagagcaacatcgtgaccgtgggcgacgtggaggagatcaacaagaccgtgagcagaatgaagatcaccaaggccgacctggagcagagacacccccagctggactacgtgttcaccctggcccagaacctgaagaacaaggccagcagcagcgacatgagaaccgccatcaccgagaagctggagagagtgaagaaccagtgggacggcacccagcacggcgtggagctgagacagcagcagctggaggacatgatcatcgacagcctgcagtgggacgaccacagagaggagaccgaggagctgatgagaaagtacgaggccagactgtacatcctgcagcaggccagaagagaccccctgaccaagcagatcagcgacaaccagatcctgctgcaggagctgggccccggcgacggcatcgtgatggccttcgacaacgtgctgcagaagctgctggaggagtacggcagcgacgacaccagaaacgtgaaggagaccaccgagtacctgaagaccagctggatcaacctgaagcagagcatcgccgacagacagaacgccctggaggccgagtggagaaccgtgcaggccagcagaagagacctggagaacttcctgaagtggatccaggaggccgagaccaccgtgaacgtgctggtggacgccagccacagagagaacgccctgcaggacagcatcctggccagagagctgaagcagcagatgcaggacatccaggccgagatcgacgcccacaacgacatcttcaagagcatcgacggcaacagacagaagatggtgaaggccctgggcaacagcgaggaggccaccatgctgcagcacagactggacgacatgaaccagagatggaacgacctgaaggccaagagcgccagcatcagagcccacctggaggccagcgccgagaagtggaacagactgctgatgagcctggaggagctgatcaagtggctgaacatgaaggacgaggagctgaagaagcagatgcccatcggcggcgacgtgcccgccctgcagctgcagtacgaccactgcaaggccctgagaagagagctgaaggagaaggagtacagcgtgctgaacgccgtggaccaggccagagtgttcctggccgaccagcccatcgaggcccccgaggagcccagaagaaacctgcagagcaagaccgagctgacccccgaggagagagcccagaagatcgccaaggccatgagaaagcagagcagcgaggtgaaggagaagtgggagagcctgaacgccgtgaccagcaactggcagaagcaggtggacaaggccctggagaagctgagagacctgcagggcgccatggacgacctggacgccgacatgaaggaggccgagagcgtgagaaacggctggaagcccgtgggcgacctgctgatcgacagcctgcaggaccacatcgagaagatcatggccttcagagaggagatcgcccccatcaacttcaaggtgaagaccgtgaacgacctgagcagccagctgagccccctggacctgcaccccagcctgaagatgagcagacagctggacgacctgaacatgagatggaagctgctgcaggtgagcgtggacgacagactgaagcagctgcaggaggcccacagagacttcggccccagcagccagcacttcctgagcaccagcgtgcagctgccctggcagagaagcatcagccacaacaaggtgccctactacatcaaccaccagacccagaccacctgctgggaccaccccaagatgaccgagctgttccagagcctggccgacctgaacaacgtgagattcagcgcctacagaaccgccatcaagatcagaagactgcagaaggccctgtgcctggacctgctggagctgagcaccaccaacgagatcttcaagcagcacaagctgaaccagaacgaccagctgctgagcgtgcccgacgtgatcaactgcctgaccaccacctacgacggcctggagcagatgcacaaggacctggtgaacgtgcccctgtgcgtggacatgtgcctgaactggctgctgaacgtgtacgacaccggcagaaccggcaagatcagagtgcagagcctgaagatcggcctgatgagcctgagcaagggcctgctggaggagaagtacagatacctgttcaaggaggtggccggccccaccgagatgtgcgaccagagacagctgggcctgctgctgcacgacgccatccagatccccagacagctgggcgaggtggccgccttcggcggcagcaacatcgagcccagcgtgagaagctgcttccagcagaacaacaacaagcccgagatcagcgtgaaggagttcatcgactggatgcacctggagccccagagcatggtgtggctgcccgtgctgcacagagtggccgccgccgagaccgccaagcaccaggccaagtgcaacatctgcaaggagtgccccatcgtgggcttcagatacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccatcaccctgatcagcatgtggcccgagcactacgaccccagccagagcccccagctgttccacgacgacacccacagcagaatcgagcagtacgccaccagactggcccagatggagagaaccaacggcagcttcctgaccgacagcagcagcaccaccggcagcgtggaggacgagcacgccctgatccagcagtactgccagaccctgggcggcgagagccccgtgagccagccccagagccccgcccagatcctgaagagcgtggagagagaggagagaggcgagctggagagaatcatcgccgacctggaggaggagcagagaaacctgcaggtggagtacgagcagctgaaggaccagcacctgagaagaggcctgcccgtgggcagcccccccgagagcatcatcagcccccaccacaccagcgaggacagcgagctgatcgccgaggccaagctgctgagacagcacaagggcagactggaggccagaatgcagatcctggaggaccacaacaagcagctggagagccagctgcacagactgagacagctgctggagcagcccgagagcgacagcagaatcaacggcgtgagcccctgggccagcccccagcacagcgccctgagctacagcctggaccccgacgccagcggcccccagttccaccaggccgccggcgaggacctgctggcccccccccacgacaccagcaccgacctgaccgaggtgatggagcagatccacagcaccttccccagctgctgccccaacgtgcccagcagaccccaggccatgtag

SEQ ID NO: 104838 - DNA, 555 bp, Artificial Sequence
  Description of Artificial Sequence: Synthetic coding sequence
atgcacctggagccccagagcatggtgtggctgcccgtgctgcacagagtggccgccgccgagaccgccaagcaccaggccaagtgcaacatctgcaaggagtgccccatcgtgggcttcagatacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccagccagagcccccagctgttccacgacgacacccacagcagaatcgagcagtacgccaccagactggcccagatggagagaaccaacggcagcttcctgaccgacagcagcagcaccaccggcagcgtggaggacgagcacgccctgatccagcagtactgccagaccctgggcggctag

SEQ ID NO: 104839 - DNA, 462 bp, Artificial Sequence
  Description of Artificial Sequence: Synthetic coding sequence
atgagcggcctggccgccaccaccttccactggaagaagtgcagactggacctgcccggccacgtggccctgcaggcctgcaagagactgcccgacgagcacaacgacgtgcagaagaagaccttcaccaagtggatcaacgccagattcagcaagagcggcaagccccccatcaacgacatgttcaccgacctgaaggacggcagaaagctgctggacctgctggagggcctgaccggcaccagcctgcccaaggagagaggcagcaccagagtgcacgccctgaacaacgtgaacagagtgctgcaggtgctgcaccagaacaacgtggagctggtgaacatcggcggcaccgacatcgtggacggcaaccacaagctgaccctgggcctgctgtggagcatcatcctgcactggcaggtggacgtgatgaaggacgtgatgagcgacctgcagcagtag

SEQ ID NO: 104840 - DNA, 546 bp, Artificial Sequence
  Description of Artificial Sequence: Synthetic coding sequence
atgcacctggagccccagagcatggtgtggctgcccgtgctgcacagagtggccgccgccgagaccgccaagcaccaggccaagtgcaacatctgcaaggagtgccccatcgtgggcttcagatacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccatcaccctgatcagcatgtggcccgagcactacgaccccagccagagcccccagctgttccacgacgacacccacagcagaatcgagcagtacgccaccagactggcccagatggagagaaccaacggcagcttcctgaccgacagcagcagcaccaccggcagcgtgtag

SEQ ID NO: 104841 - DNA, 144 bp, Artificial Sequence
  Description of Artificial Sequence: Synthetic coding sequence
atggccaagtacggcgagcacgaggccagccccgacaacggccagaacgagttcagcgacatcatcaagagcagaagcgacgagcacaacgacgtgcagaagaagaccttcaccaagtggatcaacgccagattcagcaagtag

SEQ ID NO: 104842 - DNA, 561 bp, Artificial Sequence
  Description of Artificial Sequence: Synthetic coding sequence
atgctggaggaggaggagtggtacagaagcctgaagcacttcaactacgacgtgtgccagagctgcttcttcagcggcagaaccgccaagggccacaagctgcactaccccatggtggagtactgcatccccaccaccagcggcgaggacgtgagagacttcaccaaggtgctgaagaacaagttcagaagcaagaagtacttcgccaagcaccccagactgggctacctgcccgtgcagaccgtgctggagggcgacaacctggagacccccagccagagcccccagctgttccacgacgacacccacagcagaatcgagcagtacgccaccagactggcccagatggagagaaccaacggcagcttcctgaccgacagcagcagcaccaccggcagcgtggaggacgagcacgccctgatccagcagtactgccagaccctgggcggcgagagccccgtgagccagccccagagccccgcccagatcctgaagagcgtggagagagaggagagaggcgagctggagagaatcatcgccgacctggaggaggagcagtag

SEQ ID NO: 104843 - DNA, 201 bp, Artificial Sequence; identical to SEQ ID NO: 104834
  Description of Artificial Sequence: Synthetic coding sequence

SEQ ID NO: 104844 - DNA, 555 bp, Artificial Sequence; identical to SEQ ID NO: 104838
  Description of Artificial Sequence: Synthetic coding sequence

SEQ ID NO: 104845 - DNA, 2100 bp, Artificial Sequence
  Description of Artificial Sequence: Synthetic coding sequence
atgagcgccagcgccagcgtgggcggccccgtgccccagcccccccccggccccgccgccgccctgccccccggcagcgccgccagagccctgcacgtggagctgcccagccagcagagaagactgagacacctgagaaacatcgccgccagaaacatcgtgaacagaaacggccaccagctgctggacacctacttcaccctgcacctgtgcagcaccgagaagatctacaaggagttctacagaagcgaggtgatcaagaacagcctgaaccccacctggagaagcctggacttcggcatcatgcccgacagactggacaccagcgtgagctgcttcgtggtgaagatctggggcggcaaggagaacatctaccagctgctgatcgagtggaaggtgtgcctggacggcctgaagtacctgggccagcagatccacgccagaaaccagaacgagatcatcttcggcctgaacgacggctactacggcgcccccttcgagcacaagggctacagcaacgcccagaagaccatcctgctgcaggtggaccagaactgcgtgagaaacagctacgacgtgttcagcctgctgagactgcacagagcccagtgcgccatcaagcagacccaggtgaccgtgcagaagatcggcaaggagatcgaggagaagctgagactgaccagcaccagcaacgagctgaagaagaagagcgagtgcctgcagctgaagatcctggtgctgcagaacgagctggagagacagaagaaggccctgggcagagaggtggccctgctgcacaagcagcagatcgccctgcaggacaagggcagcgccttcagcgccgagcacctgaagctgcagctgcagaaggagagcctgaacgagctgagaaaggagtgcaccgccaagagagagctgttcctgaagaccaacgcccagctgaccatcagatgcagacagctgctgagcgagctgagctacatctaccccatcgacctgaacgagcacaaggactacttcgtgtgcggcgtgaagctgcccaacagcgaggacttccaggccaaggacgacggcagcatcgccgtggccctgggctacaccgcccacctggtgagcatgatcagcttcttcctgcaggtgcccctgagataccccatcatccacaagggcagcagaagcaccatcaaggacaacatcaacgacaagctgaccgagaaggagagagagttccccctgtaccccaagggcggcgagaagctgcagttcgactacggcgtgtacctgctgaacaagaacatcgcccagctgagataccagcacggcctgggcacccccgacctgagacagaccctgcccaacctgaagaacttcatggagcacggcctgatggtgagatgcgacagacaccacaccagcagcgccatccccgtgcccaagagacagagcagcatcttcggcggcgccgacgtgggcttcagcggcggcatccccagccccgacaagggccacagaaagagagccagcagcgagaacgagagactgcagtacaagacccccccccccagctacaacagcgccctggcccagcccgtgaccaccgtgcccagcatgggcgagaccgagagaaagatcaccagcctgagcagcagcctggacaccagcctggacttcagcaaggagaacaagaagaagggcgaggacctggtgggcagcctgaacggcggccacgccaacgtgcaccccagccaggagcagggcgaggccctgagcggccacagagccaccgtgaacggcaccctgctgcccagcgagcaggccggcagcgccagcgtgcagctgcccggcgagttccaccccgtgagcgaggccgagctgtgctgcaccgtggagcaggccgaggagatcatcggcctggaggccaccggcttcgccagcggcgaccagctggaggccttcaactgcatccccgtggacagcgccgtggccgtggagtgcgacgagcaggtgctgggcgagttcgaggagttcagcagaagaatctacgccctgaacgagaacgtgagcagcttcagaagacccagaagaagcagcgacaagtag

SEQ ID NO: 104846 - DNA, 768 bp, Artificial Sequence
  Description of Artificial Sequence: Synthetic coding sequence
atgttcatcagcgtggcccagagacagagagagaacgccttcagctgcagcaccttcctgagatgcgacagacaccacaccagcagcgccatccccgtgcccaagagacagagcagcatcttcggcggcgccgacgtgggcttcagcggcggcatccccagccccgacaagggccacagaaagagagccagcagcgagaacgagagactgcagtacaagacccccccccccagctacaacagcgccctggcccagcccgtgaccaccgtgcccagcatgggcgagaccgagagaaagatcaccagcctgagcagcagcctggacaccagcctggacttcagcaaggagaacaagaagaagggcgaggacctggtgggcagcctgaacggcggccacgccaacgtgcaccccagccaggagcagggcgaggccctgagcggccacagagccaccgtgaacggcaccctgctgcccagcgagcaggccggcagcgccagcgtgcagctgcccggcgagttccaccccgtgagcgaggccgagctgtgctgcaccgtggagcaggccgaggagatcatcggcctggaggccaccggcttcgccagcggcgaccagctggaggccttcaactgcatccccgtggacagcgccgtggccgtggagtgcgacgagcaggtgctgggcgagttcgaggagttcagcagaagaatctacgccctgaacgagaacgtgagcagcttcagaagacccagaagaagcagcgacaagtag

SEQ ID NO: 104847 - DNA, 984 bp, Artificial Sequence
  Description of Artificial Sequence: Synthetic coding sequence
atgatcagcttcttcctgcaggtgcccctgagataccccatcatccacaagggcagcagaagcaccatcaaggacaacatcaacgacaagctgaccgagaaggagagagagttccccctgtaccccaagggcggcgagaagctgcagttcgactacggcgtgtacctgctgaacaagaacatcgcccagctgagataccagcacggcctgggcacccccgacctgagacagaccctgcccaacctgaagaacttcatggagcacggcctgatggtgagatgcgacagacaccacaccagcagcgccatccccgtgcccaagagacagagcagcatcttcggcggcgccgacgtgggcttcagcggcggcatccccagccccgacaagggccacagaaagagagccagcagcgagaacgagagactgcagtacaagacccccccccccagctacaacagcgccctggcccagcccgtgaccaccgtgcccagcatgggcgagaccgagagaaagatcaccagcctgagcagcagcctggacaccagcctggacttcagcaaggagaacaagaagaagggcgaggacctggtgggcagcctgaacggcggccacgccaacgtgcaccccagccaggagcagggcgaggccctgagcggccacagagccaccgtgaacggcaccctgctgcccagcgagcaggccggcagcgccagcgtgcagctgcccggcgagttccaccccgtgagcgaggccgagctgtgctgcaccgtggagcaggccgaggagatcatcggcctggaggccaccggcttcgccagcggcgaccagctggaggccttcaactgcatccccgtggacagcgccgtggccgtggagtgcgacgagcaggtgctgggcgagttcgaggagttcagcagaagaatctacgccctgaacgagaacgtgagcagcttcagaagacccagaagaagcagcgacaagtag

SEQ ID NO: 104848 - DNA, 4251 bp, Artificial Sequence
  Description of Artificial Sequence: Synthetic coding sequence
atgaagagcctgaagagcagactgagaagacaggacgtgcccggccccgccagcagcggcgccgccgccgccagcgcccacgccgccgactggaacaagtacgacgacagactgatgaaggccgccgagagaggcgacgtggagaaggtgaccagcatcctggccaagaagggcgtgaaccccggcaagctggacgtggagggcagaagcgtgttccacgtggtgaccagcaagggcaacctggagtgcctgaacgccatcctgatccacggcgtggacatcaccaccagcgacaccgccggcagaaacgccctgcacctggccgccaagtacggccacgccctgtgcctgcagaagctgctgcagtacaactgccccaccgagcacgccgacctgcagggcagaaccgccctgcacgacgccgccatggccgactgccccagcagcatccagctgctgtgcgaccacggcgccagcgtgaacgccaaggacgtggacggcagaacccccctggtgctggccacccagatgagcagacccaccatctgccagctgctgatcgacagaggcgccgacgtgaacagcagagacaagcagaacagaaccgccctgatgctgggctgcgagtacggctgcagagacgccgtggaggtgctgatcaagaacggcgccgacatcagcctgctggacgccctgggccacgacagcagctactacgccagaatcggcgacaacctggacatcctgaccctgctgaagaccgccagcgagaacaccaacaagggcagagagctgtggaagaagggccccagcctgcagcagagaaacctgacccacatgcaggacgaggtgaacgtgaagagccaccagagagagcaccagaacatccaggacctggagatcgagaacgaggacctgaaggagagactgagaaagatccagcaggagcagagaatcctgctggacaaggtgaacggcctgcagctgcagctgaacgaggaggtgatggtggccgacgacctggagagcgagagagagaagctgaagagcctgctggccgccaaggagaagcagcacgaggagagcctgagaaccatcgaggccctgaagaacagattcaagtacttcgagagcgaccacctgggcagcggcagccacttcagcaacagaaaggaggacatgctgctgaagcagggccagatgtacatggccgacagccagtgcaccagccccggcatccccgcccacatgcagagcagaagcatgctgagacccctggagctgagcctgcccagccagaccagctacagcgagaacgagatcctgaagaaggagctggaggccatgagaaccttctgcgagagcgccaagcaggacagactgaagctgcagaacgagctggcccacaaggtggccgagtgcaaggccctggccctggagtgcgagagagtgaaggaggacagcgacgagcagatcaagcagctggaggacgccctgaaggacgtgcagaagagaatgtacgagagcgagggcaaggtgaagcagatgcagacccacttcctggccctgaaggagcacctgaccagcgaggccgccagcggcaaccacagactgaccgaggagctgaaggaccagctgaaggacctgaaggtgaagtacgagggcgccagcgccgaggtgggcaagctgagaaaccagatcaagcagaacgagatgatcgtggaggagttcaagagagacgagggcaagctgatcgaggagaacaagagactgcagaaggagctgagcatgtgcgagatggagagagagaagaagggcagaaaggtgaccgagatggagggccaggccaaggagctgagcgccaagctggccctgagcatccccgccgagaagttcgagaacatgaagagcagcctgagcaacgaggtgaacgagaaggccaagaagctggtggagatggagagagagcacgagaagagcctgagcgagatcagacagctgaagagagagctggagaacgtgaaggccaagctggcccagcacgtgaagcccgaggagcacgagcaggtgaagagcagactggagcagaagagcggcgagctgggcaagaagatcaccgagctgaccctgaagaaccagaccctgcagaaggagatcgagaaggtgtacctggacaacaagctgctgaaggagcaggcccacaacctgaccatcgagatgaagaaccactacgtgcccctgaaggtgagcgaggacatgaagaagagccacgacgccatcatcgacgacctgaacagaaagctgctggacgtgacccagaagtacaccgagaagaagctggagatggagaagctgctgctggagaacgacagcctgagcaaggacgtgagcagactggagaccgtgttcgtgccccccgagaagcacgagaaggagatcatcgccctgaagagcaacatcgtggagctgaagaagcagctgagcgagctgaagaagaagtgcggcgaggaccaggagaagatccacgccctgaccagcgagaacaccaacctgaagaagatgatgagcaaccagtacgtgcccgtgaagacccacgaggaggtgaagatgaccctgaacgacaccctggccaagaccaacagagagctgctggacgtgaagaagaagttcgaggacatcaaccaggagttcgtgaagatcaaggacaagaacgagatcctgaagagaaacctggagaacacccagaaccagatcaaggccgagtacatcagcctggccgagcacgaggccaagatgagcagcctgagccagagcatgagaaaggtgcaggacagcaacgccgagatcctggccaactacagaaagggccaggaggagatcgtgaccctgcacgccgagatcaaggcccagaagaaggagctggacaccatccaggagtgcatcaaggtgaagtacgcccccatcgtgagcttcgaggagtgcgagagaaagttcaaggccaccgagaaggagctgaaggaccagctgagcgagcagacccagaagtacagcgtgagcgaggaggaggtgaagaagaacaagcaggagaacgacaagctgaagaaggagatcttcaccctgcagaaggacctgagagacaagaccgtgctgatcgagaagagccacgagatggagagagccctgagcagaaagaccgacgagctgaacaagcagctgaaggacctgagccagaagtacaccgaggtgaagaacgtgaaggagaagctggtggaggagaacgccaagcagaccagcgagatcctggccgtgcagaacctgctgcagaagcagcacgtgcccctggagcaggtggaggccctgaagaagagcctgaacggcaccatcgagaacctgaaggaggagctgaagagcatgcagagatgctacgagaaggagcagcagaccgtgaccaagctgcaccagctgctggagaaccagaagaacagcagcgtgcccctggccgagcacctgcagatcaaggaggccttcgagaaggaggtgggcatcatcaaggccagcctgagagagaaggaggaggagagccagaacaagatggaggaggtgagcaagctgcagagcgaggtgcagaacaccaagcaggccctgaagaagctggagaccagagaggtggtggacctgagcaagtacaaggccaccaagagcgacctggagacccagatcagcagcctgaacgagaagctggccaacctgaacagaaagtacgaggaggtgtgcgaggaggtgctgcacgccaagaagaaggagatcagcgccaaggacgagaaggagctgctgcacttcagcatcgagcaggagatcaaggaccagaaggagagatgcgacaagagcctgaccaccatcaccgagctgcagagaagaatccaggagagcgccaagcagatcgaggccaaggacaacaagatcaccgagctgctgaacgacgtggagagactgaagcaggccctgaacggcctgagccagctgacctacaccagcggcaaccccaccaagagacagagccagctgatcgacaccctgcagcaccaggtgaagagcctggagcagcagctggccgacgccgacagacagcaccaggaggtgatcgccatctacagaacccacctgctgagcgccgcccagggccacatggacgaggacgtgcaggaggccctgctgcagatcatccagatgagacagggcctggtgtgctag

SEQ ID NO: 104849 - DNA, 4212 bp, Artificial Sequence
  Description of Artificial Sequence: Synthetic coding sequence
atgatgaactgctggttcagctgcacccccaagaacagacacgccgccgactggaacaagtacgacgacagactgatgaaggccgccgagagaggcgacgtggagaaggtgaccagcatcctggccaagaagggcgtgaaccccggcaagctggacgtggagggcagaagcgtgttccacgtggtgaccagcaagggcaacctggagtgcctgaacgccatcctgatccacggcgtggacatcaccaccagcgacaccgccggcagaaacgccctgcacctggccgccaagtacggccacgccctgtgcctgcagaagctgctgcagtacaactgccccaccgagcacgccgacctgcagggcagaaccgccctgcacgacgccgccatggccgactgccccagcagcatccagctgctgtgcgaccacggcgccagcgtgaacgccaaggacgtggacggcagaacccccctggtgctggccacccagatgagcagacccaccatctgccagctgctgatcgacagaggcgccgacgtgaacagcagagacaagcagaacagaaccgccctgatgctgggctgcgagtacggctgcagagacgccgtggaggtgctgatcaagaacggcgccgacatcagcctgctggacgccctgggccacgacagcagctactacgccagaatcggcgacaacctggacatcctgaccctgctgaagaccgccagcgagaacaccaacaagggcagagagctgtggaagaagggccccagcctgcagcagagaaacctgacccacatgcaggacgaggtgaacgtgaagagccaccagagagagcaccagaacatccaggacctggagatcgagaacgaggacctgaaggagagactgagaaagatccagcaggagcagagaatcctgctggacaaggtgaacggcctgcagctgcagctgaacgaggaggtgatggtggccgacgacctggagagcgagagagagaagctgaagagcctgctggccgccaaggagaagcagcacgaggagagcctgagaaccatcgaggccctgaagaacagattcaagtacttcgagagcgaccacctgggcagcggcagccacttcagcaacagaaaggaggacatgctgctgaagcagggccagatgtacatggccgacagccagtgcaccagccccggcatccccgcccacatgcagagcagaagcatgctgagacccctggagctgagcctgcccagccagaccagctacagcgagaacgagatcctgaagaaggagctggaggccatgagaaccttctgcgagagcgccaagcaggacagactgaagctgcagaacgagctggcccacaaggtggccgagtgcaaggccctggccctggagtgcgagagagtgaaggaggacagcgacgagcagatcaagcagctggaggacgccctgaaggacgtgcagaagagaatgtacgagagcgagggcaaggtgaagcagatgcagacccacttcctggccctgaaggagcacctgaccagcgaggccgccagcggcaaccacagactgaccgaggagctgaaggaccagctgaaggacctgaaggtgaagtacgagggcgccagcgccgaggtgggcaagctgagaaaccagatcaagcagaacgagatgatcgtggaggagttcaagagagacgagggcaagctgatcgaggagaacaagagactgcagaaggagctgagcatgtgcgagatggagagagagaagaagggcagaaaggtgaccgagatggagggccaggccaaggagctgagcgccaagctggccctgagcatccccgccgagaagttcgagaacatgaagagcagcctgagcaacgaggtgaacgagaaggccaagaagctggtggagatggagagagagcacgagaagagcctgagcgagatcagacagctgaagagagagctggagaacgtgaaggccaagctggcccagcacgtgaagcccgaggagcacgagcaggtgaagagcagactggagcagaagagcggcgagctgggcaagaagatcaccgagctgaccctgaagaaccagaccctgcagaaggagatcgagaaggtgtacctggacaacaagctgctgaaggagcaggcccacaacctgaccatcgagatgaagaaccactacgtgcccctgaaggtgagcgaggacatgaagaagagccacgacgccatcatcgacgacctgaacagaaagctgctggacgtgacccagaagtacaccgagaagaagctggagatggagaagctgctgctggagaacgacagcctgagcaaggacgtgagcagactggagaccgtgttcgtgccccccgagaagcacgagaaggagatcatcgccctgaagagcaacatcgtggagctgaagaagcagctgagcgagctgaagaagaagtgcggcgaggaccaggagaagatccacgccctgaccagcgagaacaccaacctgaagaagatgatgagcaaccagtacgtgcccgtgaagacccacgaggaggtgaagatgaccctgaacgacaccctggccaagaccaacagagagctgctggacgtgaagaagaagttcgaggacatcaaccaggagttcgtgaagatcaaggacaagaacgagatcctgaagagaaacctggagaacacccagaaccagatcaaggccgagtacatcagcctggccgagcacgaggccaagatgagcagcctgagccagagcatgagaaaggtgcaggacagcaacgccgagatcctggccaactacagaaagggccaggaggagatcgtgaccctgcacgccgagatcaaggcccagaagaaggagctggacaccatccaggagtgcatcaaggtgaagtacgcccccatcgtgagcttcgaggagtgcgagagaaagttcaaggccaccgagaaggagctgaaggaccagctgagcgagcagacccagaagtacagcgtgagcgaggaggaggtgaagaagaacaagcaggagaacgacaagctgaagaaggagatcttcaccctgcagaaggacctgagagacaagaccgtgctgatcgagaagagccacgagatggagagagccctgagcagaaagaccgacgagctgaacaagcagctgaaggacctgagccagaagtacaccgaggtgaagaacgtgaaggagaagctggtggaggagaacgccaagcagaccagcgagatcctggccgtgcagaacctgctgcagaagcagcacgtgcccctggagcaggtggaggccctgaagaagagcctgaacggcaccatcgagaacctgaaggaggagctgaagagcatgcagagatgctacgagaaggagcagcagaccgtgaccaagctgcaccagctgctggagaaccagaagaacagcagcgtgcccctggccgagcacctgcagatcaaggaggccttcgagaaggaggtgggcatcatcaaggccagcctgagagagaaggaggaggagagccagaacaagatggaggaggtgagcaagctgcagagcgaggtgcagaacaccaagcaggccctgaagaagctggagaccagagaggtggtggacctgagcaagtacaaggccaccaagagcgacctggagacccagatcagcagcctgaacgagaagctggccaacctgaacagaaagtacgaggaggtgtgcgaggaggtgctgcacgccaagaagaaggagatcagcgccaaggacgagaaggagctgctgcacttcagcatcgagcaggagatcaaggaccagaaggagagatgcgacaagagcctgaccaccatcaccgagctgcagagaagaatccaggagagcgccaagcagatcgaggccaaggacaacaagatcaccgagctgctgaacgacgtggagagactgaagcaggccctgaacggcctgagccagctgacctacaccagcggcaaccccaccaagagacagagccagctgatcgacaccctgcagcaccaggtgaagagcctggagcagcagctggccgacgccgacagacagcaccaggaggtgatcgccatctacagaacccacctgctgagcgccgcccagggccacatggacgaggacgtgcaggaggccctgctgcagatcatccagatgagacagggcctggtgtgctag

SEQ ID NO: 104850 - DNA, 1686 bp, Artificial Sequence
  Description of Artificial Sequence: Synthetic coding sequence
atgatgaactgctggttcagctgcacccccaagaacagacacgccgccgactggaacaagtacgacgacagactgatgaaggccgccgagagaggcgacgtggagaaggtgaccagcatcctggccaagaagggcgtgaaccccggcaagctggacgtggagggcagaagcgtgttccacgtggtgaccagcaagggcaacctggagtgcctgaacgccatcctgatccacggcgtggacatcaccaccagcgacaccgccggcagaaacgccctgcacctggccgccaagtacggccacgccctgtgcctgcagaagctgctgcagtacaactgccccaccgagcacgccgacctgcagggcagaaccgccctgcacgacgccgccatggccgactgccccagcagcatccagctgctgtgcgaccacggcgccagcgtgaacgccaaggacgtggacggcagaacccccctggtgctggccacccagatgagcagacccaccatctgccagctgctgatcgacagaggcgccgacgtgaacagcagagacaagcagaacagaaccgccctgatgctgggctgcgagtacggctgcagagacgccgtggaggtgctgatcaagaacggcgccgacatcagcctgctggacgccctgggccacgacagcagctactacgccagaatcggcgacaacctggacatcctgaccctgctgaagaccgccagcgagaacaccaacaagggcagagagctgtggaagaagggccccagcctgcagcagagaaacctgacccacatgcaggacgaggtgaacgtgaagagccaccagagagagcaccagaacatccaggacctggagatcgagaacgaggacctgaaggagagactgagaaagatccagcaggagcagagaatcctgctggacaaggtgaacggcctgcagctgcagctgaacgagagagagaagctgaagagcctgctggccgccaaggagaagcagcacgaggagagcctgagaaccatcgaggccctgaagaacagattcaagtacttcgagagcgaccacctgggcagcggcagccacttcagcaacagaaaggaggacatgctgctgaagcagggccagatgtacatggccgacagccagtgcaccagccccggcatccccgcccacatgcagagcagaagcatgctgagacccctggagctgagcctgcccagccagaccagctacagcgagaacgagatcctgaagaaggagctggaggccatgagaaccttctgcgagagcgccaagcaggacagactgaagctgcagaacgagctggcccacaaggtggccgagtgcaaggccctggccctggagtgcgagagagtgaaggaggacagcgacgagcagatcaagcagctggaggacgccctgaaggacgtgcagaagagaatgtacgagagcgagggcaaggtgaagcagatgcagacccacttcctggccctgaaggagcacctgaccagcgaggccgccagcggcaaccacagactgaccgaggagctgaaggaccagctgaaggacctgaaggtgaagtacgagggcgccagcgccgaggtgggcaagctgagaaaccagatcaagcagaacgagatgatcgtggaggagttcaagagagacgagggcaagctgatctag

SEQ ID NO: 104851 - DNA, 4206 bp, Artificial Sequence
  Description of Artificial Sequence: Synthetic coding sequence
atgatgaactgctggttcagctgcacccccaagaacagacacgccgccgactggaacaagtacgacgacagactgatgaaggccgccgagagaggcgacgtggagaaggtgaccagcatcctggccaagaagggcgtgaaccccggcaagctggacgtggagggcagaagcgtgttccacgtggtgaccagcaagggcaacctggagtgcctgaacgccatcctgatccacggcgtggacatcaccaccagcgacaccgccggcagaaacgccctgcacctggccgccaagtacggccacgccctgtgcctgcagaagctgctgcagtacaactgccccaccgagcacgccgacctgcagggcagaaccgccctgcacgacgccgccatggccgactgccccagcagcatccagctgctgtgcgaccacggcgccagcgtgaacgccaaggacgtggacggcagaacccccctggtgctggccacccagatgagcagacccaccatctgccagctgctgatcgacagaggcgccgacgtgaacagcagagacaagcagaacagaaccgccctgatgctgggctgcgagtacggctgcagagacgccgtggaggtgctgatcaagaacggcgccgacatcagcctgctggacgccctgggccacgacagcagctactacgccagaatcggcgacaacctggacatcctgaccctgctgaagaccgccagcgagaacaccaacaagggcagagagctgtggaagaagggccccagcctgcagcagagaaacctgacccacatgcaggacgaggtgaacgtgaagagccaccagagagagcaccagaacatccaggacctggagatcgagaacgaggacctgaaggagagactgagaaagatccagcaggagcagagaatcctgctggacaaggtgaacggcctgcagctgcagctgaacgaggaggtgatggtggccgacgacctggagagcgagagagagaagctgaagagcctgctggccgccaaggagaagcagcacgaggagagcctgagaaccatcgaggccctgaagaacagattcaagtacttcgagagcgaccacctgggcagcggcagccacttcagaaaggaggacatgctgctgaagcagggccagatgtacatggccgacagccagtgcaccagccccggcatccccgcccacatgcagagcagaagcatgctgagacccctggagctgagcctgcccagccagaccagctacagcgagaacgagatcctgaagaaggagctggaggccatgagaaccttctgcgagagcgccaagcaggacagactgaagctgcagaacgagctggcccacaaggtggccgagtgcaaggccctggccctggagtgcgagagagtgaaggaggacagcgacgagcagatcaagcagctggaggacgccctgaaggacgtgcagaagagaatgtacgagagcgagggcaaggtgaagcagatgcagacccacttcctggccctgaaggagcacctgaccagcgaggccgccagcggcaaccacagactgaccgaggagctgaaggaccagctgaaggacctgaaggtgaagtacgagggcgccagcgccgaggtgggcaagctgagaaaccagatcaagcagaacgagatgatcgtggaggagttcaagagagacgagggcaagctgatcgaggagaacaagagactgcagaaggagctgagcatgtgcgagatggagagagagaagaagggcagaaaggtgaccgagatggagggccaggccaaggagctgagcgccaagctggccctgagcatccccgccgagaagttcgagaacatgaagagcagcctgagcaacgaggtgaacgagaaggccaagaagctggtggagatggagagagagcacgagaagagcctgagcgagatcagacagctgaagagagagctggagaacgtgaaggccaagctggcccagcacgtgaagcccgaggagcacgagcaggtgaagagcagactggagcagaagagcggcgagctgggcaagaagatcaccgagctgaccctgaagaaccagaccctgcagaaggagatcgagaaggtgtacctggacaacaagctgctgaaggagcaggcccacaacctgaccatcgagatgaagaaccactacgtgcccctgaaggtgagcgaggacatgaagaagagccacgacgccatcatcgacgacctgaacagaaagctgctggacgtgacccagaagtacaccgagaagaagctggagatggagaagctgctgctggagaacgacagcctgagcaaggacgtgagcagactggagaccgtgttcgtgccccccgagaagcacgagaaggagatcatcgccctgaagagcaacatcgtggagctgaagaagcagctgagcgagctgaagaagaagtgcggcgaggaccaggagaagatccacgccctgaccagcgagaacaccaacctgaagaagatgatgagcaaccagtacgtgcccgtgaagacccacgaggaggtgaagatgaccctgaacgacaccctggccaagaccaacagagagctgctggacgtgaagaagaagttcgaggacatcaaccaggagttcgtgaagatcaaggacaagaacgagatcctgaagagaaacctggagaacacccagaaccagatcaaggccgagtacatcagcctggccgagcacgaggccaagatgagcagcctgagccagagcatgagaaaggtgcaggacagcaacgccgagatcctggccaactacagaaagggccaggaggagatcgtgaccctgcacgccgagatcaaggcccagaagaaggagctggacaccatccaggagtgcatcaaggtgaagtacgcccccatcgtgagcttcgaggagtgcgagagaaagttcaaggccaccgagaaggagctgaaggaccagctgagcgagcagacccagaagtacagcgtgagcgaggaggaggtgaagaagaacaagcaggagaacgacaagctgaagaaggagatcttcaccctgcagaaggacctgagagacaagaccgtgctgatcgagaagagccacgagatggagagagccctgagcagaaagaccgacgagctgaacaagcagctgaaggacctgagccagaagtacaccgaggtgaagaacgtgaaggagaagctggtggaggagaacgccaagcagaccagcgagatcctggccgtgcagaacctgctgcagaagcagcacgtgcccctggagcaggtggaggccctgaagaagagcctgaacggcaccatcgagaacctgaaggaggagctgaagagcatgcagagatgctacgagaaggagcagcagaccgtgaccaagctgcaccagctgctggagaaccagaagaacagcagcgtgcccctggccgagcacctgcagatcaaggaggccttcgagaaggaggtgggcatcatcaaggccagcctgagagagaaggaggaggagagccagaacaagatggaggaggtgagcaagctgcagagcgaggtgcagaacaccaagcaggccctgaagaagctggagaccagagaggtggtggacctgagcaagtacaaggccaccaagagcgacctggagacccagatcagcagcctgaacgagaagctggccaacctgaacagaaagtacgaggaggtgtgcgaggaggtgctgcacgccaagaagaaggagatcagcgccaaggacgagaaggagctgctgcacttcagcatcgagcaggagatcaaggaccagaaggagagatgcgacaagagcctgaccaccatcaccgagctgcagagaagaatccaggagagcgccaagcagatcgaggccaaggacaacaagatcaccgagctgctgaacgacgtggagagactgaagcaggccctgaacggcctgagccagctgacctacaccagcggcaaccccaccaagagacagagccagctgatcgacaccctgcagcaccaggtgaagagcctggagcagcagctggccgacgccgacagacagcaccaggaggtgatcgccatctacagaacccacctgctgagcgccgcccagggccacatggacgaggacgtgcaggaggccctgctgcagatcatccagatgagacagggcctggtgtgctag

SEQ ID NO: 104852 - DNA, 3195 bp, Artificial Sequence
  Description of Artificial Sequence: Synthetic coding sequence
atggtgctgggcaccgtgctgctgccccccaacagctacggcagagaccaggacaccagcctgtgctgcctgtgcaccgaggccagcgagagcgccctgcccgacctgaccgaccacttcgccagctgcgtggaggacggcttcgagggcgacaagaccggcggcagcagccccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104853 - DNA, 1629 bp, Artificial Sequence
  Description of Artificial Sequence: Synthetic coding sequence
atgggccagcaggtgggcagagtgggcgaggcccccggcctgcagcagccccagcccagaggcatcagaggcagcagcgccgccagacccagcggcagaagaagagaccccgccggcagaaccaccgagaccggcttcaacatcttcacccagcacgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggtgctgctgcactgcgccaaccagacctgcatcaccctgtag

SEQ ID NO: 104854 - DNA, 3441 bp, Artificial Sequence
  Description of Artificial Sequence: Synthetic coding sequence
atggtgctgggcaccgtgctgctgccccccaacagctacggcagagaccaggacaccagcctgtgctgcctgtgcaccgaggccagcgagagcgccctgcccgacctgaccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcaacttcagcagcgtggccagcctgcagcacgccgacggcttcagcttcacccccgcccagcaggaggccaacctggtgccccccaagtgctacggcggcagcttcgcccagagaaacctgtgcaacgacgacggcggcggcggcggcggcagcggcaccgccggcggcggctggagcggcatcaccggcttcttcacccccagactgatcaagaagaccctgggcctgagagccggcaagcccaccgccagcgacgacaccagcaagcccttccccagaagcaacagcaccagcagcatgagcagcggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104855 - DNA, 3549 bp, Artificial Sequence
  Description of Artificial Sequence: Synthetic coding sequence
atgggccagcaggtgggcagagtgggcgaggcccccggcctgcagcagccccagcccagaggcatcagaggcagcagcgccgccagacccagcggcagaagaagagaccccgccggcagaaccaccgagaccggcttcaacatcttcacccagcacgaccacttcgccagctgcgtggaggacggcttcgagggcgacaagaccggcggcagcagccccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcaacttcagcagcgtggccagcctgcagcacgccgacggcttcagcttcacccccgcccagcaggaggccaacctggtgccccccaagtgctacggcggcagcttcgcccagagaaacctgtgcaacgacgacggcggcggcggcggcggcagcggcaccgccggcggcggctggagcggcatcaccggcttcttcacccccagactgatcaagaagaccctgggcctgagagccggcaagcccaccgccagcgacgacaccagcaagcccttccccagaagcaacagcaccagcagcatgagcagcggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104856 - DNA, 3132 bp, Artificial Sequence
  Description of Artificial Sequence: Synthetic coding sequence
atggtgctgggcaccgtgctgctgccccccaacagctacggcagagaccaggacaccagcctgtgctgcctgtgcaccgaggccagcgagagcgccctgcccgacctgaccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104857 - DNA, 3504 bp, Artificial Sequence
  Description of Artificial Sequence: Synthetic coding sequence
atggtgctgggcaccgtgctgctgccccccaacagctacggcagagaccaggacaccagcctgtgctgcctgtgcaccgaggccagcgagagcgccctgcccgacctgaccgaccacttcgccagctgcgtggaggacggcttcgagggcgacaagaccggcggcagcagccccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcaacttcagcagcgtggccagcctgcagcacgccgacggcttcagcttcacccccgcccagcaggaggccaacctggtgccccccaagtgctacggcggcagcttcgcccagagaaacctgtgcaacgacgacggcggcggcggcggcggcagcggcaccgccggcggcggctggagcggcatcaccggcttcttcacccccagactgatcaagaagaccctgggcctgagagccggcaagcccaccgccagcgacgacaccagcaagcccttccccagaagcaacagcaccagcagcatgagcagcggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104858 - DNA, 3486 bp, Artificial Sequence
  Description of Artificial Sequence: Synthetic coding sequence
atgggccagcaggtgggcagagtgggcgaggcccccggcctgcagcagccccagcccagaggcatcagaggcagcagcgccgccagacccagcggcagaagaagagaccccgccggcagaaccaccgagaccggcttcaacatcttcacccagcacgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcaacttcagcagcgtggccagcctgcagcacgccgacggcttcagcttcacccccgcccagcaggaggccaacctggtgccccccaagtgctacggcggcagcttcgcccagagaaacctgtgcaacgacgacggcggcggcggcggcggcagcggcaccgccggcggcggctggagcggcatcaccggcttcttcacccccagactgatcaagaagaccctgggcctgagagccggcaagcccaccgccagcgacgacaccagcaagcccttccccagaagcaacagcaccagcagcatgagcagcggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104859 - DNA, 3177 bp, Artificial Sequence
  Description of Artificial Sequence: Synthetic coding sequence
atgggccagcaggtgggcagagtgggcgaggcccccggcctgcagcagccccagcccagaggcatcagaggcagcagcgccgccagacccagcggcagaagaagagaccccgccggcagaaccaccgagaccggcttcaacatcttcacccagcacgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104860 - DNA, 3240 bp, Artificial Sequence
  Description of Artificial Sequence: Synthetic coding sequence
atgggccagcaggtgggcagagtgggcgaggcccccggcctgcagcagccccagcccagaggcatcagaggcagcagcgccgccagacccagcggcagaagaagagaccccgccggcagaaccaccgagaccggcttcaacatcttcacccagcacgaccacttcgccagctgcgtggaggacggcttcgagggcgacaagaccggcggcagcagccccgaggccctgcacagaccctacggctgcgacgtggagccccaggccctgaacgaggccatcagatggagcagcaaggagaacctgctgggcgccaccgagagcgaccccaacctgttcgtggccctgtacgacttcgtggccagcggcgacaacaccctgagcatcaccaagggcgagaagctgagagtgctgggctacaaccagaacggcgagtggagcgaggtgagaagcaagaacggccagggctgggtgcccagcaactacatcacccccgtgaacagcctggagaagcacagctggtaccacggccccgtgagcagaagcgccgccgagtacctgctgagcagcctgatcaacggcagcttcctggtgagagagagcgagagcagccccggccagctgagcatcagcctgagatacgagggcagagtgtaccactacagaatcaacaccaccgccgacggcaaggtgtacgtgaccgccgagagcagattcagcaccctggccgagctggtgcaccaccacagcaccgtggccgacggcctggtgaccaccctgcactaccccgcccccaagtgcaacaagcccaccgtgtacggcgtgagccccatccacgacaagtgggagatggagagaaccgacatcaccatgaagcacaagctgggcggcggccagtacggcgaggtgtacgtgggcgtgtggaagaagtacagcctgaccgtggccgtgaagaccctgaaggaggacaccatggaggtggaggagttcctgaaggaggccgccgtgatgaaggagatcaagcaccccaacctggtgcagctgctgggcgtgtgcaccctggagccccccttctacatcgtgaccgagtacatgccctacggcaacctgctggactacctgagagagtgcaacagagaggaggtgaccgccgtggtgctgctgtacatggccacccagatcagcagcgccatggagtacctggagaagaagaacttcatccacagagacctggccgccagaaactgcctggtgggcgagaaccacgtggtgaaggtggccgacttcggcctgagcagactgatgaccggcgacacctacaccgcccacgccggcgccaagttccccatcaagtggaccgcccccgagagcctggcctacaacaccttcagcatcaagagcgacgtgtgggccttcggcgtgctgctgtgggagatcgccacctacggcatgagcccctaccccggcatcgacctgagccaggtgtacgacctgctggagaagggctacagaatggagcagcccgagggctgcccccccaaggtgtacgagctgatgagagcctgctggaagtggagccccgccgacagacccagcttcgccgagacccaccaggccttcgagaccatgttccacgacagcagcatcagcgaggaggtggccgaggagctgggcagagccgccagcagcagcagcgtggtgccctacctgcccagactgcccatcctgcccagcaagaccagaaccctgaagaagcaggtggagaacaaggagaacatcgagggcgcccaggacgccaccgagaacagcgccagcagcctggcccccggcttcatcagaggcgcccaggccagcagcggcagccccgccctgcccagaaagcagagagacaagagccccagcagcctgctggaggacgccaaggagacctgcttcaccagagacagaaagggcggcttcttcagcagcttcatgaagaagagaaacgcccccaccccccccaagagaagcagcagcttcagagagatggagaaccagccccacaagaagtacgagctgaccggcctgcccgagcaggacagaatggccatgaccctgcccagaaactgccagagaagcaagctgcagctggagagaaccgtgagcaccagcagccagcccgaggagaacgtggacagagccaacgacatgctgcccaagaagagcgaggagagcgccgcccccagcagagagagacccaaggccaagctgctgcccagaggcgccaccgccctgcccctgagaacccccagcggcgacctggccatcaccgagaaggacccccccggcgtgggcgtggccggcgtggccgccgcccccaagggcaaggagaagaacggcggcgccagactgggcatggccggcgtgcccgaggacggcgagcagcccggctggcccagccccgccaaggccgcccccgtgctgcccaccacccacaaccacaaggtgcccgtgctgatcagccccaccctgaagcacacccccgccgacgtgcagctgatcggcaccgacagccagggcaacaagttcaagctgctgagcgagcaccaggtgaccagcagcggcgacaaggacagacccagaagagtgaagcccaagtgcgcccccccccccccccccgtgatgagactgctgcagcaccccagcatctgcagcgaccccaccgaggagcccaccgccctgaccgccggccagagcaccagcgagacccaggagggcggcaagaaggccgccctgggcgccgtgcccatcagcggcaaggccggcagacccgtgatgccccccccccaggtgcccctgcccaccagcagcatcagccccgccaagatggccaacggcaccgccggcaccaaggtggccctgagaaagaccaagcaggccgccgagaagatcagcgccgacaagatcagcaaggaggccctgctggagtgcgccgacctgctgagcagcgccctgaccgagcccgtgcccaacagccagctggtggacaccggccaccagctgctggactactgcagcggctacgtggactgcatcccccagaccagaaacaagttcgccttcagagaggccgtgagcaagctggagctgagcctgcaggagctgcaggtgagcagcgccgccgccggcgtgcccggcaccaaccccgtgctgaacaacctgctgagctgcgtgcaggagatcagcgacgtggtgcagagatag

SEQ ID NO: 104861 - DNA, 2349 bp, Artificial Sequence
  Description of Artificial Sequence: Synthetic coding sequence
atgaaccccgagaaggacttcgcccccctgacccccaacatcgtgagagccctgaacgacaagctgtacgagaagagaaaggtggccgccctggagatcgagaagctggtgagagagttcgtggcccagaacaacaccgtgcagatcaagcacgtgatccagaccctgagccaggagttcgccctgagccagcacccccacagcagaaagggcggcctgatcggcctggccgcctgcagcatcgccctgggcaaggacagcggcctgtacctgaaggagctgatcgagcccgtgctgacctgcttcaacgacgccgacagcagactgagatactacgcctgcgaggccctgtacaacatcgtgaaggtggccagaggcgccgtgctgccccacttcaacgtgctgttcgacggcctgagcaagctggccgccgaccccgaccccaacgtgaagagcggcagcgagctgctggacagactgctgaaggacatcgtgaccgagagcaacaagttcgacctggtgagcttcatccccctgctgagagagagaatctacagcaacaaccagtacgccagacagttcatcatcagctggatcctggtgctggagagcgtgcccgacatcaacctgctggactacctgcccgagatcctggacggcctgttccagatcctgggcgacaacggcaaggagatcagaaagatgtgcgaggtggtgctgggcgagttcctgaaggagatcaagaagaaccccagcagcgtgaagttcgccgagatggccaacatcctggtgatccactgccagaccaccgacgacctgatccagctgaccgccatgtgctggatgagagagttcatccagctggccggcagagtgatgctgccctacagcagcggcatcctgaccgccgtgctgccctgcctggcctacgacgacagaaagaagagcatcaaggaggtggccaacgtgtgcaaccagagcctgatgaagctggtgacccccgaggacgacgagctggacgagctgagacccggccagagacaggccgagcccacccccgacgacgccctgcccaagcaggagggcaccgccagcggcggccccgacggcagctgcgacagcagcttcagcagcggcatcagcgtgttcaccgccgccagcaccgagagagcccccgtgaccctgcacctggacggcatcgtgcaggtgctgaactgccacctgagcgacaccgccatcggcatgatgaccagaatcgccgtgctgaagtggctgtaccacctgtacatcaagacccccagaaagatgttcagacacaccgacagcctgttccccatcctgctgcagaccctgagcgacgagagcgacgaggtgatcctgaaggacctggaggtgctggccgagatcgccagcagccccgccggccagaccgacgaccccggccccctggacggccccgacctgcaggccagccacagcgagctgcaggtgcccacccccggcagagccggcctgctgaacaccagcggcaccaagggcctggagtgcagccccagcacccccaccatgaacagctacttctacaagttcatgatcaacctgctgaagagattcagcagcgagagaaagctgctggaggtgagaggccccttcatcatcagacagctgtgcctgctgctgaacgccgagaacatcttccacagcatggccgacatcctgctgagagaggaggacctgaagttcgccagcaccatggtgcacgccctgaacaccatcctgctgaccagcaccgagctgttccagctgagaaaccagctgaaggacctgaagaccctggagagccagaacctgttctgctgcctgtacagaagctggtgccacaaccccgtgaccaccgtgagcctgtgcttcctgacccagaactacagacacgcctacgacctgatccagaagttcggcgacctggaggtgaccgtggacttcctggccgaggtggacaagctggtgcagctgatcgagtgccccatcttcacctacctgagactgcagctgctggacgtgaagaacaacccctacctgatcaaggccctgtacggcctgctgatgctgctgccccagagcagcgccttccagctgctgagccacagactgcagtgcgtgcccaaccccgagctgctgcagaccgaggacagcctgaaggccgcccccaagagccagaaggccgacagccccagcatcgactacgccgagctgctgcagcacttcgagaaggtgcagaacaagcacctggaggtgagacaccagagaagcggcagaggcgaccacctggacagaagagtggtgctgtag

SEQ ID NO: 104862 - DNA, 645 bp, Artificial Sequence
  Description of Artificial Sequence: Synthetic coding sequence
atggccgacatcctgctgagagaggaggacctgaagttcgccagcaccatggtgcacgccctgaacaccatcctgctgaccagcaccgagctgttccagctgagaaaccagctgaaggacctgaagaccctggagagccagaacctgttctgctgcctgtacagaagctggtgccacaaccccgtgaccaccgtgagcctgtgcttcctgacccagaactacagacacgcctacgacctgatccagaagttcggcgacctggaggtgaccgtggacttcctggccgaggtggacaagctggtgcagctgatcgagtgccccatcttcacctacctgagactgcagctgctggacgtgaagaacaacccctacctgatcaaggccctgtacggcctgctgatgctgctgccccagagcagcgccttccagctgctgagccacagactgcagtgcgtgcccaaccccgagctgctgcagaccgaggacagcctgaaggccgcccccaagagccagaaggccgacagccccagcatcgactacgccgagctgctgcagcacttcgagaaggtgcagaacaagcacctggaggtgagacaccagagaagcggcagaggcgaccacctggacagaagagtggtgctgtag

SEQ ID NO: 104863 - DNA, 1062 bp, Artificial Sequence
  Description of Artificial Sequence: Synthetic coding sequence
atggccagcagctggccccccctggagctgcagagcagcaaccagagccagctgttcccccagaacgccaccgcctgcgacaacgcccccgaggcctgggacctgctgcacagagtgctgcccaccttcatcatcagcatctgcttcttcggcctgctgggcaacctgttcgtgctgctggtgttcctgctgcccagaagacagctgaacgtggccgagatctacctggccaacctggccgccagcgacctggtgttcgtgctgggcctgcccttctgggccgagaacatctggaaccagttcaactggcccttcggcgccctgctgtgcagagtgatcaacggcgtgatcaaggccaacctgttcatcagcatcttcctggtggtggccatcagccaggacagatacagagtgctggtgcaccccatggccagcagaagacagcagagaagaagacaggccagagtgacctgcgtgctgatctgggtggtgggcggcctgctgagcatccccaccttcctgctgagaagcatccaggccgtgcccgacctgaacatcaccgcctgcatcctgctgctgccccacgaggcctggcacttcgccagaatcgtggagctgaacatcctgggcttcctgctgcccctggccgccatcgtgttcttcaactaccacatcctggccagcctgagaaccagagaggaggtgagcagaaccagatgcggcggcagaaaggacagcaagaccaccgccctgatcctgaccctggtggtggccttcctggtgtgctgggccccctaccacttcttcgccttcctggagttcctgttccaggtgcaggccgtgagaggctgcttctgggaggacttcatcgacctgggcctgcagctggccaacttcttcgccttcaccaacagcagcctgaaccccgtgatctacgtgttcgtgggcagactgttcagaaccaaggtgtgggagctgtacaagcagtgcacccccaagagcctggcccccatcagcagcagccacagaaaggagatcttccagctgttctggagaaactag

SEQ ID NO: 104864 - DNA, 1527 bp, Artificial Sequence
  Description of Artificial Sequence: Synthetic coding sequence
atgccccccaagagaaacgagaagtacaagctgcccatccccttccccgagggcaaggtgctggacgacatggagggcaaccagtgggtgctgggcaagaagatcggcagcggcggcttcggcctgatctacctggccttccccaccaacaagcccgagaaggacgccagacacgtggtgaaggtggagtaccaggagaacggccccctgttcagcgagctgaagttctaccagagagtggccaagaaggactgcatcaagaagtggatcgagagaaagcagctggactacctgggcatccccctgttctacggcagcggcctgaccgagttcaagggcagaagctacagattcatggtgatggagagactgggcatcgacctgcagaagatcagcggccagaacggcaccttcaagaagagcaccgtgctgcagctgggcatcagaatgctggacgtgctggagtacatccacgagaacgagtacgtgcacggcgacatcaaggccgccaacctgctgctgggctacaagaaccccgaccaggtgtacctggccgactacggcctgagctacagatactgccccaacggcaaccacaagcagtaccaggagaaccccagaaagggccacaacggcaccatcgagttcaccagcctggacgcccacaagggcgtggccctgagcagaagaagcgacgtggagatcctgggctactgcatgctgagatggctgtgcggcaagctgccctgggagcagaacctgaaggaccccgtggccgtgcagaccgccaagaccaacctgctggacgagctgccccagagcgtgctgaagtgggcccccagcggcagcagctgctgcgagatcgcccagttcctggtgtgcgcccacagcctggcctacgacgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactgatcgagaagaaggtgcacagcgagagaagcgccgagagctgcgccacctggaaggtgcagaaggaggagaagctgatcggcctgatgaacaacgaggccgcccaggagagcaccagaagaagacagaagtaccaggagagccaggagcccctgaacgaggtgaacagcttcccccagaagatcagctacacccagttccccaacagcttctacgagccccaccaggacttcaccagccccgacatcttcaagaagagcagaagccccagctggtacaagtacaccagcaccgtgagcaccggcatcaccgacctggagagcagcaccggcctgtggcccaccatcagccagttcaccctgagcgaggagaccaacgccgacgtgtactactacagaatcatcatccccgtgctgctgatgctggtgttcctggccctgttcttcctgtag

SEQ ID NO: 104865 - DNA, 1203 bp, Artificial Sequence
  Description of Artificial Sequence: Synthetic coding sequence
atgccccccaagagaaacgagaagtacaagctgcccatccccttccccgagggcaaggtgctggacgacatggagggcaaccagtgggtgctgggcaagaagatcggcagcggcggcttcggcctgatctacctggccttccccaccaacaagcccgagaaggacgccagacacgtggtgaaggtggagtaccaggagaacggccccctgttcagcgagctgaagttctaccagagagtggccaagaaggactgcatcaagaagtggatcgagagaaagcagctggactacctgggcatccccctgttctacggcagcggcctgaccgagttcaagggcagaagctacagattcatggtgatggagagactgggcatcgacctgcagaagatcagcggccagaacggcaccttcaagaagagcaccgtgctgcagctgggcatcagaatgctggacgtgctggagtacatccacgagaacgagtacgtgcacggcgacatcaaggccgccaacctgctgctgggctacaagaaccccgaccaggtgtacctggccgactacggcctgagctacagatactgccccaacggcaaccacaagcagtaccaggagaaccccagaaagggccacaacggcaccatcgagttcaccagcctggacgcccacaagggcgtggccctgagcagaagaagcgacgtggagatcctgggctactgcatgctgagatggctgtgcggcaagctgccctgggagcagaacctgaaggaccccgtggccgtgcagaccgccaagaccaacctgctggacgagctgccccagagcgtgctgaagtgggcccccagcggcagcagctgctgcgagatcgcccagttcctggtgtgcgcccacagcctggcctacgacgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactgatcgagaagaaggtgcacagcgagagaagcgccgagagctgcgccacctggaaggtgcagaaggaggagaagctgatcggcctgatgaacaacgaggccgcccagatcagacagctgggctactag

SEQ ID NO: 104866 - DNA, 1191 bp, Artificial Sequence
  Description of Artificial Sequence: Synthetic coding sequence
atgccccccaagagaaacgagaagtacaagctgcccatccccttccccgagggcaaggtgctggacgacatggagggcaaccagtgggtgctgggcaagaagatcggcagcggcggcttcggcctgatctacctggccttccccaccaacaagcccgagaaggacgccagacacgtggtgaaggtggagtaccaggagaacggccccctgttcagcgagctgaagttctaccagagagtggccaagaaggactgcatcaagaagtggatcgagagaaagcagctggactacctgggcatccccctgttctacggcagcggcctgaccgagttcaagggcagaagctacagattcatggtgatggagagactgggcatcgacctgcagaagatcagcggccagaacggcaccttcaagaagagcaccgtgctgcagctgggcatcagaatgctggacgtgctggagtacatccacgagaacgagtacgtgcacggcgacatcaaggccgccaacctgctgctgggctacaagaaccccgaccaggtgtacctggccgactacggcctgagctacagatactgccccaacggcaaccacaagcagtaccaggagaaccccagaaagggccacaacggcaccatcgagttcaccagcctggacgcccacaagggcgtggccctgagcagaagaagcgacgtggagatcctgggctactgcatgctgagatggctgtgcggcaagctgccctgggagcagaacctgaaggaccccgtggccgtgcagaccgccaagaccaacctgctggacgagctgccccagagcgtgctgaagtgggcccccagcggcagcagctgctgcgagatcgcccagttcctggtgtgcgcccacagcctggcctacgacgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactgatcgagaagaaggtgcacagcgagagaagcgccgagagctgcgccacctggaaggtgcagaaggaggagaagctgatcggcctgatgaacaacgaggccgcccagttcagatag

SEQ ID NO: 104867 - DNA, 876 bp, Artificial Sequence
  Description of Artificial Sequence: Synthetic coding sequence
atgccccccaagagaaacgagaagtacaagctgcccatccccttccccgagggcaaggtgctggacgacatggagggcaaccagtgggtgctgggcaagaagatcggcagcggcggcttcggcctgatctacctggccttccccaccaacaagcccgagaaggacgccagacacgtggtgaaggtggagtaccaggagaacggccccctgttcagcgagctgaagttctaccagagagtggccaagaaggactgcatcgtgttcgtggtgaagaagtggatcgagagaaagcagctggactacctgggcatccccctgttctacggcagcggcctgaccgagttcaagggcagaagctacagattcatggtgatggagagactgggcatcgacctgcagaagatcagcggccagaacggcaccttcaagaagagcaccgtgctgcagctgggcatcagaatgctggacgtgctggagtacatccacgagaacgagtacgtgcacggcgacatcaaggccgccaacctgctgctgggctacaagaaccccgaccaggtgtacctggccgactacggcctgagctacagatactgccccaacggcaaccacaagcagtaccaggagaaccccagaaagggccacaacggcaccatcgagttcaccagcctggacgcccacaagggcgtggccctgagcagaagaagcgacgtggagatcctgggctactgcatgctgagatggctgtgcggcaagctgccctgggagcagaacctgaaggaccccgtggccgtgcagaccgccaagaccaagtacaagttcagcagcatcagcagctgcaccgcccccggcctgaagggctacatcaagggcagctag

SEQ ID NO: 104868 - DNA, 1527 bp, Artificial Sequence; identical to SEQ ID NO: 104864
  Description of Artificial Sequence: Synthetic coding sequence

SEQ ID NO: 104869 - DNA, 1458 bp, Artificial Sequence
  Description of Artificial Sequence: Synthetic coding sequence
atggagggcaaccagtgggtgctgggcaagaagatcggcagcggcggcttcggcctgatctacctggccttccccaccaacaagcccgagaaggacgccagacacgtggtgaaggtggagtaccaggagaacggccccctgttcagcgagctgaagttctaccagagagtggccaagaaggactgcatcaagaagtggatcgagagaaagcagctggactacctgggcatccccctgttctacggcagcggcctgaccgagttcaagggcagaagctacagattcatggtgatggagagactgggcatcgacctgcagaagatcagcggccagaacggcaccttcaagaagagcaccgtgctgcagctgggcatcagaatgctggacgtgctggagtacatccacgagaacgagtacgtgcacggcgacatcaaggccgccaacctgctgctgggctacaagaaccccgaccaggtgtacctggccgactacggcctgagctacagatactgccccaacggcaaccacaagcagtaccaggagaaccccagaaagggccacaacggcaccatcgagttcaccagcctggacgcccacaagggcgtggccctgagcagaagaagcgacgtggagatcctgggctactgcatgctgagatggctgtgcggcaagctgccctgggagcagaacctgaaggaccccgtggccgtgcagaccgccaagaccaacctgctggacgagctgccccagagcgtgctgaagtgggcccccagcggcagcagctgctgcgagatcgcccagttcctggtgtgcgcccacagcctggcctacgacgagaagcccaactaccaggccctgaagaagatcctgaacccccacggcatccccctgggccccctggacttcagcaccaagggccagagcatcaacgtgcacacccccaacagccagaaggtggacagccagaaggccgccaccaagcaggtgaacaaggcccacaacagactgatcgagaagaaggtgcacagcgagagaagcgccgagagctgcgccacctggaaggtgcagaaggaggagaagctgatcggcctgatgaacaacgaggccgcccaggagagcaccagaagaagacagaagtaccaggagagccaggagcccctgaacgaggtgaacagcttcccccagaagatcagctacacccagttccccaacagcttctacgagccccaccaggacttcaccagccccgacatcttcaagaagagcagaagccccagctggtacaagtacaccagcaccgtgagcaccggcatcaccgacctggagagcagcaccggcctgtggcccaccatcagccagttcaccctgagcgaggagaccaacgccgacgtgtactactacagaatcatcatccccgtgctgctgatgctggtgttcctggccctgttcttcctgtag

SEQ ID NO: 104870 - DNA, 531 bp, Artificial Sequence
  Description of Artificial Sequence: Synthetic coding sequence
atggccatgagcttcgagtggccctggcagtacagattcccccccttcttcaccctgcagcccaacgtggacaccagacagaagcagctggccgcctggtgcagcctggtgctgagcttctgcagactgcacaagcagagcagcatgaccgtgatggaggcccaggagagccccctgttcaacaacgtgaagctgcagagaaagctgcccgtggagagcatccagatcgtgctggaggagctgagaaagaagggcaacctggagtggctggacaagagcaagagcagcttcctgatcatgtggagaagacccgaggagtggggcaagctgatctaccagtgggtgagcagaagcggccagaacaacagcgtgttcaccctgtacgagctgaccaacggcgaggacaccgaggacgaggagttccacggcctggacgaggccaccctgctgagagccctgcaggccctgcagcaggagcacaaggccgagatcatcaccgtgagcgacggcagaggcgtgaagttcttctag

SEQ ID NO: 104871 - DNA, 984 bp, Artificial Sequence
  Description of Artificial Sequence: Synthetic coding sequence
atgagcttcctgggcggcttcttcggccccatctgcgagatcgacatcgtgctgaacgacggcgagaccagaaagatggccgagatgaagaccgaggacggcaaggtggagaagcactacctgttctacgacggcgagagcgtgagcggcaaggtgaacctggccttcaagcagcccggcaagagactggagcaccagggcatcagaatcgagttcgtgggccagatcgagctgttcaacgacaagagcaacacccacgagttcgtgaacctggtgaaggagctggccctgcccggcgagctgacccagagcagaagctacgacttcgagttcatgcaggtggagaagccctacgagagctacatcggcgccaacgtgagactgagatacttcctgaaggtgaccatcgtgagaagactgaccgacctggtgaaggagtacgacctgatcgtgcaccagctggccacctaccccgacgtgaacaacagcatcaagatggaggtgggcatcgaggactgcctgcacatcgagttcgagtacaacaagagcaagtaccacctgaaggacgtgatcgtgggcaagatctacttcctgctggtgagaatcaagatccagcacatggagctgcagctgatcaagaaggagatcaccggcatcggccccagcaccaccaccgagaccgagaccatcgccaagtacgagatcatggacggcgcccccgtgaagggcgagagcatccccatcagactgttcctggccggctacgaccccacccccaccatgagagacgtgaacaagaagttcagcgtgagatacttcctgaacctggtgctggtggacgaggaggacagaagatacttcaagcagcaggagatcatcctgtggagaaaggcccccgagaagctgagaaagcagagaaccaacttccaccagagattcgagagccccgagagccaggccagcgccgagcagcccgagatgtag

SEQ ID NO: 104872 - DNA, 984 bp, Artificial Sequence; identical to SEQ ID NO: 104871
  Description of Artificial Sequence: Synthetic coding sequence

SEQ ID NO: 104873 - DNA, 756 bp, Artificial Sequence
  Description of Artificial Sequence: Synthetic coding sequence
atgagcttcctgggcggcttcttcggccccatctgcgagatcgacatcgtgctgaacgacggcgagaccagaaagatggccgagatgaagaccgaggacggcaaggtggagaagcactacctgttctacgacggcgagagcgtgagcggcaaggtgaacctggccttcaagcagcccggcaagagactggagcaccagggcatcagaatcgagttcgtgggccagatcgagctgttcaacgacaagagcaacacccacgagttcgtgaacctggtgaaggagctggccctgcccggcgagctgacccagagcagaagctacgacttcgagttcatgcaggtggagaagccctacgagagctacatcggcgccaacgtgagactgagatacttcctgaaggtgaccatcgtgagaagactgaccgacctggtgaaggagtacgacctgatcgtgcaccagctggccacctaccccgacgtgaacaacagcatcaagatggaggtgggcatcgaggactgcctgcacatcgagttcgagtacaacaagagcaagtaccacctgaaggacgtgatcgtgggcaagatctacttcctgctggtgagaatcaagatccagcacatggagctgcagctgatcaagaaggagatcaccggcatcggccccagcaccaccaccgagaccgagaccatcgccaagtacgagatcatggacggcgcccccgtgaagggcgacaacttcatggagaagagcagctag

SEQ ID NO: 104874 - DNA, 651 bp, Artificial Sequence
  Description of Artificial Sequence: Synthetic coding sequence
atgcaggtggagaagccctacgagagctacatcggcgccaacgtgagactgagatacttcctgaaggtgaccatcgtgagaagactgaccgacctggtgaaggagtacgacctgatcgtgcaccagctggccacctaccccgacgtgaacaacagcatcaagatggaggtgggcatcgaggactgcctgcacatcgagttcgagtacaacaagagcaagtaccacctgaaggacgtgatcgtgggcaagatctacttcctgctggtgagaatcaagatccagcacatggagctgcagctgatcaagaaggagatcaccggcatcggccccagcaccaccaccgagaccgagaccatcgccaagtacgagatcatggacggcgcccccgtgaagggcgagagcatccccatcagactgttcctggccggctacgaccccacccccaccatgagagacgtgaacaagaagttcagcgtgagatacttcctgaacctggtgctggtggacgaggaggacagaagatacttcaagcagcaggagatcatcctgtggagaaaggcccccgagaagctgagaaagcagagaaccaacttccaccagagattcgagagccccgagagccaggccagcgccgagcagcccgagatgtag

SEQ ID NO: 104875 - DNA, 933 bp, Artificial Sequence
  Description of Artificial Sequence: Synthetic coding sequence
atgaccgagaaccccttccaggagagatacagcgtggaggacctgagcaccttcggcatgtgcctgtgcatggtgagatacgtgtacgacgccttctacaaggtgaacctggccttcaagcagcccggcaagagactggagcaccagggcatcagaatcgagttcgtgggccagatcgagctgttcaacgacaagagcaacacccacgagttcgtgaacctggtgaaggagctggccctgcccggcgagctgacccagagcagaagctacgacttcgagttcatgcaggtggagaagccctacgagagctacatcggcgccaacgtgagactgagatacttcctgaaggtgaccatcgtgagaagactgaccgacctggtgaaggagtacgacctgatcgtgcaccagctggccacctaccccgacgtgaacaacagcatcaagatggaggtgggcatcgaggactgcctgcacatcgagttcgagtacaacaagagcaagtaccacctgaaggacgtgatcgtgggcaagatctacttcctgctggtgagaatcaagatccagcacatggagctgcagctgatcaagaaggagatcaccggcatcggccccagcaccaccaccgagaccgagaccatcgccaagtacgagatcatggacggcgcccccgtgaagggcgagagcatccccatcagactgttcctggccggctacgaccccacccccaccatgagagacgtgaacaagaagttcagcgtgagatacttcctgaacctggtgctggtggacgaggaggacagaagatacttcaagcagcaggagatcatcctgtggagaaaggcccccgagaagctgagaaagcagagaaccaacttccaccagagattcgagagccccgagagccaggccagcgccgagcagcccgagatgtag

SEQ ID NO: 104876 - DNA, 1011 bp, Artificial Sequence
  Description of Artificial Sequence: Synthetic coding sequence
atgagcttcttcggcttcggccagagcgtggaggtggagatcctgctgaacgacgccgagagcagaaagagagccgagcacaagaccgaggacggcaagaaggagaagtacttcctgttctacgacggcgagaccgtgagcggcaaggtgagcctggccctgaagaaccccaacaagagactggagcaccagggcatcaagatcgagttcatcggccagatcgagctgtactacgacagaggcaaccaccacgagttcgtgagcctggtgaaggacctggccagacccggcgagatcacccagagccaggccttcgacttcgagttcacccacgtggagaagccctacgagagctacaccggccagaacgtgaagctgagatacttcctgagagccaccatcagcagaagactgaacgacgtggtgaaggagatggacatcgtggtgcacaccctgagcacctaccccgagctgaacagcagcatcaagatggaggtgggcatcgaggactgcctgcacatcgagttcgagtacaacaagagcaagtaccacctgaaggacgtgatcgtgggcaagatctacttcctgctggtgagaatcaagatcaagcacatggagatcgacatcatcaagagagagaccaccggcaccggccccaacgtgtaccacgagaacgacaccatcgccaagtacgagatcatggacggcgcccccgtgagaggcgagagcatccccatcagactgttcctggccggctacgagctgacccccaccatgagagacatcaacaagaagttcagcgtgagatactacctgaacctggtgctgatcgacgaggaggagagaagatacttcaagcagcaggaggtggtgctgtggagaaagggcgacatcgtgagaaagagcatgagccaccaggccgccatcgccagccagagattcgagggcaccaccagcctgggcgaggtgagaacccccagccagctgagcgacaacaactgcagacagtag

SEQ ID NO: 104877 - DNA, 666 bp, Artificial Sequence
  Description of Artificial Sequence: Synthetic coding sequence
atgttccacggcatccccgccacccccggcatcggcgcccccggcaacaagcccgagctgtacgaggaggtgaagctgtacaagaacgccagagagagagagaagtacgacaacatggccgagctgttcgccgtggtgaagaccatgcaggccctggagaaggcctacatcaaggactgcgtgagccccagcgagtacaccgccgcctgcagcagactgctggtgcagtacaaggccgccttcagacaggtgcagggcagcgagatcagcagcatcgacgagttctgcagaaagttcagactggactgccccctggccatggagagaatcaaggaggacagacccatcaccatcaaggacgacaagggcaacctgaacagatgcatcgccgacgtggtgagcctgttcatcaccgtgatggacaagctgagactggagatcagagccatggacgagatccagcccgacctgagagagctgatggagaccatgcacagaatgagccacctgccccccgacttcgagggcagacagaccgtgagccagtggctgcagaccctgagcggcatgagcgccagcgacgagctggacgacagccaggtgagacagatgctgttcgacctggagagcgcctacaacgccttcaacagattcctgcacgcctag

SEQ ID NO: 104878 - DNA, 702 bp, Artificial Sequence
  Description of Artificial Sequence: Synthetic coding sequence
atgttccacggcatccccgccacccccggcatcggcgcccccggcaacaagcccgagctgtacgaggaggtgaagctgtacaagaacgccagagagagagagaagtacgacaacatggccgagctgttcgccgtggtgaagaccatgcaggccctggagaaggcctacatcaaggactgcgtgagccccagcgagtacaccgccgcctgcagcagactgctggtgcagtacaaggccgccttcagacaggtgcagggcagcgagatcagcagcatcgacgagttctgcagaaagttcagactggactgccccctggccatggagagaatcaaggaggacagacccatcaccatcaaggacgacaagggcaacctgaacagatgcatcgccgacgtggtgagcctgttcatcaccgtgatggacaagctgagactggagatcagagccatggacgagatccagcccgacctgagagagctgatggagaccatgcacagaatgagccacctgccccccgacttcgagggcagacagaccgtgagccagtggtgggtgagcctgcccgccagacagagccccgccgtgcccgagaccctgcccgccagaagaagccccgccgtgcccctgagacccagcgcccccacctgccccgtgctgcacagccaggccgccgaccccgagagacacgtgggcgtgagatag

SEQ ID NO: 104879 - DNA, 666 bp, Artificial Sequence; identical to SEQ ID NO: 104877
  Description of Artificial Sequence: Synthetic coding sequence

SEQ ID NO: 104880 - DNA, 1791 bp, Artificial Sequence
  Description of Artificial Sequence: Synthetic coding sequence
atggccgcccacctgagctacggcagagtgaacctgaacgtgctgagagaggccgtgagaagagagctgagagagttcctggacaagtgcgccggcagcaaggccatcgtgtgggacgagtacctgaccggccccttcggcctgatcgcccagtacagcctgctgaaggagcacgaggtggagaagatgttcaccctgaagggcaacagactgcccgccgccgacgtgaagaacatcatcttcttcgtgagacccagactggagctgatggacatcatcgccgagaacgtgctgagcgaggacagaagaggccccaccagagacttccacatcctgttcgtgcccagaagaagcctgctgtgcgagcagagactgaaggacctgggcgtgctgggcagcttcatccacagagaggagtacagcctggacctgatccccttcgacggcgacctgctgagcatggagagcgagggcgccttcaaggagtgctacctggagggcgaccagaccagcctgtaccacgccgccaagggcctgatgaccctgcaggccctgtacggcaccatcccccagatcttcggcaagggcgagtgcgccagacaggtggccaacatgatgatcagaatgaagagagagttcaccggcagccagaacagcatcttccccgtgttcgacaacctgctgctgctggacagaaacgtggacctgctgacccccctggccacccagctgacctacgagggcctgatcgacgagatctacggcatccagaacagctacgtgaagctgccccccgagaagttcgcccccaagaagcagggcgacggcggcaaggacctgcccaccgaggccaagaagctgcagctgaacagcgccgaggagctgtacgccgagatcagagacaagaacttcaacgccgtgggcagcgtgctgagcaagaaggccaagatcatcagcgccgccttcgaggagagacacaacgccaagaccgtgggcgagatcaagcagttcgtgagccagctgccccacatgcaggccgccagaggcagcctggccaaccacaccagcatcgccgagctgatcaaggacgtgaccaccagcgaggacttcttcgacaagctgaccgtggagcaggagttcatgagcggcatcgacaccgacaaggtgaacaactacatcgaggactgcatcgcccagaagcacagcctgatcaaggtgctgagactggtgtgcctgcagagcgtgtgcaacagcggcctgaagcagaaggtgctggactactacaagagagagatcctgcagacctacggctacgagcacatcctgaccctgcacaacctggagaaggccggcctgctgaagccccagaccggcggcagaaacaactaccccaccatcagaaagaccctgagactgtggatggacgacgtgaacgagcagaaccccaccgacatcagctacgtgtacagcggctacgcccccctgagcgtgagactggcccagctgctgagcagacccggctggagaagcatcgaggaggtgctgagaatcctgcccggcccccacttcgaggagagacagcccctgcccaccggcctgcagaagaagagacagcccggcgagaacagagtgaccctgatcttcttcctgggcggcgtgaccttcgccgagatcgccgccctgagattcctgagccagctggaggacggcggcaccgagtacgtgatcgccaccaccaagctgatgaacggcaccagctggatcgaggccctgatggagaagcccttctag

SEQ ID NO: 104881 - DNA, 1854 bp, Artificial Sequence
  Description of Artificial Sequence: Synthetic coding sequence
atggccttcccccacagacccgacgcccccgagctgcccgacttcagcatgctgaagagactggccagagaccagctgatctacctgctggagcagctgcccggcaagaaggacctgttcatcgaggccgacctgatgagccccctggacagaatcgccaacgtgagcatcctgaagcagcacgaggtggacaagctgtacaaggtggagaacaagcccgccctgagcagcaacgagcagctgtgcttcctggtgagacccagaatcaagaacatgagatacatcgccagcctggtgaacgccgacaagctggccggcagaaccagaaagtacaaggtgatcttcagcccccagaagttctacgcctgcgagatggtgctggaggaggagggcatctacggcgacgtgagctgcgacgagtgggccttcagcctgctgcccctggacgtggacctgctgagcatggagctgcccgagttcttcagagactacttcctggagggcgaccagagatggatcaacaccgtggcccaggccctgcacctgctgagcaccctgtacggccccttccccaactgctacggcatcggcagatgcgccaagatggcctacgagctgtggagaaacctggaggaggaggaggacggcgagaccaagggcagaagacccgagatcggccacatcttcctgctggacagagacgtggacttcgtgaccgccctgtgcagccaggtggtgtacgagggcctggtggacgacaccttcagaatcaagtgcggcagcgtggacttcggccccgaggtgaccagcagcgacaagagcctgaaggtgctgctgaacgccgaggacaaggtgttcaacgagatcagaaacgagcacttcagcaacgtgttcggcttcctgagccagaaggccagaaacctgcaggcccagtacgacagaagaagaggcatggacatcaagcagatgaagaacttcgtgagccaggagctgaagggcctgaagcaggagcacagactgctgagcctgcacatcggcgcctgcgagagcatcatgaagaagaagaccaagcaggacttccaggagctgatcaagaccgagcacgccctgctggagggcttcaacatcagagagagcaccagctacatcgaggagcacatcgacagacaggtgagccccatcgagagcctgagactgatgtgcctgctgagcatcaccgagaacggcctgatccccaaggactacagaagcctgaagacccagtacctgcagagctacggccccgagcacctgctgaccttcagcaacctgagaagagccggcctgctgaccgagcaggcccccggcgacaccctgaccgccgtggagagcaaggtgagcaagctggtgaccgacaaggccgccggcaagatcaccgacgccttcagcagcctggccaagagaagcaacttcagagccatcagcaagaagctgaacctgatccccagagtggacggcgagtacgacctgaaggtgcccagagacatggcctacgtgttcggcggcgcctacgtgcccctgagctgcagaatcatcgagcaggtgctggagagaagaagctggcagggcctggacgaggtggtgagactgctgaactgcagcgacttcgccttcaccgacatgaccaaggaggacaaggccagcagcgagagcctgagactgatcctggtggtgttcctgggcggctgcaccttcagcgagatcagcgccctgagattcctgggcagagagaagggctacagattcatcttcctgaccaccgccgtgaccaacagcgccagactgatggaggccatgagcgaggtgaaggcctag

SEQ ID NO: 104882 - DNA, 1719 bp, Artificial Sequence
  Description of Artificial Sequence: Synthetic coding sequence
atgagccccctggacagaatcgccaacgtgagcatcctgaagcagcacgaggtggacaagctgtacaaggtggagaacaagcccgccctgagcagcaacgagcagctgtgcttcctggtgagacccagaatcaagaacatgagatacatcgccagcctggtgaacgccgacaagctggccggcagaaccagaaagtacaaggtgatcttcagcccccagaagttctacgcctgcgagatggtgctggaggaggagggcatctacggcgacgtgagctgcgacgagtgggccttcagcctgctgcccctggacgtggacctgctgagcatggagctgcccgagttcttcagagactacttcctggagggcgaccagagatggatcaacaccgtggcccaggccctgcacctgctgagcaccctgtacggccccttccccaactgctacggcatcggcagatgcgccaagatggcctacgagctgtggagaaacctggaggaggaggaggacggcgagaccaagggcagaagacccgagatcggccacatcttcctgctggacagagacgtggacttcgtgaccgccctgtgcagccaggtggtgtacgagggcctggtggacgacaccttcagaatcaagtgcggcagcgtggacttcggccccgaggtgaccagcagcgacaagagcctgaaggtgctgctgaacgccgaggacaaggtgttcaacgagatcagaaacgagcacttcagcaacgtgttcggcttcctgagccagaaggccagaaacctgcaggcccagtacgacagaagaagaggcatggacatcaagcagatgaagaacttcgtgagccaggagctgaagggcctgaagcaggagcacagactgctgagcctgcacatcggcgcctgcgagagcatcatgaagaagaagaccaagcaggacttccaggagctgatcaagaccgagcacgccctgctggagggcttcaacatcagagagagcaccagctacatcgaggagcacatcgacagacaggtgagccccatcgagagcctgagactgatgtgcctgctgagcatcaccgagaacggcctgatccccaaggactacagaagcctgaagacccagtacctgcagagctacggccccgagcacctgctgaccttcagcaacctgagaagagccggcctgctgaccgagcaggcccccggcgacaccctgaccgccgtggagagcaaggtgagcaagctggtgaccgacaaggccgccggcaagatcaccgacgccttcagcagcctggccaagagaagcaacttcagagccatcagcaagaagctgaacctgatccccagagtggacggcgagtacgacctgaaggtgcccagagacatggcctacgtgttcggcggcgcctacgtgcccctgagctgcagaatcatcgagcaggtgctggagagaagaagctggcagggcctggacgaggtggtgagactgctgaactgcagcgacttcgccttcaccgacatgaccaaggaggacaaggccagcagcgagagcctgagactgatcctggtggtgttcctgggcggctgcaccttcagcgagatcagcgccctgagattcctgggcagagagaagggctacagattcatcttcctgaccaccgccgtgaccaacagcgccagactgatggaggccatgagcgaggtgaaggcctag

SEQ ID NO: 104883 - DNA, 2391 bp, Artificial Sequence
  Description of Artificial Sequence: Synthetic coding sequence
atgcccaccacccagcagagcccccaggacgagcaggagaagctgctggacgaggccatccaggccgtgaaggtgcagagcttccagatgaagagatgcctggacaagaacaagctgatggacgccctgaagcacgccagcaacatgctgggcgagctgagaaccagcatgctgagccccaagagctactacgagctgtacatggccatcagcgacgagctgcactacctggaggtgtacctgaccgacgagttcgccaagggcagaaaggtggccgacctgtacgagctggtgcagtacgccggcaacatcatccccagactgtacctgctgatcaccgtgggcgtggtgtacgtgaagagcttcccccagagcagaaaggacatcctgaaggacctggtggagatgtgcagaggcgtgcagcaccccctgagaggcctgttcctgagaaactacctgctgcagtgcaccagaaacatcctgcccgacgagggcgagcccaccgacgaggagaccaccggcgacatcagcgacagcatggacttcgtgctgctgaacttcgccgagatgaacaagctgtgggtgagaatgcagcaccagggccacagcagagacagagagaagagagagagagagagacaggagctgagaatcctggtgggcaccaacctggtgagactgagccagctggagggcgtgaacgtggagagatacaagcagatcgtgctgaccggcatcctggagcaggtggtgaactgcagagacgccctggcccaggagtacctgatggagtgcatcatccaggtgttccccgacgagttccacctgcagaccctgaaccccttcctgagagcctgcgccgagctgcaccagaacgtgaacgtgaagaacatcatcatcgccctgatcgacagactggccctgttcgcccacagagaggacggccccggcatccccgccgacatcaagctgttcgacatcttcagccagcaggtggccaccgtgatccagagcagacaggacatgcccagcgaggacgtggtgagcctgcaggtgagcctgatcaacctggccatgaagtgctaccccgacagagtggactacgtggacaaggtgctggagaccaccgtggagatcttcaacaagctgaacctggagcacatcgccaccagcagcgccgtgagcaaggagctgaccagactgctgaagatccccgtggacacctacaacaacatcctgaccgtgctgaagctgaagcacttccaccccctgttcgagtacttcgactacgagagcagaaagagcatgagctgctacgtgctgagcaacgtgctggactacaacaccgagatcgtgagccaggaccaggtggacagcatcatgaacctggtgagcaccctgatccaggaccagcccgaccagcccgtggaggaccccgaccccgaggacttcgccgacgagcagagcctggtgggcagattcatccacctgctgagaagcgaggaccccgaccagcagtacctgatcctgaacaccgccagaaagcacttcggcgccggcggcaaccagagaatcagattcaccctgccccccctggtgttcgccgcctaccagctggccttcagatacaaggagaacagcaaggtggacgacaagtgggagaagaagtgccagaagatcttcagcttcgcccaccagaccatcagcgccctgatcaaggccgagctggccgagctgcccctgagactgttcctgcagggcgccctggccgccggcgagatcggcttcgagaaccacgagaccgtggcctacgagttcatgagccaggccttcagcctgtacgaggacgagatcagcgacagcaaggcccagctggccgccatcaccctgatcatcggcaccttcgagagaatgaagtgcttcagcgaggagaaccacgagcccctgagaacccagtgcgccctggccgccagcaagctgctgaagaagcccgaccagggcagagccgtgagcacctgcgcccacctgttctggagcggcagaaacaccgacaagaacggcgaggagctgcacggcggcaagagagtgatggagtgcctgaagaaggccctgaagatcgccaaccagtgcatggaccccagcctgcaggtgcagctgttcatcgagatcctgaacagatacatctacttctacgagaaggagaacgacgccgtgaccatccaggtgctgaaccagctgatccagaagatcagagaggacctgcccaacctggagagcagcgaggagaccgagcagatcaacaagcacttccacaacaccctggagcacctgagactgagaagagagagccccgagagcgagggccccatctacgagggcctgatcctgtag

SEQ ID NO: 104884 - DNA, 1989 bp, Artificial Sequence
  Description of Artificial Sequence: Synthetic coding sequence
atgtgcagaggcgtgcagcaccccctgagaggcctgttcctgagaaactacctgctgcagtgcaccagaaacatcctgcccgacgagggcgagcccaccgacgaggagaccaccggcgacatcagcgacagcatggacttcgtgctgctgaacttcgccgagatgaacaagctgtgggtgagaatgcagcaccagggccacagcagagacagagagaagagagagagagagagacaggagctgagaatcctggtgggcaccaacctggtgagactgagccagctggagggcgtgaacgtggagagatacaagcagatcgtgctgaccggcatcctggagcaggtggtgaactgcagagacgccctggcccaggagtacctgatggagtgcatcatccaggtgttccccgacgagttccacctgcagaccctgaaccccttcctgagagcctgcgccgagctgcaccagaacgtgaacgtgaagaacatcatcatcgccctgatcgacagactggccctgttcgcccacagagaggacggccccggcatccccgccgacatcaagctgttcgacatcttcagccagcaggtggccaccgtgatccagagcagacaggacatgcccagcgaggacgtggtgagcctgcaggtgagcctgatcaacctggccatgaagtgctaccccgacagagtggactacgtggacaaggtgctggagaccaccgtggagatcttcaacaagctgaacctggagcacatcgccaccagcagcgccgtgagcaaggagctgaccagactgctgaagatccccgtggacacctacaacaacatcctgaccgtgctgaagctgaagcacttccaccccctgttcgagtacttcgactacgagagcagaaagagcatgagctgctacgtgctgagcaacgtgctggactacaacaccgagatcgtgagccaggaccaggtggacagcatcatgaacctggtgagcaccctgatccaggaccagcccgaccagcccgtggaggaccccgaccccgaggacttcgccgacgagcagagcctggtgggcagattcatccacctgctgagaagcgaggaccccgaccagcagtacctgatcctgaacaccgccagaaagcacttcggcgccggcggcaaccagagaatcagattcaccctgccccccctggtgttcgccgcctaccagctggccttcagatacaaggagaacagcaaggtggacgacaagtgggagaagaagtgccagaagatcttcagcttcgcccaccagaccatcagcgccctgatcaaggccgagctggccgagctgcccctgagactgttcctgcagggcgccctggccgccggcgagatcggcttcgagaaccacgagaccgtggcctacgagttcatgagccaggccttcagcctgtacgaggacgagatcagcgacagcaaggcccagctggccgccatcaccctgatcatcggcaccttcgagagaatgaagtgcttcagcgaggagaaccacgagcccctgagaacccagtgcgccctggccgccagcaagctgctgaagaagcccgaccagggcagagccgtgagcacctgcgcccacctgttctggagcggcagaaacaccgacaagaacggcgaggagctgcacggcggcaagagagtgatggagtgcctgaagaaggccctgaagatcgccaaccagtgcatggaccccagcctgcaggtgcagctgttcatcgagatcctgaacagatacatctacttctacgagaaggagaacgacgccatcgtgaccatccaggtgctgaaccagctgatccagaagatcagagaggacctgcccaacctggagagcagcgaggagaccgagcagatcaacaagcacttccacaacaccctggagcacctgagactgagaagagagagccccgagagcgagggccccatctacgagggcctgatcctgtag

SEQ ID NO: 104885 - DNA, 1161 bp, Artificial Sequence
  Description of Artificial Sequence: Synthetic coding sequence
atggacagattcgtgtggaccagcggcctgctggagatcaacgagaccctggtgatccagcagagaggcgtgagaatctacgacggcgaggagaagatcaagttcgacgccggcaccctgctgctgagcacccacagactgatctggagagaccagaagaaccacgagtgctgcatggccatcctgctgagccagatcgtgttcatcgaggagcaggccgccggcatcggcaagagcgccaagatcgtggtgcacctgcaccccgccccccccaacaaggagcccggccccttccagagcagcaagaacagctacatcaagctgagcttcaaggagcacggccagatcgagttctacagaagactgagcgaggagatgacccagagaagatgggagaacatgcccgtgagccagagcctgcagaccaacagaggcccccagcccggcagaatcagagccgtgggcatcgtgggcatcgagagaaagctggaggagaagagaaaggagaccgacaagaacatcagcgaggccttcgaggacctgagcaagctgatgatcaaggccaaggagatggtggagctgagcaagagcatcgccaacaagatcaaggacaagcagggcgacatcaccgaggacgagaccatcagattcaagagctacctgctgagcatgggcatcgccaaccccgtgaccagagagacctacggcagcggcacccagtaccacatgcagctggccaagcagctggccggcatcctgcaggtgcccctggaggagagaggcggcatcatgagcctgaccgaggtgtactgcctggtgaacagagccagaggcatggagctgctgagccccgaggacctggtgaacgcctgcaagatgctggaggccctgaagctgcccctgagactgagagtgttcgacagcggcgtgatggtgatcgagctgcagagccacaaggaggaggagatggtggccagcgccctggagaccgtgagcgagaagggcagcctgaccagcgaggagttcgccaagctggtgggcatgagcgtgctgctggccaaggagagactgctgctggccgagaagatgggccacctgtgcagagacgacagcgtggagggcctgagattctaccccaacctgttcatgacccagagctag

SEQ ID NO: 104886 - DNA, 558 bp, Artificial Sequence
  Description of Artificial Sequence: Synthetic coding sequence
atgagctggctgttccccctgaccaagagcgccagcagcagcgccgccggcagccccggcggcctgaccagcctgcagcagcagaagcagagactgatcgagagcctgagaaacagccacagcagcatcgccgagatccagaaggacgtggagtacagactgcccttcaccatcaacaacctgaccatcaacatcaacatcctgctgcccccccagttcccccaggagaagcccgtgatcagcgtgtacccccccatcagacaccacctgatggacaagcagggcgtgtacgtgaccagccccctggtgaacaacttcaccatgcacagcgacctgggcaagatcatccagagcctgctggacgagttctggaagaacccccccgtgctggcccccaccagcaccgccttcccctaccagctggagatcagatggcaccacccccactgcctggagatcagcctggccagaagcagcaacagcctgggcttcagcatcagcagcagcatcagcagcaccagaagcaagcaggagtaccacttcttcatctgctgctag

SEQ ID NO: 104887 - DNA, 1194 bp, Artificial Sequence
  Description of Artificial Sequence: Synthetic coding sequence
atgagctggctgttccccctgaccaagagcgccagcagcagcgccgccggcagccccggcggcctgaccagcctgcagcagcagaagcagagactgatcgagagcctgagaaacagccacagcagcatcgccgagatccagaaggacgtggagtacagactgcccttcaccatcaacaacctgaccatcaacatcaacatcctgctgcccccccagttcccccaggagaagcccgtgatcagcgtgtacccccccatcagacaccacctgatggacaagcagggcgtgtacgtgaccagccccctggtgaacaacttcaccatgcacagcgacctgggcaagatcatccagagcctgctggacgagttctggaagaacccccccgtgctggcccccaccagcaccgccttcccctacctgtacagcaaccccagcggcatgagcccctacgccagccagggcttccccttcctgcccccctaccccccccaggaggccaacagaagcatcaccagcctgagcgtggccgacaccgtgagcagcagcaccaccagccacaccaccgccaagcccgccgcccccagcttcggcgtgctgagcaacctgcccctgcccatccccaccgtggacgccagcatccccaccagccagaacggcttcggctacaagatgcccgacgtgcccgacgccttccccgagctgagcgagctgagcgtgagccagctgaccgacatgaacgagcaggaggaggtgctgctggagcagttcctgaccctgccccagctgaagcagatcatcaccgacaaggacgacctggtgaagagcatcgaggagctggccagaaagaacctgctgctggagcccagcctggaggccaagagacagaccgtgctggacaagtacgagctgctgacccagatgaagagcaccttcgagaagaagatgcagagacagcacgagctgagcgagagctgcagcgccagcgccctgcaggccagactgaaggtggccgcccacgaggccgaggaggagagcgacaacatcgccgaggacttcctggagggcaagatggagatcgacgacttcctgagcagcttcatggagaagagaaccatctgccactgcagaagagccaaggaggagaagctgcagcaggccatcgccatgcacagccagttccacgcccccctgtag

SEQ ID NO: 104888 - DNA, 1119 bp, Artificial Sequence
  Description of Artificial Sequence: Synthetic coding sequence
atgagctggctgttccccctgaccaagagcgccagcagcagcgccgccggcagccccggcggcctgaccagcctgcagcagcagaagcagagactgatcgagagcctgagaaacagccacagcagactgctgcccccccagttcccccaggagaagcccgtgatcagcgtgtacccccccatcagacaccacctgatggacaagcagggcgtgtacgtgaccagccccctggtgaacaacttcaccatgcacagcgacctgggcaagatcatccagagcctgctggacgagttctggaagaacccccccgtgctggcccccaccagcaccgccttcccctacctgtacagcaaccccagcggcatgagcccctacgccagccagggcttccccttcctgcccccctaccccccccaggaggccaacagaagcatcaccagcctgagcgtggccgacaccgtgagcagcagcaccaccagccacaccaccgccaagcccgccgcccccagcttcggcgtgctgagcaacctgcccctgcccatccccaccgtggacgccagcatccccaccagccagaacggcttcggctacaagatgcccgacgtgcccgacgccttccccgagctgagcgagctgagcgtgagccagctgaccgacatgaacgagcaggaggaggtgctgctggagcagttcctgaccctgccccagctgaagcagatcatcaccgacaaggacgacctggtgaagagcatcgaggagctggccagaaagaacctgctgctggagcccagcctggaggccaagagacagaccgtgctggacaagtacgagctgctgacccagatgaagagcaccttcgagaagaagatgcagagacagcacgagctgagcgagagctgcagcgccagcgccctgcaggccagactgaaggtggccgcccacgaggccgaggaggagagcgacaacatcgccgaggacttcctggagggcaagatggagatcgacgacttcctgagcagcttcatggagaagagaaccatctgccactgcagaagagccaaggaggagaagctgcagcaggccatcgccatgcacagccagttccacgcccccctgtag

SEQ ID NO: 104889 - DNA, 858 bp, Artificial Sequence
  Description of Artificial Sequence: Synthetic coding sequence
atggccggcgccggcagcgaggccagattcgccggcctgagcctggtgcagctgaacgagctgctggaggacgagggccagctgaccgagatggtgcagaagatggaggagacccagaacgtgcagctgaacaaggagatgaccctggccagcaacagaagcctggccgagggcaacctgctgtaccagccccagctggacaccctgaaggccagactgacccagaagtaccaggagctgcaggtgctgttcgaggcctaccagatcaagaagaccaagctggacagacagagcagcagcgccagcctggagaccctgctggccctgctgcaggccgagggcgccaagatcgaggaggacaccgagaacatggccgagaagttcctggacggcgagctgcccctggacagcttcatcgacgtgtaccagagcaagagaaagctggcccacatgagaagagtgaagatcgagaagctgcaggagatggtgctgaagggccagagactgccccaggccctggcccccctgccccccagactgcccgagctggcccccaccgcccccctgccctaccccgcccccgaggccagcggcccccccgccgtggcccccagaagaatcccccccccccccccccccgtgcccgccggcagactggccacccccttcaccgccgccatgagcagcggccaggccgtgccctaccccggcctgcagtgcccccccctgccccccagagtgggcctgcccacccagcagggcttcagcagccagttcgtgagcccctaccccccccccctgccccagagacccccccccagactgcccccccaccagcccggcttcatcctgcagtag

SEQ ID NO: 104890 - DNA, 1068 bp, Artificial Sequence
  Description of Artificial Sequence: Synthetic coding sequence
atggagaccctgaaggacaagaccctgcaggagctggaggagctgcagaacgacagcgaggccatcgaccagctggccctggagagccccgaggtgcaggacctgcagctggagagagagatggccctggccaccaacagaagcctggccgagagaaacctggagttccagggccccctggagatcagcagaagcaacctgagcgacagataccaggagctgagaaagctggtggagagatgccaggagcagaaggccaagctggagaagttcagcagcgccctgcagcccggcaccctgctggacctgctgcaggtggagggcatgaagatcgaggaggagagcgaggccatggccgagaagttcctggagggcgaggtgcccctggagaccttcctggagaacttcagcagcatgagaatgctgagccacctgagaagagtgagagtggagaagctgcaggaggtggtgagaaagcccagagccagccaggagctggccggcgacgcccccccccccagaccccccccccccgtgagacccgtgccccagggcaccccccccgtggtggaggagcagccccagccccccctggccatgcccccctaccccctgccctacagccccagccccagcctgcccgtgggccccaccgcccacggcgccctgccccccgcccccttccccgtggtgagccagcccagcttctacagcggccccctgggccccacctaccccgccgcccagctgggccccagaggcgccgccggctacagctggagcccccagagaagcatgccccccagacccggctaccccggcacccccatgggcgccagcggccccggctaccccctgagaggcggcagagcccccagccccggctacccccagcagagcccctaccccgccaccggcggcaagcccccctaccccatccagccccagctgcccagcttccccggccagccccagcccagcgtgcccctgcagcccccctacccccccggccccgcccccccctacggcttcccccccccccccggccccgcctggcccggctactag

SEQ ID NO: 104891 - DNA, 447 bp, Artificial Sequence
  Description of Artificial Sequence: Synthetic coding sequence
atggagaccctgaaggacaagaccctgcaggagctggaggagctgcagaacgacagcgaggccatcgaccagctggccctggagagccccgaggtgcaggacctgcagctggagagagagatggccctggccaccaacagaagcctggccgagagaaacctggagttccagggccccctggagatcagcagaagcaacctgagcgacagataccaggagctgagaaagctggtggagagatgccaggagcagaaggccaagctggagaagttcagcagcgccctgcagcccggcaccctgctggacctgctgcaggtggagggcatgaagatcgaggaggagagcgaggccatggccgagaagttcctggagggcgaggtgcccctggagaccttcctggagaacttcagcagcatgagaatgctgagccacctgagaagagtgtag

SEQ ID NO: 104892 - DNA, 969 bp, Artificial Sequence
  Description of Artificial Sequence: Synthetic coding sequence
atggagaccctgaaggacaagaccctgcaggagctggaggagctgcagaacgacagcgaggccatcgaccagctggccctggagagccccgaggtgcaggacctgcagctggagagagagatggccctggccaccaacagaagcctggccgagagaaacctggagttccagggccccctggagatcagcagaagcaacctgagcgacagataccaggagctgagaaagctggtggagagatgccaggagcagaaggccaagctggagaagttcagcagcgccctgcagcccggcaccctgctggacctgctgcaggtggagggcatgaagatcgaggaggagagcgaggccatggccgagaagttcctggagggcgaggtgcccctggagaccttcctggagaacttcagcagcatgagaatgctgagccacctgagaagagtgagagtggagaagctgcaggaggtggtgagaaagcccagagccagccaggagctggccggcgacgcccccccccccagaccccccccccccgtgagacccgtgccccagggcaccccccccgtggtggaggagcagccccagccccccctggccatgcccccctaccccctgccctacagccccagccccagcctgcccgtgggccccaccgcccacggcgccctgccccccgcccccttccccgtggtgagccagcccagcttctacagcggccccctgggccccacctaccccgccgcccagctgggccccagaggcgccgccggctacagctggagcccccagagaagcatgccccccagacccggctaccccggcacccccatgggcgccagcggccccggctaccccctgagaggcggcagagcccccagccccggctacccccagcagagcccctaccccgccaccggcggcaagcccccctaccccatccagccccagctgcccttcagcctgtgctag

SEQ ID NO: 104893 - DNA, 756 bp, Artificial Sequence
  Description of Artificial Sequence: Synthetic coding sequence
atgtacagagccagagccgccagagccggccccgagcccggcagccccggcagattcggcatcctgagcaccggccagctgagagacctgctgcaggacgagcccaagctggacagaatcgtgagactgagcagaaagttccagggcctgcagctggagagagaggcctgcctggccagcaactacgccctggccaaggagaacctggccctgagacccagactggagatgggcagagccgccctggccatcaagtaccaggagctgagagaggtggccgagaactgcgccgacaagctgcagagactggaggagagcatgcacagatggagcccccactgcgccctgggctggctgcaggccgagctggaggaggccgagcaggaggccgaggagcagatggagcagctgctgctgggcgagcagagcctggaggccttcctgcccgccttccagagaggcagagccctggcccacctgagaagaacccaggccgagaagctgcaggagctgctgagaagaagagagagaagcgcccagcccgcccccaccagcgccgccgacccccccaagagcttccccgccgccgccgtgctgcccaccggcgccgccagaggcccccccgccgtgcccagaagcctgccccccctggacagcagacccgtgccccccctgaagggcagccccggctgccccctgggccccgcccccctgctgagccccagacccagccagcccgagcccccccacagatag

SEQ ID NO: 104894 - DNA, 2628 bp, Artificial Sequence
  Description of Artificial Sequence: Synthetic coding sequence
atgcacgacgccttcgagcccgtgcccatcctggagaagctgcccctgcagatcgactgcctggccgcctgggaggagtggctgctggtgggcaccaagcagggccacctgctgctgtacagaatcagaaaggacgtgggctgcaacagattcgaggtgaccctggagaagagcaacaagaacttcagcaagaagatccagcagatccacgtggtgagccagttcaagatcctggtgagcctgctggagaacaacatctacgtgcacgacctgctgaccttccagcagatcaccaccgtgagcaaggccaagggcgccagcctgttcacctgcgacctgcagcacaccgagaccggcgaggaggtgctgagaatgtgcgtggccgtgaagaagaagctgcagctgtacttctggaaggacagagagttccacgagctgcagggcgacttcagcgtgcccgacgtgcccaagagcatggcctggtgcgagaacagcatctgcgtgggcttcaagagagactactacctgatcagagtggacggcaagggcagcatcaaggagctgttccccaccggcaagcagctggagcccctggtggcccccctggccgacggcaaggtggccgtgggccaggacgacctgaccgtggtgctgaacgaggagggcatctgcacccagaagtgcgccctgaactggaccgacatccccgtggccatggagcaccagcccccctacatcatcgccgtgctgcccagatacgtggagatcagaaccttcgagcccagactgctggtgcagagcatcgagctgcagagacccagattcatcaccagcggcggcagcaacatcatctacgtggccagcaaccacttcgtgtggagactgatccccgtgcccatggccacccagatccagcagctgctgcaggacaagcagttcgagctggccctgcagctggccgagatgaaggacgacagcgacagcgagaagcagcagcagatccaccacatcaagaacctgtacgccttcaacctgttctgccagaagagattcgacgagagcatgcaggtgttcgccaagctgggcaccgaccccacccacgtgatgggcctgtaccccgacctgctgcccaccgactacagaaagcagctgcagtaccccaaccccctgcccgtgctgagcggcgccgagctggagaaggcccacctggccctgatcgactacctgacccagaagagaagccagctggtgaagaagctgaacgacagcgaccaccagagcagcaccagccccctgatggagggcacccccaccatcaagagcaagaagaagctgctgcagatcatcgacaccaccctgctgaagtgctacctgcacaccaacgtggccctggtggcccccctgctgagactggagaacaaccactgccacatcgaggagagcgagcacgtgctgaagaaggcccacaagtacagcgagctgatcatcctgtacgagaagaagggcctgcacgagaaggccctgcaggtgctggtggaccagagcaagaaggccaacagccccctgaagggccacgagagaaccgtgcagtacctgcagcacctgggcaccgagaacctgcacctgatcttcagctacagcgtgtgggtgctgagagacttccccgaggacggcctgaagatcttcaccgaggacctgcccgaggtggagagcctgcccagagacagagtgctgggcttcctgatcgagaacttcaagggcctggccatcccctacctggagcacatcatccacgtgtgggaggagaccggcagcagattccacaactgcctgatccagctgtactgcgagaaggtgcagggcctgatgaaggagtacctgctgagcttccccgccggcaagacccccgtgcccgccggcgaggaggagggcgagctgggcgagtacagacagaagctgctgatgttcctggagatcagcagctactacgaccccggcagactgatctgcgacttccccttcgacggcctgctggaggagagagccctgctgctgggcagaatgggcaagcacgagcaggccctgttcatctacgtgcacatcctgaaggacaccagaatggccgaggagtactgccacaagcactacgacagaaacaaggacggcaacaaggacgtgtacctgagcctgctgagaatgtacctgagcccccccagcatccactgcctgggccccatcaagctggagctgctggagcccaaggccaacctgcaggccgccctgcaggtgctggagctgcaccacagcaagctggacaccaccaaggccctgaacctgctgcccgccaacacccagatcaacgacatcagaatcttcctggagaaggtgctggaggagaacgcccagaagaagagattcaaccaggtgctgaagaacctgctgcacgccgagttcctgagagtgcaggaggagagaatcctgcaccagcaggtgaagtgcatcatcaccgaggagaaggtgtgcatggtgtgcaagaagaagatcggcaacagcgccttcgccagataccccaacggcgtggtggtgcactacttctgcagcaaggaggtgaaccccgccgacacctag

SEQ ID NO: 104895 - DNA, 2661 bp, Artificial Sequence
  Description of Artificial Sequence: Synthetic coding sequence
atgcacgacgccttcgagcccgtgcccatcctggagaagctgcccctgcagatcgactgcctggccgcctgggaggagtggctgctggtgggcaccaagcagggccacctgctgctgtacagaatcagaaaggacgtggtgcccgccgacgtggccagccccgagagcggcagctgcaacagattcgaggtgaccctggagaagagcaacaagaacttcagcaagaagatccagcagatccacgtggtgagccagttcaagatcctggtgagcctgctggagaacaacatctacgtgcacgacctgctgaccttccagcagatcaccaccgtgagcaaggccaagggcgccagcctgttcacctgcgacctgcagcacaccgagaccggcgaggaggtgctgagaatgtgcgtggccgtgaagaagaagctgcagctgtacttctggaaggacagagagttccacgagctgcagggcgacttcagcgtgcccgacgtgcccaagagcatggcctggtgcgagaacagcatctgcgtgggcttcaagagagactactacctgatcagagtggacggcaagggcagcatcaaggagctgttccccaccggcaagcagctggagcccctggtggcccccctggccgacggcaaggtggccgtgggccaggacgacctgaccgtggtgctgaacgaggagggcatctgcacccagaagtgcgccctgaactggaccgacatccccgtggccatggagcaccagcccccctacatcatcgccgtgctgcccagatacgtggagatcagaaccttcgagcccagactgctggtgcagagcatcgagctgcagagacccagattcatcaccagcggcggcagcaacatcatctacgtggccagcaaccacttcgtgtggagactgatccccgtgcccatggccacccagatccagcagctgctgcaggacaagcagttcgagctggccctgcagctggccgagatgaaggacgacagcgacagcgagaagcagcagcagatccaccacatcaagaacctgtacgccttcaacctgttctgccagaagagattcgacgagagcatgcaggtgttcgccaagctgggcaccgaccccacccacgtgatgggcctgtaccccgacctgctgcccaccgactacagaaagcagctgcagtaccccaaccccctgcccgtgctgagcggcgccgagctggagaaggcccacctggccctgatcgactacctgacccagaagagaagccagctggtgaagaagctgaacgacagcgaccaccagagcagcaccagccccctgatggagggcacccccaccatcaagagcaagaagaagctgctgcagatcatcgacaccaccctgctgaagtgctacctgcacaccaacgtggccctggtggcccccctgctgagactggagaacaaccactgccacatcgaggagagcgagcacgtgctgaagaaggcccacaagtacagcgagctgatcatcctgtacgagaagaagggcctgcacgagaaggccctgcaggtgctggtggaccagagcaagaaggccaacagccccctgaagggccacgagagaaccgtgcagtacctgcagcacctgggcaccgagaacctgcacctgatcttcagctacagcgtgtgggtgctgagagacttccccgaggacggcctgaagatcttcaccgaggacctgcccgaggtggagagcctgcccagagacagagtgctgggcttcctgatcgagaacttcaagggcctggccatcccctacctggagcacatcatccacgtgtgggaggagaccggcagcagattccacaactgcctgatccagctgtactgcgagaaggtgcagggcctgatgaaggagtacctgctgagcttccccgccggcaagacccccgtgcccgccggcgaggaggagggcgagctgggcgagtacagacagaagctgctgatgttcctggagatcagcagctactacgaccccggcagactgatctgcgacttccccttcgacggcctgctggaggagagagccctgctgctgggcagaatgggcaagcacgagcaggccctgttcatctacgtgcacatcctgaaggacaccagaatggccgaggagtactgccacaagcactacgacagaaacaaggacggcaacaaggacgtgtacctgagcctgctgagaatgtacctgagcccccccagcatccactgcctgggccccatcaagctggagctgctggagcccaaggccaacctgcaggccgccctgcaggtgctggagctgcaccacagcaagctggacaccaccaaggccctgaacctgctgcccgccaacacccagatcaacgacatcagaatcttcctggagaaggtgctggaggagaacgcccagaagaagagattcaaccaggtgctgaagaacctgctgcacgccgagttcctgagagtgcaggaggagagaatcctgcaccagcaggtgaagtgcatcatcaccgaggagaaggtgtgcatggtgtgcaagaagaagatcggcaacagcgccttcgccagataccccaacggcgtggtggtgcactacttctgcagcaaggaggtgaaccccgccgacacctag

SEQ ID NO: 104896 - DNA, 1314 bp, Artificial Sequence
  Description of Artificial Sequence: Synthetic coding sequence
atgaccaccagcaccctgcagaaggccatcgacctggtgaccaaggccaccgaggaggacaaggccaagaactacgaggaggccctgagactgtaccagcacgccgtggagtacttcctgcacgccatcaagtacgaggcccacagcgacaaggccaaggagagcatcagagccaagtgcgtgcagtacctggacagagccgagaagctgaaggactacctgagaagcaaggagaagcacggcaagaagcccgtgaaggagaaccagagcgagggcaagggcagcgacagcgacagcgagggcgacaaccccgagaagaagaagctgcaggagcagctgatgggcgccgtggtgatggagaagcccaacatcagatggaacgacgtggccggcctggagggcgccaaggaggccctgaaggaggccgtgatcctgcccatcaagttcccccacctgttcaccggcaagagaaccccctggagaggcatcctgctgttcggcccccccggcaccggcaagagctacctggccaaggccgtggccaccgaggccaacaacagcaccttcttcagcgtgagcagcagcgacctgatgagcaagtggctgggcgagagcgagaagctggtgaagaacctgttcgagctggccagacagcacaagcccagcatcatcttcatcgacgaggtggacagcctgtgcggcagcagaaacgagaacgagagcgaggccgccagaagaatcaagaccgagttcctggtgcagatgcagggcgtgggcaacaacaacgacggcaccctggtgctgggcgccaccaacatcccctgggtgctggacagcgccatcagaagaagattcgagaagagaatctacatccccctgcccgaggaggccgccagagcccagatgttcagactgcacctgggcagcaccccccacaacctgaccgacgccaacatccacgagctggccagaaagaccgagggctacagcggcgccgacatcagcatcatcgtgagagacagcctgatgcagcccgtgagaaaggtgcagagcgccacccacttcaagaaggtgtgcggccccagcagaaccaaccccagcatgatgatcgacgacctgctgaccccctgcagccccggcgaccccggcgccatggagatgacctggatggacgtgcccggcgacaagctgctggagcccgtggtgtgcatgagcgacatgctgagaagcctggccaccaccagacccaccgtgaacgccgacgacctgctgaaggtgaagaagttcagcgaggacttcggccaggagagctag

SEQ ID NO: 104897 - DNA, 1335 bp, Artificial Sequence
  Description of Artificial Sequence: Synthetic coding sequence
atgagcagcaccagccccaacctgcagaaggccatcgacctggccagcaaggccgcccaggaggacaaggccggcaactacgaggaggccctgcagctgtaccagcacgccgtgcagtacttcctgcacgtggtgaagtacgaggcccagggcgacaaggccaagcagagcatcagagccaagtgcaccgagtacctggacagagccgagaagctgaaggagtacctgaagaacaaggagaagaaggcccagaagcccgtgaaggagggccagcccagccccgccgacgagaagggcaacgacagcgacggcgagggcgagagcgacgaccccgagaagaagaagctgcagaaccagctgcagggcgccatcgtgatcgagagacccaacgtgaagtggagcgacgtggccggcctggagggcgccaaggaggccctgaaggaggccgtgatcctgcccatcaagttcccccacctgttcaccggcaagagaaccccctggagaggcatcctgctgttcggcccccccggcaccggcaagagctacctggccaaggccgtggccaccgaggccaacaacagcaccttcttcagcatcagcagcagcgacctggtgagcaagtggctgggcgagagcgagaagctggtgaagaacctgttccagctggccagagagaacaagcccagcatcatcttcatcgacgagatcgacagcctgtgcggcagcagaagcgagaacgagagcgaggccgccagaagaatcaagaccgagttcctggtgcagatgcagggcgtgggcgtggacaacgacggcatcctggtgctgggcgccaccaacatcccctgggtgctggacagcgccatcagaagaagattcgagaagagaatctacatccccctgcccgagccccacgccagagccgccatgttcaagctgcacctgggcaccacccagaacagcctgaccgaggccgacttcagagagctgggcagaaagaccgacggctacagcggcgccgacatcagcatcatcgtgagagacgccctgatgcagcccgtgagaaaggtgcagagcgccacccacttcaagaaggtgagaggccccagcagagccgaccccaaccacctggtggacgacctgctgaccccctgcagccccggcgaccccggcgccatcgagatgacctggatggacgtgcccggcgacaagctgctggagcccgtggtgagcatgagcgacatgctgagaagcctgagcaacaccaagcccaccgtgaacgagcacgacctgctgaagctgaagaagttcaccgaggacttcggccaggagggctag

SEQ ID NO: 104898 - DNA, 630 bp, Artificial Sequence
  Description of Artificial Sequence: Synthetic coding sequence
atggccgaggccgaggagcaggagaccggcagcctggaggagagcaccgacgagagcgaggaggaggagagcgaggaggagcccaagctgaagtacgagagactgagcaacggcgtgaccgagatcctgcagaaggacgccgccagctgcatgaccgtgcacgacaagttcctggccctgggcacccactacggcaaggtgtacctgctggacgtgcagggcaacatcacccagaagttcgacgtgagccccgtgaagatcaaccagatcagcctggacgagagcggcgagcacatgggcgtgtgcagcgaggacggcaaggtgcaggtgttcggcctgtacagcggcgaggagttccacgagaccttcgactgccccatcaagatcatcgccgtgcacccccacttcgtgagaagcagctgcaagcagttcgtgaccggcggcaagaagctgctgctgttcgagagaagctggatgaacagatggaagagcgccgtgctgcacgagggcgagggcaacatcagaagcgtgaagtggagaggccacctgatcgcctgggccaacaacatgagcaagaagcccgaggcctggagagtggccaagaagatgaagagctacctgaacaactag

SEQ ID NO: 104899 - DNA, 2565 bp, Artificial Sequence
  Description of Artificial Sequence: Synthetic coding sequence
atggccgaggccgaggagcaggagaccggcagcctggaggagagcaccgacgagagcgaggaggaggagagcgaggaggagcccaagctgaagtacgagagactgagcaacggcgtgaccgagatcctgcagaaggacgccgccagctgcatgaccgtgcacgacaagttcctggccctgggcacccactacggcaaggtgtacctgctggacgtgcagggcaacatcacccagaagttcgacgtgagccccgtgaagatcaaccagatcagcctggacgagagcggcgagcacatgggcgtgtgcagcgaggacggcaaggtgcaggtgttcggcctgtacagcggcgaggagttccacgagaccttcgactgccccatcaagatcatcgccgtgcacccccacttcgtgagaagcagctgcaagcagttcgtgaccggcggcaagaagctgctgctgttcgagagaagctggatgaacagatggaagagcgccgtgctgcacgagggcgagggcaacatcagaagcgtgaagtggagaggccacctgatcgcctgggccaacaacatgggcgtgaagatcttcgacatcatcagcaagcagagaatcaccaacgtgcccagagacgacatcagcctgagacccgacatgtacccctgcagcctgtgctggaaggacaacgtgaccctgatcatcggctggggcaccagcgtgaaggtgtgcagcgtgaaggagagacacgccagcgagatgagagacctgcccagcagatacgtggagatcgtgagccagttcgagaccgagttctacatcagcggcctggcccccctgtgcgaccagctggtggtgctgagctacgtgaaggagatcagcgagaagaccgagagagagtactgcgccagacccagactggacatcatccagcccctgagcgagacctgcgaggagatcagcagcgacgccctgaccgtgagaggcttccaggagaacgagtgcagagactaccacctggagtacagcgagggcgagagcctgttctacatcgtgagccccagagacgtggtggtggccaaggagagagaccaggacgaccacatcgactggctgctggagaagaagaagtacgaggaggccctgatggccgccgagatcagccagaagaacatcaagagacacaagatcctggacatcggcctggcctacatcaaccacctggtggagagaggcgactacgacatcgccgccagaaagtgccagaagatcctgggcaagaacgccgccctgtgggagtacgaggtgtacaagttcaaggagatcggccagctgaaggccatcagcccctacctgcccagaggcgaccccgtgctgaagcccctgatctacgagatgatcctgcacgagttcctggagagcgactacgagggcttcgccaccctgatcagagagtggcccggcgacctgtacaacaacagcgtgatcgtgcaggccgtgagagaccacctgaagaaggacagccagaacaagaccctgctgaagaccctggccgagctgtacacctacgacaagaactacggcaacgccctggagatctacctgaccctgagacacaaggacgtgttccagctgatccacaagcacaacctgttcagcagcatcaaggacaagatcgtgctgctgatggacttcgacagcgagaaggccgtggacatgctgctggacaacgaggacaagatcagcatcaagaaggtggtggaggagctggaggacagacccgagctgcagcacgtgtacctgcacaagctgttcaagagagaccaccacaagggccagagataccacgagaagcagatcagcctgtacgccgagtacgacagacccaacctgctgcccttcctgagagacagcacccactgccccctggagaaggccctggagatctgccagcagagaaacttcgtggaggagaccgtgtacctgctgagcagaatgggcaacagcagaagcgccctgaagatgatcatggaggagctgcacgacgtggacaaggccatcgagttcgccaaggagcaggacgacggcgagctgtgggaggacctgatcctgtacagcatcgacaagccccccttcatcaccggcctgctgaacaacatcggcacccacgtggaccccatcctgctgatccacagaatcaaggagggcatggagatccccaacctgagagacagcctggtgaagatcctgcaggactacaacctgcagatcctgctgagagagggctgcaagaagatcctggtggccgacagcctgagcctgctgaagaagatgcacagaacccagatgaagggcgtgctggtggacgaggagaacatctgcgagagctgcctgagccccatcctgcccagcgacgccgccaagcccttcagcgtggtggtgttccactgcagacacatgttccacaaggagtgcctgcccatgcccagcatgaacagcgccgcccagttctgcaacatctgcagcgccaagaacagaggccccggcagcgccatcctggagatgaagaagtag

SEQ ID NO: 104900 - DNA, 2490 bp, Artificial Sequence
  Description of Artificial Sequence: Synthetic coding sequence
atggccgaggccgaggagcaggagaccggcagcctggaggagagcaccgacgagagcgaggaggaggagagcgaggaggagcccaagctgaagtacgagagactgagcaacggcgtgaccgagatcctgcagaaggacgccgccagctgcatgaccgtgcacgacaagttcctggccctgggcacccactacggcaaggtgtacctgctggacgtgcagggcaacatcacccagaagttcgacgtggtgcaggtgttcggcctgtacagcggcgaggagttccacgagaccttcgactgccccatcaagatcatcgccgtgcacccccacttcgtgagaagcagctgcaagcagttcgtgaccggcggcaagaagctgctgctgttcgagagaagctggatgaacagatggaagagcgccgtgctgcacgagggcgagggcaacatcagaagcgtgaagtggagaggccacctgatcgcctgggccaacaacatgggcgtgaagatcttcgacatcatcagcaagcagagaatcaccaacgtgcccagagacgacatcagcctgagacccgacatgtacccctgcagcctgtgctggaaggacaacgtgaccctgatcatcggctggggcaccagcgtgaaggtgtgcagcgtgaaggagagacacgccagcgagatgagagacctgcccagcagatacgtggagatcgtgagccagttcgagaccgagttctacatcagcggcctggcccccctgtgcgaccagctggtggtgctgagctacgtgaaggagatcagcgagaagaccgagagagagtactgcgccagacccagactggacatcatccagcccctgagcgagacctgcgaggagatcagcagcgacgccctgaccgtgagaggcttccaggagaacgagtgcagagactaccacctggagtacagcgagggcgagagcctgttctacatcgtgagccccagagacgtggtggtggccaaggagagagaccaggacgaccacatcgactggctgctggagaagaagaagtacgaggaggccctgatggccgccgagatcagccagaagaacatcaagagacacaagatcctggacatcggcctggcctacatcaaccacctggtggagagaggcgactacgacatcgccgccagaaagtgccagaagatcctgggcaagaacgccgccctgtgggagtacgaggtgtacaagttcaaggagatcggccagctgaaggccatcagcccctacctgcccagaggcgaccccgtgctgaagcccctgatctacgagatgatcctgcacgagttcctggagagcgactacgagggcttcgccaccctgatcagagagtggcccggcgacctgtacaacaacagcgtgatcgtgcaggccgtgagagaccacctgaagaaggacagccagaacaagaccctgctgaagaccctggccgagctgtacacctacgacaagaactacggcaacgccctggagatctacctgaccctgagacacaaggacgtgttccagctgatccacaagcacaacctgttcagcagcatcaaggacaagatcgtgctgctgatggacttcgacagcgagaaggccgtggacatgctgctggacaacgaggacaagatcagcatcaagaaggtggtggaggagctggaggacagacccgagctgcagcacgtgtacctgcacaagctgttcaagagagaccaccacaagggccagagataccacgagaagcagatcagcctgtacgccgagtacgacagacccaacctgctgcccttcctgagagacagcacccactgccccctggagaaggccctggagatctgccagcagagaaacttcgtggaggagaccgtgtacctgctgagcagaatgggcaacagcagaagcgccctgaagatgatcatggaggagctgcacgacgtggacaaggccatcgagttcgccaaggagcaggacgacggcgagctgtgggaggacctgatcctgtacagcatcgacaagccccccttcatcaccggcctgctgaacaacatcggcacccacgtggaccccatcctgctgatccacagaatcaaggagggcatggagatccccaacctgagagacagcctggtgaagatcctgcaggactacaacctgcagatcctgctgagagagggctgcaagaagatcctggtggccgacagcctgagcctgctgaagaagatgcacagaacccagatgaagggcgtgctggtggacgaggagaacatctgcgagagctgcctgagccccatcctgcccagcgacgccgccaagcccttcagcgtggtggtgttccactgcagacacatgttccacaaggagtgcctgcccatgcccagcatgaacagcgccgcccagttctgcaacatctgcagcgccaagaacagaggccccggcagcgccatcctggagatgaagaagtag

SEQ ID NO: 104901 - DNA, 1617 bp, Artificial Sequence
  Description of Artificial Sequence: Synthetic coding sequence
atggtgtacacccagagcgagatcctgcagaaggaggtgtacctgttcgagagaatcgacagccagaacagagagatcatgaagcacctgaaggccatctgcttcctgagacccaccaaggagaacgtggactacatcatccaggagctgagaagacccaagtacaccatctacttcatctacttcagcaacgtgatcagcaagagcgacgtgaagagcctggccgaggccgacgagcaggaggtggtggccgaggtgcagcaggtgatcaccaaggagtacgagctgttcgagttcagaagaaccgaggtgccccccctgctgctgatcctggacagatgcgacgacgccatcacccccctgctgaaccagtggacctaccaggccatggtgcacgagctgctgggcatcaacaacaacagaatcgacctgagcagagtgcccggcatcagcaaggacctgagagaggtggtgctgagcgccgagaacgacgagttctacgccaacaacatgtacctgaacttcgccgagatcggcagcaacatcaagaacctgatggaggacttccagaagaagaagcccaaggagcagcagaagctggagagcatcgccgacatgaaggccttcgtggagaactacccccagttcaagaagatgagcggcaccgtgagcaagcacgtgaccgtggtgggcgagctgagcagactggtgagcgagagaaacctgctggaggtgagcgaggtggagcaggagctggcctgccagaacgaccacagcagcgccctgcagaacatcaagagactgctgcagaaccccaaggtgaccgagttcgacgccgccagactggtgatgctgtacgccctgcactacgagagacacagcagcaacagcctgcccggcctgatgatggacctgagaaacaagggcgtgagcgagaagtacagaaagctggtgagcgccgtggtggagtacggcggcaagagagtgagaggcagcgacctgttcagccccaaggacgccgtggccatcaccaagcagttcctgaagggcctgaagggcgtggagaacgtgtacacccagcaccagcccttcctgcacgagaccctggaccacctgatcaagggcagactgaaggagaacctgtacccctacctgggccccagcaccctgagagacagaccccaggacatcatcgtgttcgtgatcggcggcgccacctacgaggaggccctgaccgtgtacaacctgaacagaaccacccccggcgtgagaatcgtgctgggcggcaccaccgtgcacaacaccaagagagacggcgtgagcctgtgcagccccgcctggttcagaacccccggcctgaagagaagcaccagactgagcctgcccaagtgctgggactacagcttccccagaggcagcagcggcttctggaccgcccagcccaagcagggcgagctgagcagccacatcaaggtgagcgagcagaagatgaagagatggctgggcgagggccacagcttcctgagctgcccccactacagattcagcctgctgaacaagggcgtgggcgagcagctgtgggtgctgtgctggctgctggagctgatcagcagatag

SEQ ID NO: 104902 - DNA, 1713 bp, Artificial Sequence
  Description of Artificial Sequence: Synthetic coding sequence
atgaacgtggtgttcgccgtgaagcagtacatcagcaagatgatcgaggacagcggccccggcatgaaggtgctgctgatggacaaggagaccaccggcatcgtgagcatggtgtacacccagagcgagatcctgcagaaggaggtgtacctgttcgagagaatcgacagccagaacagagagatcatgaagcacctgaaggccatctgcttcctgagacccaccaaggagaacgtggactacatcatccaggagctgagaagacccaagtacaccatctacttcatctacttcagcaacgtgatcagcaagagcgacgtgaagagcctggccgaggccgacgagcaggaggtggtggccgaggtgcaggagttctacggcgactacatcgccgtgaacccccacctgttcagcctgaacatcctgggctgctgccagggcagaaactgggaccccgcccagctgagcagaaccacccagggcctgaccgccctgctgctgagcctgaagaagtgccccatgatcagataccagctgagcagcgaggccgccaagagactggccgagtgcgtgaagcaggtgatcaccaaggagtacgagctgttcgagttcagaagaaccgaggtgccccccctgctgctgatcctggacagatgcgacgacgccatcacccccctgctgaaccagtggacctaccaggccatggtgcacgagctgctgggcatcaacaacaacagaatcgacctgagcagagtgcccggcatcagcaaggacctgagagaggtggtgctgagcgccgagaacgacgagttctacgccaacaacatgtacctgaacttcgccgagatcggcagcaacatcaagaacctgatggaggacttccagaagaagaagcccaaggagcagcagaagctggagagcatcgccgacatgaaggccttcgtggagaactacccccagttcaagaagatgagcggcaccgtgagcaagcacgtgaccgtggtgggcgagctgagcagactggtgagcgagagaaacctgctggaggtgagcgaggtggagcaggagctggcctgccagaacgaccacagcagcgccctgcagaacatcaagagactgctgcagaaccccaaggtgaccgagttcgacgccgccagactggtgatgctgtacgccctgcactacgagagacacagcagcaacagcctgcccggcctgatgatggacctgagaaacaagggcgtgagcgagaagtacagaaagctggtgagcgccgtggtggagtacggcggcaagagagtgagaggcagcgacctgttcagccccaaggacgccgtggccatcaccaagcagttcctgaagggcctgaagggcgtggagaacgtgtacacccagcaccagcccttcctgcacgagaccctggaccacctgatcaagggcagactgaaggagaacctgtacccctacctgggccccagcaccctgagagacagaccccaggacatcatcgtgttcgtgatcggcggcgccacctacgaggaggccctgaccgtgtacaacctgaacagaaccacccccggcgtgagaatcgtgctgggcggcaccaccgtgcacaacaccaagagcttcctggaggaggtgctggccagcggcctgcacagcagaagcaaggagagcagccaggtgaccagcagaagcgccagcagaagatag

SEQ ID NO: 104903 - DNA, 951 bp, Artificial Sequence
  Description of Artificial Sequence: Synthetic coding sequence
atgaacgtggtgttcgccgtgaagcagtacatcagcaagatgatcgaggacagcggccccggcatgaaggtgctgctgatggacaaggagaccaccggcatcgtgagcatggtgtacacccagagcgagatcctgcagaaggaggtgtacctgttcgagagaatcgacagccagaacagagagatcatgaagcacctgaaggccatctgcttcctgagacccaccaaggagaacgtggactacatcatccaggagctgagaagacccaagtacaccatctacttcatctacttcagcaacgtgatcagcaagagcgacgtgaagagcctggccgaggccgacgagcaggaggtggtggccgaggtgcagcaggtgatcaccaaggagtacgagctgttcgagttcagaagaaccgaggtgccccccctgctgctgatcctggacagatgcgacgacgccatcacccccctgctgaaccagtggacctaccaggccatggtgcacgagctgctgggcatcaacaacaacagaatcgacctgagcagagtgcccggcatcagcaaggacctgagagaggtggtgctgagcgccgagaacgacgagttctacgccaacaacatgtacctgaacttcgccgagatcggcagcaacatcaagaacctgatggaggacttccagaagaagaagcccaaggagcagcagaagctggagagcatcgccgacatgaaggccttcgtggagaactacccccagttcaagaagatgagcggcaccgtgagcaagcacgtgaccgtggtgggcgagctgagcagactggtgagcgagagaaacctgctggaggtgagcgaggtggagcaggagctggcctgccagaacgaccacagcagcgccctgcagaacatcaagagactgctgcagaaccccaaggtgaccgagttcgacgccgcctag

SEQ ID NO: 104904 - DNA, 1305 bp, Artificial Sequence
  Description of Artificial Sequence: Synthetic coding sequence
atgaacgtggtgttcgccgtgaagcagtacatcagcaagatgatcgaggacagcggccccggcatgaaggtgctgctgatggacaaggagaccaccggcatcgtgagcatggtgtacacccagagcgagatcctgcagaaggaggtgtacctgttcgagagaatcgacagccagaacagagagatcatgaagcacctgaaggccatctgcttcctgagacccaccaaggagaacgtggactacatcatccaggagctgagaagacccaagtacaccatctacttcatctacttcagcaacgtgatcagcaagagcgacgtgaagagcctggccgaggccgacgagcaggaggtggtggccgaggtgcagcaggtgatcaccaaggagtacgagctgttcgagttcagaagaaccgaggtgccccccctgctgctgatcctggacagatgcgacgacgccatcacccccctgctgaaccagtggacctaccaggccatggtgcacgagctgctgggcatcaacaacaacagaatcgacctgagcagagtgcccggcatcagcaaggacctgagagaggtggtgctgagcgccgagaacgacgagttctacgccaacaacatgtacctgaacttcgccgagatcggcagcaacatcaagaacctgatggaggacttccagaagaagaagcccaaggagcagcagaagctggagagcatcgccgacatgaaggccttcgtggagaactacccccagttcaagaagatgagcggcaccgtgagcaagcacgtgaccgtggtgggcgagctgagcagactggtgagcgagagaaacctgctggaggtgagcgaggtggagcaggagctggcctgccagaacgaccacagcagcgccctgcagaacatcaagagactgctgcagaaccccaaggtgaccgagttcgacgccgccagactggtgatgctgtacgccctgcactacgagagacacagcagcaacagcctgcccggcctgatgatggacctgagaaacaagggcgtgagcgagaagtacagaaagctggtgagcgccgtggtggagtacggcggcaagagagtgagaggcagcgacctgttcagccccaaggacgccgtggccatcaccaagcagttcctgaagggcctgaagggcgtggagaacgtgtacacccagcaccagcccttcctgcacgagaccctggaccacctgatcaagggcagactgaaggagaacctgtacccctacctgggccccagcaccctgagagacagaatcgccagctgcctgtag

SEQ ID NO: 104905 - DNA, 1338 bp, Artificial Sequence
  Description of Artificial Sequence: Synthetic coding sequence
atgaacgtggtgttcgccgtgaacccccacctgttcagcctgaacatcctgggctgctgccagggcagaaactgggaccccgcccagctgagcagaaccacccagggcctgaccgccctgctgctgagcctgaagaagtgccccatgatcagataccagctgagcagcgaggccgccaagagactggccgagtgcgtgaagcaggtgatcaccaaggagtacgagctgttcgagttcagaagaaccgaggtgccccccctgctgctgatcctggacagatgcgacgacgccatcacccccctgctgaaccagtggacctaccaggccatggtgcacgagctgctgggcatcaacaacaacagaatcgacctgagcagagtgcccggcatcagcaaggacctgagagaggtggtgctgagcgccgagaacgacgagttctacgccaacaacatgtacctgaacttcgccgagatcggcagcaacatcaagaacctgatggaggacttccagaagaagaagcccaaggagcagcagaagctggagagcatcgccgacatgaaggccttcgtggagaactacccccagttcaagaagatgagcggcaccgtgagcaagcacgtgaccgtggtgggcgagctgagcagactggtgagcgagagaaacctgctggaggtgagcgaggtggagcaggagctggcctgccagaacgaccacagcagcgccctgcagaacatcaagagactgctgcagaaccccaaggtgaccgagttcgacgccgccagactggtgatgctgtacgccctgcactacgagagacacagcagcaacagcctgcccggcctgatgatggacctgagaaacaagggcgtgagcgagaagtacagaaagctggtgagcgccgtggtggagtacggcggcaagagagtgagaggcagcgacctgttcagccccaaggacgccgtggccatcaccaagcagttcctgaagggcctgaagggcgtggagaacgtgtacacccagcaccagcccttcctgcacgagaccctggaccacctgatcaagggcagactgaaggagaacctgtacccctacctgggccccagcaccctgagagacagaccccaggacatcatcgtgttcgtgatcggcggcgccacctacgaggaggccctgaccgtgtacaacctgaacagaaccacccccggcgtgagaatcgtgctgggcggcaccaccgtgcacaacaccaagagcttcctggaggaggtgctggccagcggcctgcacagcagaagcaaggagagcagccaggtgaccagcagaagcgccagcagaagatag

SEQ ID NO: 104906 - DNA, 1128 bp, Artificial Sequence
  Description of Artificial Sequence: Synthetic coding sequence
atgagcctggccggcggcagagcccccagaaagaccgccggcaacagactgagcggcctgctggaggccgaggaggaggacgagttctaccagaccacctacggcggcttcaccgaggagagcggcgacgacgagtaccagggcgaccagagcgacaccgaggacgaggtggacagcgacttcgacatcgacgagggcgacgagcccagcagcgacggcgaggccgaggagcccagaagaaagagaagagtggtgaccaaggcctacaaggagcccctgaagagcctgagacccagaaaggtgaacacccccgccggcagcagccagaaggccagagaggagaaggccctgctgcccctggagctgcaggacgacggcagcgacagcagaaagagcatgagacagagcaccgccgagcacaccagacagaccttcctgagagtgcaggagagacagggccagagcagaagaagaaagggcccccactgcgagagacccctgacccaggaggagctgctgagagaggccaagatcaccgaggagctgaacctgagaagcctggagacctacgagagactggaggccgacaagaagaagcaggtgcacaagaagagaaagtgccccggccccatcatcacctaccacagcgtgaccgtgcccctggtgggcgagcccggccccaaggaggagaacgtggacatcgagggcagcctgtgcttcagcctgagcttcgtgctgagactggaccccgcccccagcgtgagcgccctgaccccccacgccggcaccggccccgtgaacccccccgccagatgcagcagaaccttcatcaccttcagcgacgacgccaccttcgaggagtggttcccccagggcagaccccccaaggtgcccgtgagagaggtgtgccccgtgacccacagacccgccctgtacagagaccccgtgaccgacatcccctacgccaccgccagagccttcaagatcatcagagaggcctacaagaagtacatcaccgcccacggcctgccccccaccgccagcgccctgggccccggcccccccccccccgagcccctgcccggcagcggccccagagccctgagacagaagatcgtgatcaagtag

SEQ ID NO: 104907 - DNA, 1095 bp, Artificial Sequence
  Description of Artificial Sequence: Synthetic coding sequence
atgagcctggccggcggcagagcccccagaaagaccgccggcaacagactgagcggcctgctggaggccgaggaggaggacgagttctaccagaccacctacggcggcttcaccgaggagagcggcgacgacgagtaccagggcgaccagagcgacaccgaggacgaggtggacagcgacttcgacatcgacgagggcgacgagcccagcagcgacggcgaggccgaggagcccagaagaaagagaagagtggtgaccaaggcctacaaggagcccctgaagagcctgagacccagaaaggtgaacacccccgccggcagcagccagaaggccagagaggagaaggccctgctgcccctggagctgcaggacgacggcagcgacagcagaaagagcatgagacagagcaccgccgagcacaccagacagaccttcctgagagtgcaggagagacagggccagagcagaagaagaaagggcccccactgcgagagacccctgacccaggaggagctgctgagagaggccaagatcaccgaggagctgaacctgagaagcctggagacctacgagagactggaggccgacaagaagaagcaggtgcacaagaagagaaagtgccccggccccatcatcacctaccacagcgtgaccgtgcccctggtgggcgagcccggccccaaggaggagaacgtggacatcgagggcctggaccccgcccccagcgtgagcgccctgaccccccacgccggcaccggccccgtgaacccccccgccagatgcagcagaaccttcatcaccttcagcgacgacgccaccttcgaggagtggttcccccagggcagaccccccaaggtgcccgtgagagaggtgtgccccgtgacccacagacccgccctgtacagagaccccgtgaccgacatcccctacgccaccgccagagccttcaagatcatcagagaggcctacaagaagtacatcaccgcccacggcctgccccccaccgccagcgccctgggccccggcccccccccccccgagcccctgcccggcagcggccccagagccctgagacagaagatcgtgatcaagtag

SEQ ID NO: 104908 - DNA, 1221 bp, Artificial Sequence
  Description of Artificial Sequence: Synthetic coding sequence
atggccgagaacggcaagaactgcgaccagagaagagtggccatgaacaaggagcaccacaacggcaacttcaccgaccccagcagcgtgaacgagaagaagagaagagagagagaggagagacagaacatcgtgctgtggagacagcccctgatcaccctgcagtacttcagcctggagatcctggtgatcctgaaggagtggaccagcaagctgtggcacagacagagcatcgtggtgagcttcctgctgctgctggccgtgctgatcgccacctactacgtggagggcgtgcaccagcagtacgtgcagagaatcgagaagcagttcctgctgtacgcctactggatcggcctgggcatcctgagcagcgtgggcctgggcaccggcctgcacaccttcctgctgtacctgggcccccacatcgccagcgtgaccctggccgcctacgagtgcaacagcgtgaacttccccgagcccccctaccccgaccagatcatctgccccgacgaggagggcaccgagggcaccatcagcctgtggagcatcatcagcaaggtgagaatcgaggcctgcatgtggggcatcggcaccgccatcggcgagctgcccccctacttcatggccagagccgccagactgagcggcgccgagcccgacgacgaggagtaccaggagttcgaggagatgctggagcacgccgagagcgcccaggacttcgccagcagagccaagctggccgtgcagaagctggtgcagaaggtgggcttcttcggcatcctggcctgcgccagcatccccaaccccctgttcgacctggccggcatcacctgcggccacttcctggtgcccttctggaccttcttcggcgccaccctgatcggcaaggccatcatcaagatgcacatccagaagatcttcgtgatcatcaccttcagcaagcacatcgtggagcagatggtggccttcatcggcgccgtgcccggcatcggccccagcctgcagaagcccttccaggagtacctggaggcccagagacagaagctgcaccacaagagcgagatgggcaccccccagggcgagaactggctgagctggatgttcgagaagctggtggtggtgatggtgtgctacttcatcctgagcatcatcaacagcatggcccagagctacgccaagagaatccagcagagactgaacagcgaggagaagaccaagtag

SEQ ID NO: 104909 - DNA, 930 bp, Artificial Sequence
  Description of Artificial Sequence: Synthetic coding sequence
atggacctgaagtacgtgcagagaatcgagaagcagttcctgctgtacgcctactggatcggcctgggcatcctgagcagcgtgggcctgggcaccggcctgcacaccttcctgctgtacctgggcccccacatcgccagcgtgaccctggccgcctacgagtgcaacagcgtgaacttccccgagcccccctaccccgaccagatcatctgccccgacgaggagggcaccgagggcaccatcagcctgtggagcatcatcagcaaggtgagaatcgaggcctgcatgtggggcatcggcaccgccatcggcgagctgcccccctacttcatggccagagccgccagactgagcggcgccgagcccgacgacgaggagtaccaggagttcgaggagatgctggagcacgccgagagcgcccaggacttcgccagcagagccaagctggccgtgcagaagctggtgcagaaggtgggcttcttcggcatcctggcctgcgccagcatccccaaccccctgttcgacctggccggcatcacctgcggccacttcctggtgcccttctggaccttcttcggcgccaccctgatcggcaaggccatcatcaagatgcacatccagaagatcttcgtgatcatcaccttcagcaagcacatcgtggagcagatggtggccttcatcggcgccgtgcccggcatcggccccagcctgcagaagcccttccaggagtacctggaggcccagagacagaagctgcaccacaagagcgagatgggcaccccccagggcgagaactggctgagctggatgttcgagaagctggtggtggtgatggtgtgctacttcatcctgagcatcatcaacagcatggcccagagctacgccaagagaatccagcagagactgaacagcgaggagaagaccaagtag

SEQ ID NO: 104910 - DNA, 819 bp, Artificial Sequence
  Description of Artificial Sequence: Synthetic coding sequence
atggacctgaagggcccccacatcgccagcgtgaccctggccgcctacgagtgcaacagcgtgaacttccccgagcccccctaccccgaccagatcatctgccccgacgaggagggcaccgagggcaccatcagcctgtggagcatcatcagcaaggtgagaatcgaggcctgcatgtggggcatcggcaccgccatcggcgagctgcccccctacttcatggccagagccgccagactgagcggcgccgagcccgacgacgaggagtaccaggagttcgaggagatgctggagcacgccgagagcgcccaggacttcgccagcagagccaagctggccgtgcagaagctggtgcagaaggtgggcttcttcggcatcctggcctgcgccagcatccccaaccccctgttcgacctggccggcatcacctgcggccacttcctggtgcccttctggaccttcttcggcgccaccctgatcggcaaggccatcatcaagatgcacatccagaagatcttcgtgatcatcaccttcagcaagcacatcgtggagcagatggtggccttcatcggcgccgtgcccggcatcggccccagcctgcagaagcccttccaggagtacctggaggcccagagacagaagctgcaccacaagagcgagatgggcaccccccagggcgagaactggctgagctggatgttcgagaagctggtggtggtgatggtgtgctacttcatcctgagcatcatcaacagcatggcccagagctacgccaagagaatccagcagagactgaacagcgaggagaagaccaagtag

SEQ ID NO: 104911 - DNA, 645 bp, Artificial Sequence
  Description of Artificial Sequence: Synthetic coding sequence
atgtggggcatcggcaccgccatcggcgagctgcccccctacttcatggccagagccgccagactgagcggcgccgagcccgacgacgaggagtaccaggagttcgaggagatgctggagcacgccgagagcgcccaggacttcgccagcagagccaagctggccgtgcagaagctggtgcagaaggtgggcttcttcggcatcctggcctgcgccagcatccccaaccccctgttcgacctggccggcatcacctgcggccacttcctggtgcccttctggaccttcttcggcgccaccctgatcggcaaggccatcatcaagatgcacatccagaagatcttcgtgatcatcaccttcagcaagcacatcgtggagcagatggtggccttcatcggcgccgtgcccggcatcggccccagcctgcagaagcccttccaggagtacctggaggcccagagacagaagctgcaccacaagagcgagatgggcaccccccagggcgagaactggctgagctggatgttcgagaagctggtggtggtgatggtgtgctacttcatcctgagcatcatcaacagcatggcccagagctacgccaagagaatccagcagagactgaacagcgaggagaagaccaagtag

SEQ ID NO: 104912 - DNA, 1053 bp, Artificial Sequence
  Description of Artificial Sequence: Synthetic coding sequence
atggccgagaacggcaagaactgcgaccagagaagagtggccatgaacaaggagcaccacaacggcaacttcaccgaccccagcagcgtgaacgagaagaagagaagagagagagaggagagacagaacatcgtgctgtggagacagcccctgatcaccctgcagtacttcagcctggagatcctggtgatcctgaaggagtggaccagcaagctgtggcacagacagagcatcgtggtgagcttcctgctgctgctggccgtgctgatcgccacctactacgtggagggcgtgcaccagcagtacgtgcagagaatcgagaagcagttcctgctgtacgcctactggatcggcctgggcatcctgagcagcgtgggcctgggcaccggcctgcacaccttcctgctgtacctgggcatcggcaccgccatcggcgagctgcccccctacttcatggccagagccgccagactgagcggcgccgagcccgacgacgaggagtaccaggagttcgaggagatgctggagcacgccgagagcgcccaggacttcgccagcagagccaagctggccgtgcagaagctggtgcagaaggtgggcttcttcggcatcctggcctgcgccagcatccccaaccccctgttcgacctggccggcatcacctgcggccacttcctggtgcccttctggaccttcttcggcgccaccctgatcggcaaggccatcatcaagatgcacatccagaagatcttcgtgatcatcaccttcagcaagcacatcgtggagcagatggtggccttcatcggcgccgtgcccggcatcggccccagcctgcagaagcccttccaggagtacctggaggcccagagacagaagctgcaccacaagagcgagatgggcaccccccagggcgagaactggctgagctggatgttcgagaagctggtggtggtgatggtgtgctacttcatcctgagcatcatcaacagcatggcccagagctacgccaagagaatccagcagagactgaacagcgaggagaagaccaagtag

SEQ ID NO: 104913 - DNA, 1443 bp, Artificial Sequence
  Description of Artificial Sequence: Synthetic coding sequence
atgagcgacgtggccatcgtgaaggagggctggctgcacaagagaggcgagtacatcaagacctggagacccagatacttcctgctgaagaacgacggcaccttcatcggctacaaggagagaccccaggacgtggaccagagagaggcccccctgaacaacttcagcgtggcccagtgccagctgatgaagaccgagagacccagacccaacaccttcatcatcagatgcctgcagtggaccaccgtgatcgagagaaccttccacgtggagacccccgaggagagagaggagtggaccaccgccatccagaccgtggccgacggcctgaagaagcaggaggaggaggagatggacttcagaagcggcagccccagcgacaacagcggcgccgaggagatggaggtgagcctggccaagcccaagcacagagtgaccatgaacgagttcgagtacctgaagctgctgggcaagggcaccttcggcaaggtgatcctggtgaaggagaaggccaccggcagatactacgccatgaagatcctgaagaaggaggtgatcgtggccaaggacgaggtggcccacaccctgaccgagaacagagtgctgcagaacagcagacaccccttcctgaccgccctgaagtacagcttccagacccacgacagactgtgcttcgtgatggagtacgccaacggcggcgagctgttcttccacctgagcagagagagagtgttcagcgaggacagagccagattctacggcgccgagatcgtgagcgccctggactacctgcacagcgagaagaacgtggtgtacagagacctgaagctggagaacctgatgctggacaaggacggccacatcaagatcaccgacttcggcctgtgcaaggagggcatcaaggacggcgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagaagctgttcgagctgatcctgatggaggagatcagattccccagaaccctgggccccgaggccaagagcctgctgagcggcctgctgaagaaggaccccaagcagagactgggcggcggcagcgaggacgccaaggagatcatgcagcacagattcttcgccggcatcgtgtggcagcacgtgtacgagaagaagctgagcccccccttcaagccccaggtgaccagcgagaccgacaccagatacttcgacgaggagttcaccgcccagatgatcaccatcaccccccccgaccaggacgacagcatggagtgcgtggacagcgagagaagaccccacttcccccagttcagctacagcgccagcggcaccgcctag

SEQ ID NO: 104914 - DNA, 1443 bp, Artificial Sequence; identical to SEQ ID NO: 104913
  Description of Artificial Sequence: Synthetic coding sequence

SEQ ID NO: 104915 - DNA, 1257 bp, Artificial Sequence
  Description of Artificial Sequence: Synthetic coding sequence
atgaagaccgagagacccagacccaacaccttcatcatcagatgcctgcagtggaccaccgtgatcgagagaaccttccacgtggagacccccgaggagagagaggagtggaccaccgccatccagaccgtggccgacggcctgaagaagcaggaggaggaggagatggacttcagaagcggcagccccagcgacaacagcggcgccgaggagatggaggtgagcctggccaagcccaagcacagagtgaccatgaacgagttcgagtacctgaagctgctgggcaagggcaccttcggcaaggtgatcctggtgaaggagaaggccaccggcagatactacgccatgaagatcctgaagaaggaggtgatcgtggccaaggacgaggtggcccacaccctgaccgagaacagagtgctgcagaacagcagacaccccttcctgaccgccctgaagtacagcttccagacccacgacagactgtgcttcgtgatggagtacgccaacggcggcgagctgttcttccacctgagcagagagagagtgttcagcgaggacagagccagattctacggcgccgagatcgtgagcgccctggactacctgcacagcgagaagaacgtggtgtacagagacctgaagctggagaacctgatgctggacaaggacggccacatcaagatcaccgacttcggcctgtgcaaggagggcatcaaggacggcgccaccatgaagaccttctgcggcacccccgagtacctggcccccgaggtgctggaggacaacgactacggcagagccgtggactggtggggcctgggcgtggtgatgtacgagatgatgtgcggcagactgcccttctacaaccaggaccacgagaagctgttcgagctgatcctgatggaggagatcagattccccagaaccctgggccccgaggccaagagcctgctgagcggcctgctgaagaaggaccccaagcagagactgggcggcggcagcgaggacgccaaggagatcatgcagcacagattcttcgccggcatcgtgtggcagcacgtgtacgagaagaagctgagcccccccttcaagccccaggtgaccagcgagaccgacaccagatacttcgacgaggagttcaccgcccagatgatcaccatcaccccccccgaccaggacgacagcatggagtgcgtggacagcgagagaagaccccacttcccccagttcagctacagcgccagcggcaccgcctag

SEQ ID NO: 104916 - DNA, 1443 bp, Artificial Sequence; identical to SEQ ID NO: 104913
  Description of Artificial Sequence: Synthetic coding sequence

SEQ ID NO: 104917 - DNA, 1443 bp, Artificial Sequence; identical to SEQ ID NO: 104913
  Description of Artificial Sequence: Synthetic coding sequence

SEQ ID NO: 104918 - DNA, 1443 bp, Artificial Sequence; identical to SEQ ID NO: 104913
  Description of Artificial Sequence: Synthetic coding sequence

SEQ ID NO: 104919 - DNA, 279 bp, Artificial Sequence
  Description of Artificial Sequence: Synthetic coding sequence
atgagcgacgtggccatcgtgaaggagggctggctgcacaagagaggcgagtacatcaagacctggagacccagatacttcctgctgaagaacgacggcaccttcatcggctacaaggagagaccccaggacgtggaccagagagaggcccccctgaacaacttcagcgtggcccagtgccagctgatgaagaccgagagacccagacccaacaccttcatcatcagatgcctgcagtggaccaccgtgatcgagagaaccttccacgtggagacctag

SEQ ID NO: 104920 - DNA, 2421 bp, Artificial Sequence
  Description of Artificial Sequence: Synthetic coding sequence
atggccagcggcgccgacagcaagggcgacgacctgagcaccgccatcctgaagcagaagaacagacccaacagactgatcgtggacgaggccatcaacgaggacaacagcgtggtgagcctgagccagcccaagatggacgagctgcagctgttcagaggcgacaccgtgctgctgaagggcaagaagagaagagaggccgtgtgcatcgtgctgagcgacgacacctgcagcgacgagaagatcagaatgaacagagtggtgagaaacaacctgagagtgagactgggcgacgtgatcagcatccagccctgccccgacgtgaagtacggcaagagaatccacgtgctgcccatcgacgacaccgtggagggcatcaccggcaacctgttcgaggtgtacctgaagccctacttcctggaggcctacagacccatcagaaagggcgacatcttcctggtgagaggcggcatgagagccgtggagttcaaggtggtggagaccgaccccagcccctactgcatcgtggcccccgacaccgtgatccactgcgagggcgagcccatcaagagagaggacgaggaggagagcctgaacgaggtgggctacgacgacatcggcggctgcagaaagcagctggcccagatcaaggagatggtggagctgcccctgagacaccccgccctgttcaaggccatcggcgtgaagccccccagaggcatcctgctgtacggcccccccggcaccggcaagaccctgatcgccagagccgtggccaacgagaccggcgccttcttcttcctgatcaacggccccgagatcatgagcaagctggccggcgagagcgagagcaacctgagaaaggccttcgaggaggccgagaagaacgcccccgccatcatcttcatcgacgagctggacgccatcgcccccaagagagagaagacccacggcgaggtggagagaagaatcgtgagccagctgctgaccctgatggacggcctgaagcagagagcccacgtgatcgtgatggccgccaccaacagacccaacagcatcgaccccgccctgagaagattcggcagattcgacagagaggtggacatcggcatccccgacgccaccggcagactggagatcctgcagatccacaccaagaacatgaagctggccgacgacgtggacctggagcaggtggccaacgagacccacggccacgtgggcgccgacctggccgccctgtgcagcgaggccgccctgcaggccatcagaaagaagatggacctgatcgacctggaggacgagaccatcgacgccgaggtgatgaacagcctggccgtgaccatggacgacttcagatgggccctgagccagagcaaccccagcgccctgagagagaccgtggtggaggtgccccaggtgacctgggaggacatcggcggcctggaggacgtgaagagagagctgcaggagctggtgcagtaccccgtggagcaccccgacaagttcctgaagttcggcatgacccccagcaagggcgtgctgttctacggcccccccggctgcggcaagaccctgctggccaaggccatcgccaacgagtgccaggccaacttcatcagcatcaagggccccgagctgctgaccatgtggttcggcgagagcgaggccaacgtgagagagatcttcgacaaggccagacaggccgccccctgcgtgctgttcttcgacgagctggacagcatcgccaaggccagaggcggcaacatcggcgacggcggcggcgccgccgacagagtgatcaaccagatcctgaccgagatggacggcatgagcaccaagaagaacgtgttcatcatcggcgccaccaacagacccgacatcatcgaccccgccatcctgagacccggcagactggaccagctgatctacatccccctgcccgacgagaagagcagagtggccatcctgaaggccaacctgagaaagagccccgtggccaaggacgtggacctggagttcctggccaagatgaccaacggcttcagcggcgccgacctgaccgagatctgccagagagcctgcaagctggccatcagagagagcatcgagagcgagatcagaagagagagagagagacagaccaaccccagcgccatggaggtggaggaggacgaccccgtgcccgagatcagaagagaccacttcgaggaggccatgagattcgccagaagaagcgtgagcgacaacgacatcagaaagtacgagatgttcgcccagaccctgcagcagagcagaggcttcggcagcttcagattccccagcggcaaccagggcggcgccggccccagccagggcagcggcggcggcaccggcggcagcgtgtacaccgaggacaacgacgacgacctgtacggctag

SEQ ID NO: 104921 - DNA, 3669 bp, Artificial Sequence
  Description of Artificial Sequence: Synthetic coding sequence
atgagccagcccccccccccccccccccccctgcccccccccccccccccccccgaggccccccagacccccagcagcctggccagcgccgccgccagcggcggcctgctgaagagaagagacagaagaatcctgagcggcagctgccccgaccccaagtgccaggccagactgttcttccccgccagcggcagcgtgagcatcgagtgcaccgagtgcggccagagacacgagcagcagcagctgctgggcgtggaggaggtgaccgaccccgacgtggtgctgcacaacctgctgagaaacgccctgctgggcgtgaccggcgcccccaagaagaacaccgagctggtgaaggtgatgggcctgagcaactaccactgcaagctgctgagccccatcctggccagatacggcatggacaagcagaccggcagagccaagctgctgagagacatgaaccagggcgagctgttcgactgcgccctgctgggcgacagagccttcctgatcgagcccgagcacgtgaacaccgtgggctacggcaaggacagaagcggcagcctgctgtacctgcacgacaccctggaggacatcaagagagccaacaagagccaggagtgcctgatccccgtgcacgtggacggcgacggccactgcctggtgcacgccgtgagcagagccctggtgggcagagagctgttctggcacgccctgagagagaacctgaagcagcacttccagcagcacctggccagataccaggccctgttccacgacttcatcgacgccgccgagtgggaggacatcatcaacgagtgcgaccccctgttcgtgccccccgagggcgtgcccctgggcctgagaaacatccacatcttcggcctggccaacgtgctgcacagacccatcatcctgctggacagcctgagcggcatgagaagcagcggcgactacagcgccaccttcctgcccggcctgatccccgccgagaagtgcaccggcaaggacggccacctgaacaagcccatctgcatcgcctggagcagcagcggcagaaaccactacatccccctggtgggcatcaagggcgccgccctgcccaagctgcccatgaacctgctgcccaaggcctggggcgtgccccaggacctgatcaagaagtacatcaagctggaggaggacggcggctgcgtgatcggcggcgacagaagcctgcaggacaagtacctgctgagactggtggccgccatggaggaggtgttcatggacaagcacggcatccaccccagcctggtggccgacgtgcaccagtacttctacagaagaaccggcgtgatcggcgtgcagcccgaggaggtgaccgccgccgccaagaaggccgtgatggacaacagactgcacaagtgcctgctgtgcggcgccctgagcgagctgcacgtgccccccgagtggctggcccccggcggcaagctgtacaacctggccaagagcacccacggccagctgagaaccgacaagaactacagcttccccctgaacaacctggtgtgcagctacgacagcgtgaaggacgtgctggtgcccgactacggcatgagcaacctgaccgcctgcaactggtgccacggcaccagcgtgagaaaggtgagaggcgacggcagcatcgtgtacctggacggcgacagaaccaacagcagaagcaccggcggcaagtgcggctgcggcttcaagcacttctgggacggcaaggagtacgacaacctgcccgaggccttccccatcaccctggagtggggcggcagagtggtgagagagaccgtgtactggttccagtacgagagcgacagcagcctgaacagcaacgtgtacgacgtggccatgaagctggtgaccaagcacttccccggcgagttcggcagcgagatcctggtgcagaaggtggtgcacaccatcctgcaccagaccgccaagaagaaccccgacgactacacccccgtgaacatcgacggcgcccacgcccagagagtgggcgacgtgcagggccaggagagcgagagccagctgcccaccaagatcatcctgaccggccagaagaccaagaccctgcacaaggaggagctgaacatgagcaagaccgagagaaccatccagcagaacatcaccgagcaggccagcgtgatgcagaagagaaagaccgagaagctgaagcaggagcagaagggccagcccagaaccgtgagccccagcaccatcagagacggccccagcagcgcccccgccacccccaccaaggccccctacagccccaccaccagcaaggagaagaagatcagaatcaccaccaacgacggcagacagagcatggtgaccctgaagagcagcaccaccttcttcgagctgcaggagagcatcgccagagagttcaacatccccccctacctgcagtgcatcagatacggcttcccccccaaggagctgatgcccccccaggccggcatggagaaggagcccgtgcccctgcagcacggcgacagaatcaccatcgagatcctgaagagcaaggccgagggcggccagagcgccgccgcccacagcgcccacaccgtgaagcaggaggacatcgccgtgaccggcaagctgagcagcaaggagctgcaggagcaggccgagaaggagatgtacagcctgtgcctgctggccaccctgatgggcgaggacgtgtggagctacgccaagggcctgccccacatgttccagcagggcggcgtgttctacagcatcatgaagaagaccatgggcatggccgacggcaagcactgcaccttcccccacctgcccggcaagaccttcgtgtacaacgccagcgaggacagactggagctgtgcgtggacgccgccggccacttccccatcggccccgacgtggaggacctggtgaaggaggccgtgagccaggtgagagccgaggccaccaccagaagcagagagagcagccccagccacggcctgctgaagctgggcagcggcggcgtggtgaagaagaagagcgagcagctgcacaacgtgaccgccttccagggcaagggccacagcctgggcaccgccagcggcaacccccacctggaccccagagccagagagaccagcgtggtgagaaagcacaacaccggcaccgacttcagcaacagcagcaccaagaccgagcccagcgtgttcaccgccagcagcagcaacagcgagctgatcagaatcgcccccggcgtggtgaccatgagagacggcagacagctggaccccgacctggtggaggcccagagaaagaagctgcaggagatggtgagcagcatccaggccagcatggacagacacctgagagaccagagcaccgagcagagccccagcgacctgccccagagaaagaccgaggtggtgagcagcagcgccaagagcggcagcctgcagaccggcctgcccgagagcttccccctgaccggcggcaccgagaacctgaacaccgagaccaccgacggctgcgtggccgacgccctgggcgccgccttcgccaccagaagcaaggcccagagaggcaacagcgtggaggagctggaggagatggacagccaggacgccgagatgaccaacaccaccgagcccatggaccacagctag

SEQ ID NO: 104922 - DNA, 3381 bp, Artificial Sequence; identical to SEQ ID NO: 74107
  Description of Artificial Sequence: Synthetic coding sequence

SEQ ID NO: 104923 - DNA, 3795 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaacccccttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatacgtgctggacccccccgccagaagaatctggaacaacgtgaccagatggttcgtgacctgcgtgagacagcccgagttcagagccgtgctgggcgaggtggtgctgtacagcggcgccagacccctgagccaccagcccggccccgaggcccccgccctgcccaagaccgccgcccagctgaagaaggaggccaagaagagagagaagctggagaagttccagcagaagcagaagatccagcagcagcagcccccccccggcgagaagaagcccaagcccgagaagagagagaagagagaccccggcgtgatcacctacgacctgcccaccccccccggcgagaagaaggacgtgagcggccccatgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatggcacagaatgagaggcgagaccaccctgtggaaccccggctgcgaccacgccggcatcgccacccaggtggtggtggagaagaagctgtggagagagcagggcctgagcagacaccagctgggcagagaggccttcctgcaggaggtgtggaagtggaaggaggagaagggcgacagaatctaccaccagctgaagaagctgggcagcagcctggactgggacagagcctgcttcaccatggaccccaagctgagcgccgccgtgaccgaggccttcgtgagactgcacgaggagggcatcatctacagaagcaccagactggtgaactggagctgcaccctgaacagcgccatcagcgacatcgaggtggacaagaaggagctgaccggcagaaccctgctgagcgtgcccggctacaaggagaaggtggagttcggcgtgctggtgagcttcgcctacaaggtgcagggcagcgacagcgacgaggaggtggtggtggccaccaccagaatcgagaccatgctgggcgacgtggccgtggccgtgcaccccaaggacaccagataccagcacctgaagggcaagaacgtgatccaccccttcctgagcagaagcctgcccatcgtgttcgacgagttcgtggacatggacttcggcaccggcgccgtgaagatcacccccgcccacgaccagaacgactacgaggtgggccagagacacggcctggaggccatcagcatcatggacagcagaggcgccctgatcaacgtgcccccccccttcctgggcctgcccagattcgaggccagaaaggccgtgctggtggccctgaaggagagaggcctgttcagaggcatcgaggacaaccccatggtggtgcccctgtgcaacagaagcaaggacgtggtggagcccctgctgagaccccagtggtacgtgagatgcggcgagatggcccaggccgccagcgccgccgtgaccagaggcgacctgagaatcctgcccgaggcccaccagagaacctggcacgcctggatggacaacatcagagagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgcccagccccaccagccagcccggcggccacgagagcctggtggacagatggatcagaagcagactgaccgaggccgtgagactgagcaaccagggcttccaggcctacgacttccccgccgtgaccaccgcccagtacagcttctggctgtacgagctgtgcgacgtgtacctggagtgcctgaagcccgtgctgaacggcgtggaccaggtggccgccgagtgcgccagacagaccctgtacacctgcctggacgtgggcctgagactgctgagccccttcatgcccttcgtgaccgaggagctgttccagagactgcccagaagaatgccccaggccccccccagcctgtgcgtgaccccctaccccgagcccagcgagtgcagctggaaggaccccgaggccgaggccgccctggagctggccctgagcatcaccagagccgtgagaagcctgagagccgactacaacctgaccagaatcagacccgactgcttcctggaggtggccgacgaggccaccggcgccctggccagcgccgtgagcggctacgtgcaggccctggccagcgccggcgtggtggccgtgctggccctgggcgcccccgccccccagggctgcgccgtggccctggccagcgacagatgcagcatccacctgcagctgcagggcctggtggaccccgccagagagctgggcaagctgcaggccaagagagtggaggcccagagacaggcccagagactgagagagagaagagccgccagcggctaccccgtgaaggtgcccctggaggtgcaggaggccgacgaggccaagctgcagcagaccgaggccgagctgagaaaggtggacgaggccatcgccctgttccagaagatgctgtag

SEQ ID NO: 104924 - DNA, 525 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaaccagcttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatactag

SEQ ID NO: 104925 - DNA, 525 bp, Artificial Sequence; identical to SEQ ID NO: 104924
  Description of Artificial Sequence: Synthetic coding sequence

SEQ ID NO: 104926 - DNA, 867 bp, Artificial Sequence
  Description of Artificial Sequence: Synthetic coding sequence
tgaaaggagagaggcctgttcagaggcatcgaggacaaccccatggtggtgcccctgtgcaacagaagcaaggacgtggtggagcccctgctgagaccccagtgggagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgccctag

SEQ ID NO: 104927 - DNA, 3795 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaaccagcttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatacgtgctggacccccccgccagaagaatctggaacaacgtgaccagatggttcgtgacctgcgtgagacagcccgagttcagagccgtgctgggcgaggtggtgctgtacagcggcgccagacccctgagccaccagcccggccccgaggcccccgccctgcccaagaccgccgcccagctgaagaaggaggccaagaagagagagaagctggagaagttccagcagaagcagaagatccagcagcagcagcccccccccggcgagaagaagcccaagcccgagaagagagagaagagagaccccggcgtgatcacctacgacctgcccaccccccccggcgagaagaaggacgtgagcggccccatgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatggcacagaatgagaggcgagaccaccctgtggaaccccggctgcgaccacgccggcatcgccacccaggtggtggtggagaagaagctgtggagagagcagggcctgagcagacaccagctgggcagagaggccttcctgcaggaggtgtggaagtggaaggaggagaagggcgacagaatctaccaccagctgaagaagctgggcagcagcctggactgggacagagcctgcttcaccatggaccccaagctgagcgccgccgtgaccgaggccttcgtgagactgcacgaggagggcatcatctacagaagcaccagactggtgaactggagctgcaccctgaacagcgccatcagcgacatcgaggtggacaagaaggagctgaccggcagaaccctgctgagcgtgcccggctacaaggagaaggtggagttcggcgtgctggtgagcttcgcctacaaggtgcagggcagcgacagcgacgaggaggtggtggtggccaccaccagaatcgagaccatgctgggcgacgtggccgtggccgtgcaccccaaggacaccagataccagcacctgaagggcaagaacgtgatccaccccttcctgagcagaagcctgcccatcgtgttcgacgagttcgtggacatggacttcggcaccggcgccgtgaagatcacccccgcccacgaccagaacgactacgaggtgggccagagacacggcctggaggccatcagcatcatggacagcagaggcgccctgatcaacgtgcccccccccttcctgggcctgcccagattcgaggccagaaaggccgtgctggtggccctgaaggagagaggcctgttcagaggcatcgaggacaaccccatggtggtgcccctgtgcaacagaagcaaggacgtggtggagcccctgctgagaccccagtggtacgtgagatgcggcgagatggcccaggccgccagcgccgccgtgaccagaggcgacctgagaatcctgcccgaggcccaccagagaacctggcacgcctggatggacaacatcagagagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgcccagccccaccagccagcccggcggccacgagagcctggtggacagatggatcagaagcagactgaccgaggccgtgagactgagcaaccagggcttccaggcctacgacttccccgccgtgaccaccgcccagtacagcttctggctgtacgagctgtgcgacgtgtacctggagtgcctgaagcccgtgctgaacggcgtggaccaggtggccgccgagtgcgccagacagaccctgtacacctgcctggacgtgggcctgagactgctgagccccttcatgcccttcgtgaccgaggagctgttccagagactgcccagaagaatgccccaggccccccccagcctgtgcgtgaccccctaccccgagcccagcgagtgcagctggaaggaccccgaggccgaggccgccctggagctggccctgagcatcaccagagccgtgagaagcctgagagccgactacaacctgaccagaatcagacccgactgcttcctggaggtggccgacgaggccaccggcgccctggccagcgccgtgagcggctacgtgcaggccctggccagcgccggcgtggtggccgtgctggccctgggcgcccccgccccccagggctgcgccgtggccctggccagcgacagatgcagcatccacctgcagctgcagggcctggtggaccccgccagagagctgggcaagctgcaggccaagagagtggaggcccagagacaggcccagagactgagagagagaagagccgccagcggctaccccgtgaaggtgcccctggaggtgcaggaggccgacgaggccaagctgcagcagaccgaggccgagctgagaaaggtggacgaggccatcgccctgttccagaagatgctgtag

SEQ ID NO: 104928 - DNA, 1101 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaacccccttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatacgtgctggacccccccgccagaagaatctggaacaacgtgaccagatggttcgtgacctgcgtgagacagcccgagttcagagccgtgctgggcgaggtggtgctgtacagcggcgccagacccctgagccaccagcccggccccgaggcccccgccctgcccaagaccgccgcccagctgaagaaggaggccaagaagagagagaagctggagaagttccagcagaagcagaagatccagcagcagcagcccccccccggcgagaagaagcccaagcccgagaagagagagaagagagaccccggcgtgatcacctacgacctgcccaccccccccggcgagaagaaggacgtgagcggccccatgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatag

SEQ ID NO: 104929 - DNA, 525 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcctgcagcccccccccaccagcagaacccccttccccccccccagactgcccgccctggagcagggccccggcggcctgtgggtgtggggcgccaccgccgtggcccagctgctgtggcccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatactag

SEQ ID NO: 104930 - DNA, 3552 bp, Artificial Sequence
  Description of Artificial Sequence: Synthetic coding sequence
tgaggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatacgtgctggacccccccgccagaagaatctggaacaacgtgaccagatggttcgtgacctgcgtgagacagcccgagttcagagccgtgctgggcgaggtggtgctgtacagcggcgccagacccctgagccaccagcccggccccgaggcccccgccctgcccaagaccgccgcccagctgaagaaggaggccaagaagagagagaagctggagaagttccagcagaagcagaagatccagcagcagcagcccccccccggcgagaagaagcccaagcccgagaagagagagaagagagaccccggcgtgatcacctacgacctgcccaccccccccggcgagaagaaggacgtgagcggccccatgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatggcacagaatgagaggcgagaccaccctgtggaaccccggctgcgaccacgccggcatcgccacccaggtggtggtggagaagaagctgtggagagagcagggcctgagcagacaccagctgggcagagaggccttcctgcaggaggtgtggaagtggaaggaggagaagggcgacagaatctaccaccagctgaagaagctgggcagcagcctggactgggacagagcctgcttcaccatggaccccaagctgagcgccgccgtgaccgaggccttcgtgagactgcacgaggagggcatcatctacagaagcaccagactggtgaactggagctgcaccctgaacagcgccatcagcgacatcgaggtggacaagaaggagctgaccggcagaaccctgctgagcgtgcccggctacaaggagaaggtggagttcggcgtgctggtgagcttcgcctacaaggtgcagggcagcgacagcgacgaggaggtggtggtggccaccaccagaatcgagaccatgctgggcgacgtggccgtggccgtgcaccccaaggacaccagataccagcacctgaagggcaagaacgtgatccaccccttcctgagcagaagcctgcccatcgtgttcgacgagttcgtggacatggacttcggcaccggcgccgtgaagatcacccccgcccacgaccagaacgactacgaggtgggccagagacacggcctggaggccatcagcatcatggacagcagaggcgccctgatcaacgtgcccccccccttcctgggcctgcccagattcgaggccagaaaggccgtgctggtggccctgaaggagagaggcctgttcagaggcatcgaggacaaccccatggtggtgcccctgtgcaacagaagcaaggacgtggtggagcccctgctgagaccccagtggtacgtgagatgcggcgagatggcccaggccgccagcgccgccgtgaccagaggcgacctgagaatcctgcccgaggcccaccagagaacctggcacgcctggatggacaacatcagagagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgcccagccccaccagccagcccggcggccacgagagcctggtggacagatggatcagaagcagactgaccgaggccgtgagactgagcaaccagggcttccaggcctacgacttccccgccgtgaccaccgcccagtacagcttctggctgtacgagctgtgcgacgtgtacctggagtgcctgaagcccgtgctgaacggcgtggaccaggtggccgccgagtgcgccagacagaccctgtacacctgcctggacgtgggcctgagactgctgagccccttcatgcccttcgtgaccgaggagctgttccagagactgcccagaagaatgccccaggccccccccagcctgtgcgtgaccccctaccccgagcccagcgagtgcagctggaaggaccccgaggccgaggccgccctggagctggccctgagcatcaccagagccgtgagaagcctgagagccgactacaacctgaccagaatcagacccgactgcttcctggaggtggccgacgaggccaccggcgccctggccagcgccgtgagcggctacgtgcaggccctggccagcgccggcgtggtggccgtgctggccctgggcgcccccgccccccagggctgcgccgtggccctggccagcgacagatgcagcatccacctgcagctgcagggcctggtggaccccgccagagagctgggcaagctgcaggccaagagagtggaggcccagagacaggcccagagactgagagagagaagagccgccagcggctaccccgtgaaggtgcccctggaggtgcaggaggccgacgaggccaagctgcagcagaccgaggccgagctgagaaaggtggacgaggccatcgccctgttccagaagatgctgtag

SEQ ID NO: 104931 - DNA, 525 bp, Artificial Sequence; identical to SEQ ID NO: 104929
  Description of Artificial Sequence: Synthetic coding sequence

SEQ ID NO: 104932 - DNA, 867 bp, Artificial Sequence; identical to SEQ ID NO: 104926
  Description of Artificial Sequence: Synthetic coding sequence

SEQ ID NO: 104933 - DNA, 525 bp, Artificial Sequence; identical to SEQ ID NO: 104929
  Description of Artificial Sequence: Synthetic coding sequence

SEQ ID NO: 104934 - DNA, 867 bp, Artificial Sequence; identical to SEQ ID NO: 104926
  Description of Artificial Sequence: Synthetic coding sequence

SEQ ID NO: 104935 - DNA, 867 bp, Artificial Sequence; identical to SEQ ID NO: 104926
  Description of Artificial Sequence: Synthetic coding sequence

SEQ ID NO: 104936 - DNA, 3795 bp, Artificial Sequence; identical to SEQ ID NO: 104927
  Description of Artificial Sequence: Synthetic coding sequence

SEQ ID NO: 104937 - DNA, 525 bp, Artificial Sequence; identical to SEQ ID NO: 104929
  Description of Artificial Sequence: Synthetic coding sequence

SEQ ID NO: 104938 - DNA, 894 bp, Artificial Sequence
  Description of Artificial Sequence: Synthetic coding sequence
atgcccgacagctacagccccagatacgtggaggccgcctggtacccctggtgggagcagcagggcttcttcaagcccgagtacggcagacccaacgtgagcgccgccaaccccagaggcgtgttcatgatgtgcatccccccccccaacgtgaccggcagcctgcacctgggccacgccctgaccaacgccatccaggacagcctgaccagatggcacagaatgagaggcgagaccaccctgtggaaccccggctgcgaccacgccggcatcgccacccaggtggtggtggagaagaagctgtggagagagcagggcctgagcagacaccagctgggcagagaggccttcctgcaggaggtgtggaagtggaaggaggagaagggcgacagaatctaccaccagctgaagaagctgggcagcagcctggactgggacagagcctgcttcaccatggaccccaagctgagcgccgccgtgaccgaggccttcgtgagactgcacgaggagggcatcatctacagaagcaccagactggtgaactggagctgcaccctgaacagcgccatcagcgacatcgaggtggacaagaaggagctgaccggcagaaccctgctgagcgtgcccggctacaaggagaaggtggagttcggcgtgctggtgagcttcgcctacaaggtgcagggcagcgacagcgacgaggaggtggtggtggccaccaccagaatcgagaccatgctgggcgacgtggccgtggccgtgcaccccaaggacaccagataccagcacctgaagggcaagaacgtgatccaccccttcctgagcagaagcctgcccatcgtgttcgacgagttcgtggacatggacttcggcaccggccccgcccaggtgtag

SEQ ID NO: 104939 - DNA, 867 bp, Artificial Sequence; identical to SEQ ID NO: 104926
  Description of Artificial Sequence: Synthetic coding sequence

SEQ ID NO: 104940 - DNA, 867 bp, Artificial Sequence; identical to SEQ ID NO: 104926
  Description of Artificial Sequence: Synthetic coding sequence

SEQ ID NO: 104941 - DNA, 288 bp, Artificial Sequence
  Description of Artificial Sequence: Synthetic coding sequence
tgacccgccggcctgggcggccccggcggcagcagagccgccgtgctggtgcagcagtgggtgagctacgccgacaccgagctgatccccgccgcctgcggcgccaccctgcccgccctgggcctgagaagcagcgcccaggacccccaggccgtgctgggcgccctgggcagagccctgagccccctggaggagtggctgagactgcacacctacctggccggcgaggcccccaccctggccgacctggccgccgtgaccgccctgctgctgcccttcagatactag

SEQ ID NO: 104942 - DNA, 3795 bp, Artificial Sequence; identical to SEQ ID NO: 104923
  Description of Artificial Sequence: Synthetic coding sequence

SEQ ID NO: 104943 - DNA, 2031 bp, Artificial Sequence
  Description of Artificial Sequence: Synthetic coding sequence
atgagcaccctgtacgtgagcccccaccccgacgccttccccagcctgagagccctgatcgccgccagatacggcgaggccggcgagggccccggctggggcggcgcccaccccagaatctgcagactgcccagattcgaggccagaaaggccgtgctggtggccctgaaggagagaggcctgttcagaggcatcgaggacaaccccatggtggtgcccctgtgcaacagaagcaaggacgtggtggagcccctgctgagaccccagtggtacgtgagatgcggcgagatggcccaggccgccagcgccgccgtgaccagaggcgacctgagaatcctgcccgaggcccaccagagaacctggcacgcctggatggacaacatcagagagtggtgcatcagcagacagctgtggtggggccacagaatccccgcctacttcgtgaccgtgagcgaccccgccgtgccccccggcgaggaccccgacggcagatactgggtgagcggcagaaacgaggccgaggccagagagaaggccgccaaggagttcggcgtgagccccgacaagatcagcctgcagcaggacgaggacgtgctggacacctggttcagcagcggcctgttccccctgagcatcctgggctggcccaaccagagcgaggacctgagcgtgttctaccccggcaccctgctggagaccggccacgacatcctgttcttctgggtggccagaatggtgatgctgggcctgaagctgaccggcagactgcccttcagagaggtgtacctgcacgccatcgtgagagacgcccacggcagaaagatgagcaagagcctgggcaacgtgatcgaccccctggacgtgatctacggcatcagcctgcagggcctgcacaaccagctgctgaacagcaacctggaccccagcgaggtggagaaggccaaggagggccagaaggccgacttccccgccggcatccccgagtgcggcaccgacgccctgagattcggcctgtgcgcctacatgagccagggcagagacatcaacctggacgtgaacagaatcctgggctacagacacttctgcaacaagctgtggaacgccaccaagttcgccctgagaggcctgggcaagggcttcgtgcccagccccaccagccagcccggcggccacgagagcctggtggacagatggatcagaagcagactgaccgaggccgtgagactgagcaaccagggcttccaggcctacgacttccccgccgtgaccaccgcccagtacagcttctggctgtacgagctgtgcgacgtgtacctggagtgcctgaagcccgtgctgaacggcgtggaccaggtggccgccgagtgcgccagacagaccctgtacacctgcctggacgtgggcctgagactgctgagccccttcatgcccttcgtgaccgaggagctgttccagagactgcccagaagaatgccccaggccccccccagcctgtgcgtgaccccctaccccgagcccagcgagtgcagctggaaggaccccgaggccgaggccgccctggagctggccctgagcatcaccagagccgtgagaagcctgagagccgactacaacctgaccagaatcagacccgactgcttcctggaggtggccgacgaggccaccggcgccctggccagcgccgtgagcggctacgtgcaggccctggccagcgccggcgtggtggccgtgctggccctgggcgcccccgccccccagggctgcgccgtggccctggccagcgacagatgcagcatccacctgcagctgcagggcctggtggaccccgccagagagctgggcaagctgcaggccaagagagtggaggcccagagacaggcccagagactgagagagagaagagccgccagcggctaccccgtgaaggtgcccctggaggtgcaggaggccgacgaggccaagctgcagcagaccgaggccgagctgagaaaggtggacgaggccatcgccctgttccagaagatgctgtag

SEQ ID NO: 104944 - DNA, 2031 bp, Artificial Sequence; identical to SEQ ID NO: 104943
  Description of Artificial Sequence: Synthetic coding sequence

SEQ ID NO: 104945 - DNA, 894 bp, Artificial Sequence; identical to SEQ ID NO: 104938
  Description of Artificial Sequence: Synthetic coding sequence

SEQ ID NO: 104946 - DNA, 894 bp, Artificial Sequence; identical to SEQ ID NO: 104938
  Description of Artificial Sequence: Synthetic coding sequence

SEQ ID NO: 104947 - DNA, 894 bp, Artificial Sequence; identical to SEQ ID NO: 104938
  Description of Artificial Sequence: Synthetic coding sequence

SEQ ID NO: 104948 - DNA, 2031 bp, Artificial Sequence; identical to SEQ ID NO: 104943
  Description of Artificial Sequence: Synthetic coding sequence

SEQ ID NO: 104949 - DNA, 2031 bp, Artificial Sequence; identical to SEQ ID NO: 104943
  Description of Artificial Sequence: Synthetic coding sequence

SEQ ID NO: 104950 - DNA, 894 bp, Artificial Sequence; identical to SEQ ID NO: 104938
  Description of Artificial Sequence: Synthetic coding sequence

SEQ ID NO: 104951 - DNA, 3192 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 104952 - DNA, 774 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagtgttctaccacggctgctggctgctgagcggctgcgactag

SEQ ID NO: 104953 - DNA, 3192 bp, Artificial Sequence; identical to SEQ ID NO: 104951
  Description of Artificial Sequence: Synthetic coding sequence

SEQ ID NO: 104954 - DNA, 348 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctag

SEQ ID NO: 104955 - DNA, 981 bp, Artificial Sequence
  Description of Artificial Sequence: Synthetic coding sequence
atgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggctag

SEQ ID NO: 104956 - DNA, 3282 bp, Artificial Sequence
  Description of Artificial Sequence: Synthetic coding sequence
atgggcggcaaggcctggcccagaagagccgtgggcaccgccggcggcccctgcgccgagcagatcagcgcccccttccagaccctgctgatgccccacctgcccctggccagcttcagaccccccttctggggcctgagacacagcagaggcctgcccagattccacagcgtgagcacccagagcgagccccacggcagccccatcagcagaagaaacagagaggccaagcagaagagactgagagagaagcaggccaccctggaggccgagatcgccggcgagagcaagagccccgccgagagcatcaaggcctggagacccaaggagctggtgctgtacgagatccccaccaagcccggcgagaagaaggacgtgagcggccccctgccccccgcctacagccccagatacgtggaggccgcctggtacccctggtgggtgagagagggcttcttcaagcccgagtaccaggccagactgccccaggccaccggcgagaccttcagcatgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 104957 - DNA, 2772 bp, Artificial Sequence
  Description of Artificial Sequence: Synthetic coding sequence
atgtgcatccccccccccaacgtgaccggcagcctgcacatcggccacgccctgaccgtggccatccaggacgccctggtgagatggcacagaatgagaggcgaccaggtgctgtgggtgcccggcagcgaccacgccggcatcgccacccaggccgtggtggagaagcagctgtggaaggagagaggcgtgagaagacacgagctgagcagagaggccttcctgagagaggtgtggcagtggaaggaggccaagggcggcgagatctgcgagcagctgagagccctgggcgccagcctggactgggacagagagtgcttcaccatggacgtgggcagcagcgtggccgtgaccgaggccttcgtgagactgtacaaggccggcctgctgtacagaaaccaccagctggtgaactggagctgcgccctgagaagcgccatcagcgacatcgaggtggagaacagacccctgcccggccacacccagctgagactgcccggctgccccacccccgtgagcttcggcctgctgttcagcgtggccttccccgtggacggcgagcccgacgccgaggtggtggtgggcaccaccagacccgagaccctgcccggcgacgtggccgtggccgtgcaccccgacgacagcagatacacccacctgcacggcagacagctgagacaccccctgatgggccagcccctgcccctgatcaccgactacgccgtgcagccccacgtgggcaccggcgccgtgaaggtgacccccgcccacagccccgccgacgccgagatgggcgccagacacggcctgagccccctgaacgtgatcgccgaggacggcaccatgaccagcctgtgcggcgactggctgcagggcctgcacagattcgtggccagagagaagatcatgagcgtgctgagcgagtggggcctgttcagaggcctgcagaaccaccccatggtgctgcccatctgcagcagaagcggcgacgtgatcgagtacctgctgaagaaccagtggttcgtgagatgccaggagatgggcgccagagccgccaaggccgtggagagcggcgccctggagctgagccccagcttccaccagaagaactggcagcactggttcagccacatcggcgactggtgcgtgagcagacagctgtggtggggccaccagatccccgcctacctggtggtggaggaccacgcccagggcgaggaggactgctgggtggtgggcagaagcgaggccgaggccagagaggtggccgccgagctgaccggcagacccggcgccgagctgaccctggagagagaccccgacgtgctggacacctggttcagcagcgccctgttccccttcagcgccctgggctggccccaggagacccccgacctggccagattctaccccctgagcctgctggagaccggcagcgacctgctgctgttctgggtgggcagaatggtgatgctgggcacccagctgaccggccagctgcccttcagcaaggtgctgctgcaccccatggtgagagacagacagggcagaaagatgagcaagagcctgggcaacgtgctggaccccagagacatcatcagcggcgtggagatgcaggtgctgcaggagaagctgagaagcggcaacctggaccccgccgagctggccatcgtggccgccgcccagaagaaggacttcccccacggcatccccgagtgcggcaccgacgccctgagattcaccctgtgcagccacggcgtgcaggccggcgacctgcacctgagcgtgagcgaggtgcagagctgcagacacttctgcaacaagatctggaacgccctgagattcatcctgaacgccctgggcgagaagttcgtgccccagcccgccgaggagctgagccccagcagccccatggacgcctggatcctgagcagactggccctggccgcccaggagtgcgagagaggcttcctgaccagagagctgagcctggtgacccacgccctgcaccacttctggctgcacaacctgtgcgacgtgtacctggaggccgtgaagcccgtgctgtggcacagccccagacccctgggccccccccaggtgctgttcagctgcgccgacctgggcctgagactgctggcccccctgatgcccttcctggccgaggagctgtggcagagactgccccccagacccggctgcccccccgcccccagcatcagcgtggccccctaccccagcgcctgcagcctggagcactggagacagcccgagctggagagaagattcagcagagtgcaggaggtggtgcaggtgctgagagccctgagagccacctaccagctgaccaaggccagacccagagtgctgctgcagagcagcgagcccggcgaccagggcctgttcgaggccttcctggagcccctgggcaccctgggctactgcggcgccgtgggcctgctgccccccggcgccgccgcccccagcggctgggcccaggcccccctgagcgacaccgcccaggtgtacatggagctgcagggcctggtggacccccagatccagctgcccctgctggccgccagaagatacaagctgcagaagcagctggacagcctgaccgccagaacccccagcgagggcgaggccggcacccagagacagcagaagctgagcagcctgcagctggagctgagcaagctggacaaggccgccagccacctgagacagctgatggacgagccccccgcccccggcagccccgagctgtag

SEQ ID NO: 104958 - DNA, 885 bp, Artificial Sequence
  Description of Artificial Sequence: Synthetic coding sequence
atggccagcgccagcggcgccatggccaagcacgagcagatcctggtgctggacccccccaccgacctgaagttcaagggccccttcaccgacgtggtgaccaccaacctgaagctgagaaaccccagcgacagaaaggtgtgcttcaaggtgaagaccaccgcccccagaagatactgcgtgagacccaacagcggcatcatcgaccccggcagcaccgtgaccgtgagcgtgatgctgcagcccttcgactacgaccccaacgagaagagcaagcacaagttcatggtgcagaccatcttcgccccccccaacaccagcgacatggaggccgtgtggaaggaggccaagcccgacgagctgatggacagcaagctgagatgcgtgttcgagatgcccaacgagaacgacaagctgggcatcaccccccccggcaacgcccccaccgtgaccagcatgagcagcatcaacaacaccgtggccacccccgccagctaccacaccaaggacgaccccagaggcctgagcgtgctgaagcaggagaagcagaagaacgacatggagcccagcaaggccgtgcccctgaacgccagcaagcaggacggccccatgcccaagccccacagcgtgagcctgaacgacaccgagaccagaaagctgatggaggagtgcaagagactgcagggcgagatgatgaagctgagcgaggagaacagacacctgagagacgagggcctgagactgagaaaggtggcccacagcgacaagcccggcagcaccagcaccgccagcttcagagacaacgtgaccagccccctgcccagcctgctggtggtgatcgccgccatcttcatcggcttcttcctgggcaagttcatcctgtag

SEQ ID NO: 104959 - DNA, 750 bp, Artificial Sequence
  Description of Artificial Sequence: Synthetic coding sequence
atggccagcgccagcggcgccatggccaagcacgagcagatcctggtgctggacccccccaccgacctgaagttcaagggccccttcaccgacgtggtgaccaccaacctgaagctgagaaaccccagcgacagaaaggtgtgcttcaaggtgaagaccaccgcccccagaagatactgcgtgagacccaacagcggcatcatcgaccccggcagcaccgtgaccgtgagcgtgatgctgcagcccttcgactacgaccccaacgagaagagcaagcacaagttcatggtgcagaccatcttcgccccccccaacaccagcgacatggaggccgtgtggaaggaggccaagcccgacgagctgatggacagcaagctgagatgcgtgttcgagatgcccaacgagaacgacaagctgaacgacatggagcccagcaaggccgtgcccctgaacgccagcaagcaggacggccccatgcccaagccccacagcgtgagcctgaacgacaccgagaccagaaagctgatggaggagtgcaagagactgcagggcgagatgatgaagctgagcgaggagaacagacacctgagagacgagggcctgagactgagaaaggtggcccacagcgacaagcccggcagcaccagcaccgccagcttcagagacaacgtgaccagccccctgcccagcctgctggtggtgatcgccgccatcttcatcggcttcttcctgggcaagttcatcctgtag

SEQ ID NO: 104960 - DNA, 300 bp, Artificial Sequence
  Description of Artificial Sequence: Synthetic coding sequence
atggccaaggtggagcaggtgctgagcctggagccccagcacgagctgaagttcagaggccccttcaccgacgtggtgaccaccaacctgaagctgggcaaccccaccgacagaaacgtgtgcttcaaggtgaagaccaccgcccccagaagatactgcgtgagacccaacagcggcatcatcgacgccggcgccagcatcaacgtgagcggcagaagatggaccgccgacgaggaggacagcgccgagcagcagccccacttcagcatcagccccaactgggagggcagaagaccctag

SEQ ID NO: 104961 - DNA, 732 bp, Artificial Sequence
  Description of Artificial Sequence: Synthetic coding sequence
atggccaaggtggagcaggtgctgagcctggagccccagcacgagctgaagttcagaggccccttcaccgacgtggtgaccaccaacctgaagctgggcaaccccaccgacagaaacgtgtgcttcaaggtgaagaccaccgcccccagaagatactgcgtgagacccaacagcggcatcatcgacgccggcgccagcatcaacgtgagcgtgatgctgcagcccttcgactacgaccccaacgagaagagcaagcacaagttcatggtgcagagcatgttcgcccccaccgacaccagcgacatggaggccgtgtggaaggaggccaagcccgaggacctgatggacagcaagctgagatgcgtgttcgagctgcccgccgagaacgacaagccccacgacgtggagatcaacaagatcatcagcaccaccgccagcaagaccgagacccccatcgtgagcaagagcctgagcagcagcctggacgacaccgaggtgaagaaggtgatggaggagtgcaagagactgcagggcgaggtgcagagactgagagaggagaacaagcagttcaaggaggaggacggcctgagaatgagaaagaccgtgcagagcaacagccccatcagcgccctggcccccaccggcaaggaggagggcctgagcaccagactgctggccctggtggtgctgttcttcatcgtgggcgtgatcatcggcaagatcgccctgtag

SEQ ID NO: 104962 - DNA, 1575 bp, Artificial Sequence
  Description of Artificial Sequence: Synthetic coding sequence
atggacaccgagagcacctacagcggctacagctactacagcagccacagcaagaagagccacagacagggcgagagaaccagagagagacacaagagccccagaaacaaggacggcagaggcagcgagaagagcgtgaccatccagccccccaccggcgagcccctgctgggcaacgacagcaccagaaccgaggaggtgcaggacgacaactggggcgagaccaccaccgccatcaccggcaccagcgagcacagcatcagccaggaggacatcgccagaatcagcaaggacatggaggacagcgtgggcctggactgcaagagatacctgggcctgaccgtggccagcttcctgggcctgctggtgttcctgacccccatcgccttcatcctgctgccccccatcctgtggagagacgagctggagccctgcggcaccatctgcgagggcctgttcatcagcatggccttcaagctgctgatcctgctgatcggcacctgggccctgttcttcagaaagagaagagccgacatgcccagagtgttcgtgttcagagccctgctgctggtgctgatcttcctgttcgtggtgagctactggctgttctacggcgtgagaatcctggacagcagagacagaaactaccagggcatcgtgcagtacgccgtgagcctggtggacgccctgctgttcatccactacctggccatcgtgctgctggagctgagacagctgcagcccatgttcaccctgcaggtggtgagaagcaccgacggcgagagcagattctacagcctgggccacctgagcatccagagagccgccctggtggtgctggagaactactacaaggacttcaccatctacaaccccaacctgctgaccgccagcaagttcagagccgccaagcacatggccggcctgaaggtgtacaacgtggacggccccagcaacaacgccaccggccagagcagagccatgatcgccgccgccgccagaagaagagacagcagccacaacgagctgtactacgaggaggccgagcacgagagaagagtgaagaagagaaaggccagactggtggtggccgtggaggaggccttcatccacatccagagactgcaggccgaggagcagcagaaggcccccggcgaggtgatggaccccagagaggccgcccaggccatcttccccagcatggccagagccctgcagaagtacctgagaatcaccagacagcagaactaccacagcatggagagcatcctgcagcacctggccttctgcatcaccaacggcatgacccccaaggccttcctggagagatacctgagcgccggccccaccctgcagtacgacaaggacagatggctgagcacccagtggagactggtgagcgacgaggccgtgaccaacggcctgagagacggcatcgtgttcgtgctgaagtgcctggacttcagcctggtggtgaacgtgaagaagatccccttcatcatcctgagcgaggagttcatcgaccccaagagccacaagttcgtgctgagactgcagagcgagaccagcgtgtag

SEQ ID NO: 104963 - DNA, 1575 bp, Artificial Sequence; identical to SEQ ID NO: 104962
  Description of Artificial Sequence: Synthetic coding sequence

SEQ ID NO: 104964 - DNA, 1575 bp, Artificial Sequence; identical to SEQ ID NO: 104962
  Description of Artificial Sequence: Synthetic coding sequence

SEQ ID NO: 104965 - DNA, 1569 bp, Artificial Sequence
  Description of Artificial Sequence: Synthetic coding sequence
atggacaccgagagcacctacagcggctacagctactacagcagccacagcaagaagagccacagacagggcgagagaaccagagagagacacaagagccccagaaacaaggacggcagaggcagcgagaagagcgtgaccatccagccccccaccggcgagcccctgctgggcaacgacagcaccagaaccgaggaggacgacaactggggcgagaccaccaccgccatcaccggcaccagcgagcacagcatcagccaggaggacatcgccagaatcagcaaggacatggaggacagcgtgggcctggactgcaagagatacctgggcctgaccgtggccagcttcctgggcctgctggtgttcctgacccccatcgccttcatcctgctgccccccatcctgtggagagacgagctggagccctgcggcaccatctgcgagggcctgttcatcagcatggccttcaagctgctgatcctgctgatcggcacctgggccctgttcttcagaaagagaagagccgacatgcccagagtgttcgtgttcagagccctgctgctggtgctgatcttcctgttcgtggtgagctactggctgttctacggcgtgagaatcctggacagcagagacagaaactaccagggcatcgtgcagtacgccgtgagcctggtggacgccctgctgttcatccactacctggccatcgtgctgctggagctgagacagctgcagcccatgttcaccctgcaggtggtgagaagcaccgacggcgagagcagattctacagcctgggccacctgagcatccagagagccgccctggtggtgctggagaactactacaaggacttcaccatctacaaccccaacctgctgaccgccagcaagttcagagccgccaagcacatggccggcctgaaggtgtacaacgtggacggccccagcaacaacgccaccggccagagcagagccatgatcgccgccgccgccagaagaagagacagcagccacaacgagctgtactacgaggaggccgagcacgagagaagagtgaagaagagaaaggccagactggtggtggccgtggaggaggccttcatccacatccagagactgcaggccgaggagcagcagaaggcccccggcgaggtgatggaccccagagaggccgcccaggccatcttccccagcatggccagagccctgcagaagtacctgagaatcaccagacagcagaactaccacagcatggagagcatcctgcagcacctggccttctgcatcaccaacggcatgacccccaaggccttcctggagagatacctgagcgccggccccaccctgcagtacgacaaggacagatggctgagcacccagtggagactggtgagcgacgaggccgtgaccaacggcctgagagacggcatcgtgttcgtgctgaagtgcctggacttcagcctggtggtgaacgtgaagaagatccccttcatcatcctgagcgaggagttcatcgaccccaagagccacaagttcgtgctgagactgcagagcgagaccagcgtgtag

SEQ ID NO: 104966 - DNA, 1566 bp, Artificial Sequence
  Description of Artificial Sequence: Synthetic coding sequence
atggacaccgagagccagtacagcggctacagctacaagagcggccacagcagaagcagcagaaagcacagagacagaagagacagacacagaagcaagagcagagacggcggcagaggcgacaagagcgtgaccatccaggcccccggcgagcccctgctggacaacgagagcaccagaggcgacgagagagacgacaactggggcgagaccaccaccgtggtgaccggcaccagcgagcacagcatcagccacgacgacctgaccagaatcgccaaggacatggaggacagcgtgcccctggactgcagcagacacctgggcgtggccgccggcgccaccctggccctgctgagcttcctgacccccctggccttcctgctgctgccccccctgctgtggagagaggagctggagccctgcggcaccgcctgcgagggcctgttcatcagcgtggccttcaagctgctgatcctgctgctgggcagctgggccctgttcttcagaagacccaaggccagcctgcccagagtgttcgtgctgagagccctgctgatggtgctggtgttcctgctggtggtgagctactggctgttctacggcgtgagaatcctggacgccagagagagaagctaccagggcgtggtgcagttcgccgtgagcctggtggacgccctgctgttcgtgcactacctggccgtggtgctgctggagctgagacagctgcagccccagttcaccctgaaggtggtgagaagcaccgacggcgccagcagattctacaacgtgggccacctgagcatccagagagtggccgtgtggatcctggagaagtactaccacgacttccccgtgtacaaccccgccctgctgaacctgcccaagagcgtgctggccaagaaggtgagcggcttcaaggtgtacagcctgggcgaggagaacagcaccaacaacagcaccggccagagcagagccgtgatcgccgccgccgccagaagaagagacaacagccacaacgagtactactacgaggaggccgagcacgagagaagagtgagaaagagaagagccagactggtggtggccgtggaggaggccttcacccacatcaagagactgcaggaggaggagcagaagaaccccagagaggtgatggaccccagagaggccgcccaggccatcttcgccagcatggccagagccatgcagaagtacctgagaaccaccaagcagcagccctaccacaccatggagagcatcctgcagcacctggagttctgcatcacccacgacatgacccccaaggccttcctggagagatacctggccgccggccccaccatccagtaccacaaggagagatggctggccaagcagtggaccctggtgagcgaggagcccgtgaccaacggcctgaaggacggcatcgtgttcctgctgaagagacaggacttcagcctggtggtgagcaccaagaaggtgcccttcttcaagctgagcgaggagttcgtggaccccaagagccacaagttcgtgatgagactgcagagcgagaccagcgtgtag

SEQ ID NO: 104967 - DNA, 1542 bp, Artificial Sequence
  Description of Artificial Sequence: Synthetic coding sequence
atgaccacccagctgcccgcctacgtggccatcctgctgttctacgtgagcagagccagctgccaggacaccttcaccgccgccgtgtacgagcacgccgccatcctgcccaacgccaccctgacccccgtgagcagagaggaggccctggccctgatgaacagaaacctggacatcctggagggcgccatcaccagcgccgccgaccagggcgcccacatcatcgtgacccccgaggacgccatctacggctggaacttcaacagagacagcctgtacccctacctggaggacatccccgaccccgaggtgaactggatcccctgcaacaacagaaacagattcggccagacccccgtgcaggagagactgagctgcctggccaagaacaacagcatctacgtggtggccaacatcggcgacaagaagccctgcgacaccagcgacccccagtgcccccccgacggcagataccagtacaacaccgacgtggtgttcgacagccagggcaagctggtggccagataccacaagcagaacctgttcatgggcgagaaccagttcaacgtgcccaaggagcccgagatcgtgaccttcaacaccaccttcggcagcttcggcatcttcacctgcttcgacatcctgttccacgaccccgccgtgaccctggtgaaggacttccacgtggacaccatcgtgttccccaccgcctggatgaacgtgctgccccacctgagcgccgtggagttccacagcgcctgggccatgggcatgagagtgaacttcctggccagcaacatccactaccccagcaagaagatgaccggcagcggcatctacgcccccaacagcagcagagccttccactacgacatgaagaccgaggagggcaagctgctgctgagccagctggacagccaccccagccacagcgccgtggtgaactggaccagctacgccagcagcatcgaggccctgagcagcggcaacaaggagttcaagggcaccgtgttcttcgacgagttcaccttcgtgaagctgaccggcgtggccggcaactacaccgtgtgccagaaggacctgtgctgccacctgagctacaagatgagcgagaacatccccaacgaggtgtacgccctgggcgccttcgacggcctgcacaccgtggagggcagatactacctgcagatctgcaccctgctgaagtgcaagaccaccaacctgaacacctgcggcgacagcgccgagaccgccagcaccagattcgagatgttcagcctgagcggcaccttcggcacccagtacgtgttccccgaggtgctgctgagcgagaaccagctggcccccggcgagttccaggtgagcaccgacggcagactgttcagcctgaagcccaccagcggccccgtgctgaccgtgaccctgttcggcagactgtacgagaaggactgggccagcaacgccagcagcggcctgaccgcccaggccagaatcatcatgctgatcgtgatcgcccccatcgtgtgcagcctgagctggtag

SEQ ID NO: 104968 - DNA, 1563 bp, Artificial Sequence
  Description of Artificial Sequence: Synthetic coding sequence
atggtgaccagcagcttccccatcagcgtggccgtgttcgccctgatcaccctgcaggtgggcacccaggacagcttcatcgccgccgtgtacgagcacgccgtgatcctgcccaacaagaccgagacccccgtgagccaggaggacgccctgaacctgatgaacgagaacatcgacatcctggagaccgccatcaagcaggccgccgagcagggcgccagaatcatcgtgacccccgaggacgccctgtacggctggaagttcaccagagagaccgtgttcccctacctggaggacatccccgacccccaggtgaactggatcccctgccaggacccccacagattcggccacacccccgtgcaggccagactgagctgcctggccaaggacaacagcatctacgtgctggccaacctgggcgacaagaagccctgcaacagcagagacagcacctgcccccccaacggctacttccagtacaacaccaacgtggtgtacaacaccgagggcaagctggtggccagataccacaagtaccacctgtacagcgagccccagttcaacgtgcccgagaagcccgagctggtgaccttcaacaccgccttcggcagattcggcatcttcacctgcttcgacatcttcttctacgaccccggcgtgaccctggtgaaggacttccacgtggacaccatcctgttccccaccgcctggatgaacgtgctgcccctgctgaccgccatcgagttccacagcgcctgggccatgggcatgggcgtgaacctgctggtggccaacacccaccacgtgagcctgaacatgaccggcagcggcatctacgcccccaacggccccaaggtgtaccactacgacatgaagaccgagctgggcaagctgctgctgagcgaggtggacagccaccccctgagcagcctggcctaccccaccgccgtgaactggaacgcctacgccaccaccatcaagcccttccccgtgcagaagaacaccttcagaggcttcatcagcagagacggcttcaacttcaccgagctgttcgagaacgccggcaacctgaccgtgtgccagaaggagctgtgctgccacctgagctacagaatgctgcagaaggaggagaacgaggtgtacgtgctgggcgccttcaccggcctgcacggcagaagaagaagagagtactggcaggtgtgcaccctgctgaagtgcaagaccaccaacctgaccacctgcggcagacccgtggagaccgccagcaccagattcgagatgttcagcctgagcggcaccttcggcaccgagtacgtgttccccgaggtgctgctgaccgagatccacctgagccccggcaagttcgaggtgctgaaggacggcagactggtgaacaagaacggcagcagcggccccatcctgaccgtgagcctgttcggcagatggtacaccaaggacagcctgtacagcagctgcggcaccagcaacagcgccatcacctacctgctgatcttcatcctgctgatgatcatcgccctgcagaacatcgtgatgctgtag

SEQ ID NO: 104969 - DNA, 501 bp, Artificial Sequence
  Description of Artificial Sequence: Synthetic coding sequence
atggtgaccagcagcttccccatcagcgtggccgtgttcgccctgatcaccctgcaggtgggcacccaggacagcttcatcgccgccgtgtacgagcacgccgtgatcctgcccaacaagaccgagacccccgtgagccaggaggacgccctgaacctgatgaacgagaacatcgacatcctggagaccgccatcaagcaggccgccgagcagggcgccagaatcatcgtgacccccgaggacgccctgtacggctggaagttcaccagagagaccgtgttcccctacctggaggacatccccgacccccaggtgaactggatcccctgccaggacccccacagattcggccacacccccgtgcaggccagactgagctgcctggccaaggacaacagcatctacgtgctggccaacctgggcgacaagaagccctgcaacagcagagacagcacctgcccccccaacggctacttccagtacaacaccaacgtggtgtag

SEQ ID NO: 104970 - DNA, 1404 bp, Artificial Sequence
  Description of Artificial Sequence: Synthetic coding sequence
atgaacgagaacatcgacatcctggagaccgccatcaagcaggccgccgagcagggcgccagaatcatcgtgacccccgaggacgccctgtacggctggaagttcaccagagagaccgtgttcccctacctggaggacatccccgacccccaggtgaactggatcccctgccaggacccccacagattcggccacacccccgtgcaggccagactgagctgcctggccaaggacaacagcatctacgtgctggccaacctgggcgacaagaagccctgcaacagcagagacagcacctgcccccccaacggctacttccagtacaacaccaacgtggtgtacaacaccgagggcaagctggtggccagataccacaagtaccacctgtacagcgagccccagttcaacgtgcccgagaagcccgagctggtgaccttcaacaccgccttcggcagattcggcatcttcacctgcttcgacatcttcttctacgaccccggcgtgaccctggtgaaggacttccacgtggacaccatcctgttccccaccgcctggatgaacgtgctgcccctgctgaccgccatcgagttccacagcgcctgggccatgggcatgggcgtgaacctgctggtggccaacacccaccacgtgagcctgaacatgaccggcagcggcatctacgcccccaacggccccaaggtgtaccactacgacatgaagaccgagctgggcaagctgctgctgagcgaggtggacagccaccccctgagcagcctggcctaccccaccgccgtgaactggaacgcctacgccaccaccatcaagcccttccccgtgcagaagaacaccttcagaggcttcatcagcagagacggcttcaacttcaccgagctgttcgagaacgccggcaacctgaccgtgtgccagaaggagctgtgctgccacctgagctacagaatgctgcagaaggaggagaacgaggtgtacgtgctgggcgccttcaccggcctgcacggcagaagaagaagagagtactggcaggtgtgcaccctgctgaagtgcaagaccaccaacctgaccacctgcggcagacccgtggagaccgccagcaccagattcgagatgttcagcctgagcggcaccttcggcaccgagtacgtgttccccgaggtgctgctgaccgagatccacctgagccccggcaagttcgaggtgctgaaggacggcagactggtgaacaagaacggcagcagcggccccatcctgaccgtgagcctgttcggcagatggtacaccaaggacagcctgtacagcagctgcggcaccagcaacagcgccatcacctacctgctgatcttcatcctgctgatgatcatcgccctgcagaacatcgtgatgctgtag

SEQ ID NO: 104971 - DNA, 309 bp, Artificial Sequence
  Description of Artificial Sequence: Synthetic coding sequence
atgaacgagaacatcgacatcctggagaccgccatcaagcaggccgccgagcagggcgccagaatcatcgtgacccccgaggacgccctgtacggctggaagttcaccagagagaccgtgttcccctacctggaggacatccccgacccccaggtgaactggatcccctgccaggacccccacagattcggccacacccccgtgcaggccagactgagctgcctggccaaggacaacagcatctacgtgctggccaacctgggcgacaagaagccctgcaacagcagagacagcacctgccccccctag

SEQ ID NO: 104972 - DNA, 306 bp, Artificial Sequence
  Description of Artificial Sequence: Synthetic coding sequence
atggtgaccagcagcttccccatcagcgtggccgtgttcgccctgatcaccctgcaggtgggcacccaggacagcttcatcgccgccgtgtacgagcacgccgtgatcctgcccaacaagaccgagacccccgtgagccaggaggacgccctgaacctgatgaacgagaacatcgacatcctggagaccgccatcaagcaggccgccgagcagggcgccagaatcatcgtgacccccgaggacgccctgtacggctggaagttcaccagagagaccgtgttcccctacctggaggacatcccctag

SEQ ID NO: 104973 - DNA, 2931 bp, Artificial Sequence
  Description of Artificial Sequence: Synthetic coding sequence
atggaggagagaaagcacgagaccatgaaccccgcccacgtgctgttcgacagattcgtgcaggccaccacctgcaagggcaccctgaaggccttccaggagctgtgcgaccacctggagctgaagcccaaggactacagaagcttctaccacaagctgaagagcaagctgaactactggaaggccaaggccctgtgggccaagctggacaagagaggcagccacaaggactacaagaagggcaaggcctgcaccaacaccaagtgcctgatcatcggcgccggcccctgcggcctgagaaccgccatcgacctgagcctgctgggcgccaaggtggtggtgatcgagaagagagacgccttcagcagaaacaacgtgctgcacctgtggcccttcaccatccacgacctgagaggcctgggcgccaagaagttctacggcaagttctgcgccggcgccatcgaccacatcagcatcagacagctgcagctgatcctgctgaaggtggccctgatcctgggcatcgagatccacgtgaacgtggagttccagggcctgatccagccccccgaggaccaggagaacgagagaatcggctggagagccctggtgcaccccaagacccaccccgtgagcgagtacgagttcgaggtgatcatcggcggcgacggcagaagaaacaccctggagggcttcagaagaaaggagttcagaggcaagctggccatcgccatcaccgccaacttcatcaacagaaacaccaccgccgaggccaaggtggaggagatcagcggcgtggccttcatcttcaaccagaagttcttccaggagctgagagaggccaccggcatcgacctggagaacatcgtgtactacaaggacgacacccactacttcgtgatgaccgccaagaagcagagcctgctggacaagggcgtgatcctgcacgactacgccgacaccgagctgctgctgagcagagagaacgtggaccaggaggccctgctgagctacgccagagaggccgccgacttcagcacccagcagcagctgcccagcctggacttcgccatcaaccactacggccagcccgacgtggccatgttcgacttcacctgcatgtacgccagcgagaacgccgccctggtgagagagcagaacggccaccagctgctggtggccctggtgggcgacagcctgctggagcccttctggcccatgggcaccggcatcgccagaggcttcctggccgccatggacagcgcctggatggtgagaagctggagcctgggcaccagccccctggaggtgctggccgagagagagagcatctacagactgctgccccagaccacccccgagaacgtgagcaagaacttcagccagtacagcatcgaccccgtgaccagataccccaacatcaacgtgaacttcctgagacccagccaggtgagacacctgtacgacaccggcgagaccaaggacatccacctggagatggagagcctggtgaacagcagaaccacccccaagctgaccagaaacgagagcgtggccagaagcagcaagctgctgggctggtgccagagacagaccgacggctacgccggcgtgaacgtgaccgacctgaccatgagctggaagagcggcctggccctgtgcgccatcatccacagatacagacccgacctgatcgacttcgacagcctggacgagcagaacgtggagaagaacaaccagctggccttcgacatcgccgagaaggagctgggcatcagccccatcatgaccggcaaggagatggccagcgtgggcgagcccgacaagctgagcatggtgatgtacctgacccagttctacgagatgttcaaggacagcctgcccagcagcgacaccctggacctgaacgccgaggagaaggccgtgctgatcgccagcaccagaagccccatcagcttcctgagcaagctgggccagaccatcagcagaaagagaagccccaaggacaagaaggagaaggacctggacggcgccggcaagagaagaaagaccagccagagcgaggaggaggaggcccccagaggccacagaggcgagagacccaccctggtgagcaccctgaccgacagaagaatggacgtggccgtgggcaaccagaacaaggtgaagtacatggccacccagctgctggccaagttcgaggagaacgcccccgcccagagcatcggcatcagaagacagctgacccaggagagaggcgccagccagcccagctgctgcctgcccggccaggtgagacccgcccccacccccagatggaagcagggcagcatgaagaaggagttcccccagaacctgggcggcagcgacacctgctacttctgccagaagagagtgtacgtgatggagagactgagcgccgagggcaagttcttccacagaagctgcttcaagtgcgagtactgcgccaccaccctgagactgagcgcctacgcctacgacatcgaggacggcaagttctactgcaagccccactactgctacagactgagcggctacgcccagagaaagagacccgccgtggcccccctgagcggcaaggaggccaagggccccctgcaggacggcgccaccaccgacgccaacggcagagccaacgccgtggccagcagcaccgagagaacccccggcagcggcgtgaacggcctggaggagcccagcatcgccaagagactgagaggcacccccgagagaatcgagctggagaactacagactgagcctgagacaggccgaggccctgcaggaggtgcccgaggagacccaggccgagcacaacctgagcagcgtgctggacaccggcgccgaggaggacgtggccagcagaagcgccagaagagccgccggcagaccccccgccaccagaccctag

SEQ ID NO: 104974 - DNA, 825 bp, Artificial Sequence
  Description of Artificial Sequence: Synthetic coding sequence
atgatcatcagccacttccccaagtgcgtggccgtgttcgccctgctggccctgagcgtgggcgccctggacaccttcatcgccgccgtgtacgagcacgccgtgatcctgcccaacagaaccgagacccccgtgagcaaggaggaggccctgctgctgatgaacaagaacatcgacgtgctggagaaggccgtgaagctggccgccaagcagggcgcccacatcatcgtgacccccgaggacggcatctacggctggatcttcaccagagagagcatctacccctacctggaggacatccccgaccccggcgtgaactggatcccctgcagagacccctggagattcggcaacacccccgtgcagcagagactgagctgcctggccaaggacaacagcatctacgtggtggccaacatcggcgacaagaagccctgcaacgccagcgacagccagtgcccccccgacggcagataccagtacaacaccgacgtggtgttcgacagccagggcaagctgctggccagataccacaagtacaacctgttcgcccccgagatccagttcgacttccccaaggacagcgagctggtgaccttcgacacccccttcggcaagttcggcatcttcacctgcttcgacatcttcagccacgaccccgccgtggtggtggtggacgagttccagctgaccgccttcagcaccccccagcacggcaccaccagatgccccagcagcagactgttccccagcatccagcacggccccagaccctgggagagcatctacctgctgcagatccccaccacccccgcctgcacctag

SEQ ID NO: 104975 - DNA, 444 bp, Artificial Sequence
  Description of Artificial Sequence: Synthetic coding sequence
atgatcatcagccacttccccaagtgcgtggccgtgttcgccctgctggccctgagcgtgggcgccctggacaccttcatcgccgccgtgtacgagcacgccgtgatcctgcccaacagaaccgagacccccgtgagcaaggaggaggccctgctgctgatgaacaagaacatcgacgtgctggagaaggccgtgaagctggccgccaagcagggcgcccacatcatcgtgacccccgaggacggcatctacggctggatcttcaccagagagagcatctacccctacctggaggacatccccgaccccggcgtgaactggatcccctgcagagacccctggagaaagagcaagaagatgaacgagcccgtgagcaaggagctgtgctaccactgccacagcgagtgcaaccagtacggccagtggaagctgtacagaacctag

SEQ ID NO: 104976 - DNA, 624 bp, Artificial Sequence
  Description of Artificial Sequence: Synthetic coding sequence
atgatcatcagccacttccccaagtgcgtggccgtgttcgccctgctggccctgagcgtgggcgccctggacaccttcatcgccgccgtgtacgagcacgccgtgatcctgcccaacagaaccgagacccccgtgagcaaggaggaggccctgctgctgatgaacaagaacatcgacgtgctggagaaggccgtgaagctggccgccaagcagggcgcccacatcatcgtgacccccgaggacggcatctacggctggatcttcaccagagagagcatctacccctacctggaggacatccccgaccccggcgtgaactggatcccctgcagagacccctggagattcggcaacacccccgtgcagcagagactgagctgcctggccaaggacaacagcatctacgtggtggccaacatcggcgacaagaagccctgcaacgccagcgacagccagtgcccccccgacggcagataccagtacaacaccgacgtggtgttcgacagccagggcaagctgctggccagataccacaagggcgtggagagcaccccccagaagcagagcagatgcaccaccatgacctggaagcagagagtggtgagctgctgctaccagaactag

SEQ ID NO: 104977 - DNA, 561 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcgcccccgccgcccccggccccagcgaccagcccagccaggagctgccccagcacgagctgccccccgaggagcccgtgagcgagggcacccagcacgaccccctgagccaggaggccgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagccccccagccaggagagcgagatggaggagctgcccagcgtgtag

SEQ ID NO: 104978 - DNA, 621 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcgcccccgccgcccccggccccagcgaccagcccagccaggagctgccccagcacgagctgccccccgaggagcccgtgagcgagggcacccagcacgaccccctgagccaggaggccgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagccccccagccaggagagcgagatggaggagctgcccagcgtgtag

SEQ ID NO: 104979 - DNA, 420 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcgcccccgccgcccccggccccagcgaccagcccagccaggagctgccccagcacgagctgccccccgaggagcccgtgagcgagggcacccagcacgaccccctgagccaggagagcgaggtggaggagcccctgagccaggagagcgaggtggaggagcccctgaccgtgtggatggccagcttcagccccgtgagcgagagcaccgactag

SEQ ID NO: 104980 - DNA, 561 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagctgcccagcgtgtag

SEQ ID NO: 104981 - DNA, 501 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagctgcccagcgtgtag

SEQ ID NO: 104982 - DNA, 378 bp, Artificial Sequence
  Description of Artificial Sequence: Synthetic coding sequence
atgagccccaagcccagagccagcggcccccccgccaaggccaccgaggccggcaagagaaagagcagcagccagcccagccccagcgaccccaagaagaagaccaccaaggtggccaagaagggcaaggccgtgagaagaggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagccaggagagacccgccacccccctgagcccctag

SEQ ID NO: 104983 - DNA, 378 bp, Artificial Sequence
  Description of Artificial Sequence: Synthetic coding sequence
atgagccccaagcccagagccagcggcccccccgccaaggccaaggagaccggcaagagaaagagcagcagccagcccagccccagcggccccaagaagaagaccaccaaggtggccgagaagggcgaggccgtgagaggcggcagaagaggcaagaagggcgccgccaccaagatggccgccgtgaccgcccccgaggccgagagcggccccgccgcccccggccccagcgaccagcccagccaggagctgccccagcacgagctgccccccgaggagcccgtgagcgagggcacccagcacgaccccctgagccaggagagcgagctggaggagcccctgagcaagggcagacccagcacccccctgagcccctag

SEQ ID NO: 104984 - DNA, 2220 bp, Artificial Sequence
  Description of Artificial Sequence: Synthetic coding sequence
atgcccggcaagatggtggtgatcctgggcgccagcaacatcctgtggatcatgttcgccgccagccaggccttcaagatcgagaccacccccgagagcagatacctggcccagatcggcgacagcgtgagcctgacctgcagcaccaccggctgcgagagccccttcttcagctggagaacccagatcgacagccccctgaacggcaaggtgaccaacgagggcaccaccagcaccctgaccatgaaccccgtgagcttcggcaacgagcacagctacctgtgcaccgccacctgcgagagcagaaagctggagaagggcatccaggtggagatctacagcttccccaaggaccccgagatccacctgagcggccccctggaggccggcaagcccatcaccgtgaagtgcagcgtggccgacgtgtaccccttcgacagactggagatcgacctgctgaagggcgaccacctgatgaagagccaggagttcctggaggacgccgacagaaagagcctggagaccaagagcctggaggtgaccttcacccccgtgatcgaggacatcggcaaggtgctggtgtgcagagccaagctgcacatcgacgagatggacagcgtgcccaccgtgagacaggccgtgaaggagctgcaggtgtacatcagccccaagaacaccgtgatcagcgtgaaccccagcaccaagctgcaggagggcggcagcgtgaccatgacctgcagcagcgagggcctgcccgcccccgagatcttctggagcaagaagctggacaacggcaacctgcagcacctgagcggcaacgccaccctgaccctgatcgccatgagaatggaggacagcggcatctacgtgtgcgagggcgtgaacctgatcggcaagaacagaaaggaggtggagctgatcgtgcaggagaagcccttcaccgtggagatcagccccggccccagaatcgccgcccagatcggcgacagcgtgatgctgacctgcagcgtgatgggctgcgagagccccagcttcagctggagaacccagatcgacagccccctgagcggcaaggtgagaagcgagggcaccaacagcaccctgaccctgagccccgtgagcttcgagaacgagcacagctacctgtgcaccgtgacctgcggccacaagaagctggagaagggcatccaggtggagctgtacagcttccccagagaccccgagatcgagatgagcggcggcctggtgaacggcagcagcgtgaccgtgagctgcaaggtgcccagcgtgtaccccctggacagactggagatcgagctgctgaagggcgagaccatcctggagaacatcgagttcctggaggacaccgacatgaagagcctggagaacaagagcctggagatgaccttcatccccaccatcgaggacaccggcaaggccctggtgtgccaggccaagctgcacatcgacgacatggagttcgagcccaagcagagacagagcacccagaccctgtacgtgaacgtggcccccagagacaccaccgtgctggtgagccccagcagcatcctggaggagggcagcagcgtgaacatgacctgcctgagccagggcttccccgcccccaagatcctgtggagcagacagctgcccaacggcgagctgcagcccctgagcgagaacgccaccctgaccctgatcagcaccaagatggaggacagcggcgtgtacctgtgcgagggcatcaaccaggccggcagaagcagaaaggaggtggagctgatcatccaggtgacccccaaggacatcaagctgaccgccttccccagcgagagcgtgaaggagggcgacaccgtgatcatcagctgcacctgcggcaacgtgcccgagacctggatcatcctgaagaagaaggccgagaccggcgacaccgtgctgaagagcatcgacggcgcctacaccatcagaaaggcccagctgaaggacgccggcgtgtacgagtgcgagagcaagaacaaggtgggcagccagctgagaagcctgaccctggacgtgcagggcagagagaacaacaaggactacttcagccccgagctgctggtgctgtacttcgccagcagcctgatcatccccgccatcggcatgatcatctacttcgccagaaaggccaacatgaagggcagctacagcctggtggaggcccagaagagcaaggtgtag

SEQ ID NO: 104985 - DNA, 1944 bp, Artificial Sequence
  Description of Artificial Sequence: Synthetic coding sequence
atgcccggcaagatggtggtgatcctgggcgccagcaacatcctgtggatcatgttcgccgccagccaggccttcaagatcgagaccacccccgagagcagatacctggcccagatcggcgacagcgtgagcctgacctgcagcaccaccggctgcgagagccccttcttcagctggagaacccagatcgacagccccctgaacggcaaggtgaccaacgagggcaccaccagcaccctgaccatgaaccccgtgagcttcggcaacgagcacagctacctgtgcaccgccacctgcgagagcagaaagctggagaagggcatccaggtggagatctacagcttccccaaggaccccgagatccacctgagcggccccctggaggccggcaagcccatcaccgtgaagtgcagcgtggccgacgtgtaccccttcgacagactggagatcgacctgctgaagggcgaccacctgatgaagagccaggagttcctggaggacgccgacagaaagagcctggagaccaagagcctggaggtgaccttcacccccgtgatcgaggacatcggcaaggtgctggtgtgcagagccaagctgcacatcgacgagatggacagcgtgcccaccgtgagacaggccgtgaaggagctgcaggtgtacatcagccccaagaacaccgtgatcagcgtgaaccccagcaccaagctgcaggagggcggcagcgtgaccatgacctgcagcagcgagggcctgcccgcccccgagatcttctggagcaagaagctggacaacggcaacctgcagcacctgagcggcaacgccaccctgaccctgatcgccatgagaatggaggacagcggcatctacgtgtgcgagggcgtgaacctgatcggcaagaacagaaaggaggtggagctgatcgtgcaggccttccccagagaccccgagatcgagatgagcggcggcctggtgaacggcagcagcgtgaccgtgagctgcaaggtgcccagcgtgtaccccctggacagactggagatcgagctgctgaagggcgagaccatcctggagaacatcgagttcctggaggacaccgacatgaagagcctggagaacaagagcctggagatgaccttcatccccaccatcgaggacaccggcaaggccctggtgtgccaggccaagctgcacatcgacgacatggagttcgagcccaagcagagacagagcacccagaccctgtacgtgaacgtggcccccagagacaccaccgtgctggtgagccccagcagcatcctggaggagggcagcagcgtgaacatgacctgcctgagccagggcttccccgcccccaagatcctgtggagcagacagctgcccaacggcgagctgcagcccctgagcgagaacgccaccctgaccctgatcagcaccaagatggaggacagcggcgtgtacctgtgcgagggcatcaaccaggccggcagaagcagaaaggaggtggagctgatcatccaggtgacccccaaggacatcaagctgaccgccttccccagcgagagcgtgaaggagggcgacaccgtgatcatcagctgcacctgcggcaacgtgcccgagacctggatcatcctgaagaagaaggccgagaccggcgacaccgtgctgaagagcatcgacggcgcctacaccatcagaaaggcccagctgaaggacgccggcgtgtacgagtgcgagagcaagaacaaggtgggcagccagctgagaagcctgaccctggacgtgcagggcagagagaacaacaaggactacttcagccccgagctgctggtgctgtacttcgccagcagcctgatcatccccgccatcggcatgatcatctacttcgccagaaaggccaacatgaagggcagctacagcctggtggaggcccagaagagcaaggtgtag

SEQ ID NO: 104986 - DNA, 1623 bp, Artificial Sequence
  Description of Artificial Sequence: Synthetic coding sequence
atgcccggcaagatggtggtgatcctgggcgccagcaacatcctgtggatcatgttcgccgccagccaggccttcaagatcgagaccacccccgagagcagatacctggcccagatcggcgacagcgtgagcctgacctgcagcaccaccggctgcgagagccccttcttcagctggagaacccagatcgacagccccctgaacggcaaggtgaccaacgagggcaccaccagcaccctgaccatgaaccccgtgagcttcggcaacgagcacagctacctgtgcaccgccacctgcgagagcagaaagctggagaagggcatccaggtggagatctacagcttccccaaggaccccgagatccacctgagcggccccctggaggccggcaagcccatcaccgtgaagtgcagcgtggccgacgtgtaccccttcgacagactggagatcgacctgctgaagggcgaccacctgatgaagagccaggagttcctggaggacgccgacagaaagagcctggagaccaagagcctggaggtgaccttcacccccgtgatcgaggacatcggcaaggtgctggtgtgcagagccaagctgcacatcgacgagatggacagcgtgcccaccgtgagacaggccgtgaaggagctgcaggtgtacatcagccccaagaacaccgtgatcagcgtgaaccccagcaccaagctgcaggagggcggcagcgtgaccatgacctgcagcagcgagggcctgcccgcccccgagatcttctggagcaagaagctggacaacggcaacctgcagcacctgagcggcaacgccaccctgaccctgatcgccatgagaatggaggacagcggcatctacgtgtgcgagggcgtgaacctgatcggcaagaacagaaaggaggtggagctgatcgtgcaggtggcccccagagacaccaccgtgctggtgagccccagcagcatcctggaggagggcagcagcgtgaacatgacctgcctgagccagggcttccccgcccccaagatcctgtggagcagacagctgcccaacggcgagctgcagcccctgagcgagaacgccaccctgaccctgatcagcaccaagatggaggacagcggcgtgtacctgtgcgagggcatcaaccaggccggcagaagcagaaaggaggtggagctgatcatccaggtgacccccaaggacatcaagctgaccgccttccccagcgagagcgtgaaggagggcgacaccgtgatcatcagctgcacctgcggcaacgtgcccgagacctggatcatcctgaagaagaaggccgagaccggcgacaccgtgctgaagagcatcgacggcgcctacaccatcagaaaggcccagctgaaggacgccggcgtgtacgagtgcgagagcaagaacaaggtgggcagccagctgagaagcctgaccctggacgtgcagggcagagagaacaacaaggactacttcagccccgagctgctggtgctgtacttcgccagcagcctgatcatccccgccatcggcatgatcatctacttcgccagaaaggccaacatgaagggcagctacagcctggtggaggcccagaagagcaaggtgtag

SEQ ID NO: 104987 - DNA, 2034 bp, Artificial Sequence
  Description of Artificial Sequence: Synthetic coding sequence
atgcccggcaagatggtggtgatcctgggcgccagcaacatcctgtggatcatgttcgccgccagccaggccttcaagatcgagaccacccccgagagcagatacctggcccagatcggcgacagcgtgagcctgacctgcagcaccaccggcagcttccccaaggaccccgagatccacctgagcggccccctggaggccggcaagcccatcaccgtgaagtgcagcgtggccgacgtgtaccccttcgacagactggagatcgacctgctgaagggcgaccacctgatgaagagccaggagttcctggaggacgccgacagaaagagcctggagaccaagagcctggaggtgaccttcacccccgtgatcgaggacatcggcaaggtgctggtgtgcagagccaagctgcacatcgacgagatggacagcgtgcccaccgtgagacaggccgtgaaggagctgcaggtgtacatcagccccaagaacaccgtgatcagcgtgaaccccagcaccaagctgcaggagggcggcagcgtgaccatgacctgcagcagcgagggcctgcccgcccccgagatcttctggagcaagaagctggacaacggcaacctgcagcacctgagcggcaacgccaccctgaccctgatcgccatgagaatggaggacagcggcatctacgtgtgcgagggcgtgaacctgatcggcaagaacagaaaggaggtggagctgatcgtgcaggagaagcccttcaccgtggagatcagccccggccccagaatcgccgcccagatcggcgacagcgtgatgctgacctgcagcgtgatgggctgcgagagccccagcttcagctggagaacccagatcgacagccccctgagcggcaaggtgagaagcgagggcaccaacagcaccctgaccctgagccccgtgagcttcgagaacgagcacagctacctgtgcaccgtgacctgcggccacaagaagctggagaagggcatccaggtggagctgtacagcttccccagagaccccgagatcgagatgagcggcggcctggtgaacggcagcagcgtgaccgtgagctgcaaggtgcccagcgtgtaccccctggacagactggagatcgagctgctgaagggcgagaccatcctggagaacatcgagttcctggaggacaccgacatgaagagcctggagaacaagagcctggagatgaccttcatccccaccatcgaggacaccggcaaggccctggtgtgccaggccaagctgcacatcgacgacatggagttcgagcccaagcagagacagagcacccagaccctgtacgtgaacgtggcccccagagacaccaccgtgctggtgagccccagcagcatcctggaggagggcagcagcgtgaacatgacctgcctgagccagggcttccccgcccccaagatcctgtggagcagacagctgcccaacggcgagctgcagcccctgagcgagaacgccaccctgaccctgatcagcaccaagatggaggacagcggcgtgtacctgtgcgagggcatcaaccaggccggcagaagcagaaaggaggtggagctgatcatccaggtgacccccaaggacatcaagctgaccgccttccccagcgagagcgtgaaggagggcgacaccgtgatcatcagctgcacctgcggcaacgtgcccgagacctggatcatcctgaagaagaaggccgagaccggcgacaccgtgctgaagagcatcgacggcgcctacaccatcagaaaggcccagctgaaggacgccggcgtgtacgagtgcgagagcaagaacaaggtgggcagccagctgagaagcctgaccctggacgtgcagggcagagagaacaacaaggactacttcagccccgagctgctggtgctgtacttcgccagcagcctgatcatccccgccatcggcatgatcatctacttcgccagaaaggccaacatgaagggcagctacagcctggtggaggcccagaagagcaaggtgtag

SEQ ID NO: 104988 - DNA, 1566 bp, Artificial Sequence
  Description of Artificial Sequence: Synthetic coding sequence
atggaggccaactggaccgccttcctgttccaggcccacgaggccagccaccaccagcagcaggccgcccagaacagcctgctgcccctgctgagcagcgccgtggagccccccgaccagaagcccctgctgcccatccccatcacccagaagccccagggcgcccccgagaccctgaaggacgccatcggcatcaagaaggagaagcccaagaccagcttcgtgtgcacctactgcagcaaggccttcagagacagctaccacctgagaagacacgagagctgccacaccggcatcaagctggtgagcagacccaagaagacccccaccaccgtggtgcccctgatcagcaccatcgccggcgacagcagcagaaccagcctggtgagcaccatcgccggcatcctgagcaccgtgaccaccagcagcagcggcaccaaccccagcagcagcgccagcaccaccgccatgcccgtgacccagagcgtgaagaagcccagcaagcccgtgaagaagaaccacgcctgcgagatgtgcggcaaggccttcagagacgtgtaccacctgaacagacacaagctgagccacagcgacgagaagcccttcgagtgccccatctgcaaccagagattcaagagaaaggacagaatgacctaccacgtgagaagccacgagggcggcatcaccaagccctacacctgcagcgtgtgcggcaagggcttcagcagacccgaccacctgagctgccacgtgaagcacgtgcacagcaccgagagacccttcaagtgccagacctgcaccgccgccttcgccaccaaggacagactgagaacccacatggtgagacacgagggcaaggtgagctgcaacatctgcggcaagctgctgagcgccgcctacatcaccagccacctgaagacccacggccagagccagagcatcaactgcaacacctgcaagcagggcatcagcaagacctgcatgagcgaggagaccagcaaccagaagcagcagcagcagcagcagcagcagcagcagcagcagcagcagcagcagcagcagcacgtgaccagctggcccggcaagcaggtggagaccctgagactgtgggaggaggccgtgaaggccagaaagaaggaggccgccaacctgtgccagaccagcaccgccgccaccacccccgtgaccctgaccacccccttcagcatcaccagcagcgtgagcagcggcaccatgagcaaccccgtgaccgtggccgccgccatgagcatgagaagccccgtgaacgtgagcagcgccgtgaacatcaccagccccatgaacatcggccaccccgtgaccatcaccagccccctgagcatgaccagccccctgaccctgaccacccccgtgaacctgcccacccccgtgaccgcccccgtgaacatcgcccaccccgtgaccatcaccagccccatgaacctgcccacccccatgaccctggccgcccccctgaacatcgccatgagacccgtggagagcatgcccttcctgccccaggccctgcccaccagccccccctggtag

SEQ ID NO: 104989 - DNA, 1566 bp, Artificial Sequence; identical to SEQ ID NO: 104988
  Description of Artificial Sequence: Synthetic coding sequence

SEQ ID NO: 104990 - DNA, 1374 bp, Artificial Sequence
  Description of Artificial Sequence: Synthetic coding sequence
atgagaccccccagccccctgcccgccagatggctgtgcgtgctggccggcgccctggcctgggccctgggccccgccggcggccaggccgccagactgcaggaggagtgcgactacgtgcagatgatcgaggtgcagcacaagcagtgcctggaggaggcccagctggagaacgagaccatcggctgcagcaagatgtgggacaacctgacctgctggcccgccacccccagaggccaggtggtggtgctggcctgccccctgatcttcaagctgttcagcagcatccagggcagaaacgtgagcagaagctgcaccgacgagggctggacccacctggagcccggcccctaccccatcgcctgcggcctggacgacaaggccgccagcctggacgagcagcagaccatgttctacggcagcgtgaagaccggctacaccatcggctacggcctgagcctggccaccctgctggtggccaccgccatcctgagcctgttcagaaagctgcactgcaccagaaactacatccacatgcacctgttcatcagcttcatcctgagagccgccgccgtgttcatcaaggacctggccctgttcgacagcggcgagagcgaccagtgcagcgagggcagcgtgggctgcaaggccgccatggtgttcttccagtactgcgtgatggccaacttcttctggctgctggtggagggcctgtacctgtacaccctgctggccgtgagcttcttcagcgagagaaagtacttctggggctacatcctgatcggctggggcgtgcccagcaccttcaccatggtgtggaccatcgccagaatccacttcgaggactacggctgctgggacaccatcaacagcagcctgtggtggatcatcaagggccccatcctgaccagcatcctggtgaacttcatcctgttcatctgcatcatcagaatcctgctgcagaagctgagaccccccgacatcagaaagagcgacagcagcccctacagcagactggccagaagcaccctgctgctgatccccctgttcggcgtgcactacatcatgttcgccttcttccccgacaacttcaagcccgaggtgaagatggtgttcgagctggtggtgggcagcttccagggcttcgtggtggccatcctgtactgcttcctgaacggcgaggtgcaggccgagctgagaagaaagtggagaagatggcacctgcagggcgtgctgggctggaaccccaagtacagacaccccagcggcggcagcaacggcgccacctgcagcacccaggtgagcatgctgaccagagtgagccccggcgccagaagaagcagcagcttccaggccgaggtgagcctggtgtag

SEQ ID NO: 104991 - DNA, 1251 bp, Artificial Sequence
  Description of Artificial Sequence: Synthetic coding sequence
atgatcgaggtgcagcacaagcagtgcctggaggaggcccagctggagaacgagaccatcggctgcagcaagatgtgggacaacctgacctgctggcccgccacccccagaggccaggtggtggtgctggcctgccccctgatcttcaagctgttcagcagcatccagggcagaaacgtgagcagaagctgcaccgacgagggctggacccacctggagcccggcccctaccccatcgcctgcggcctggacgacaaggccgccagcctggacgagcagcagaccatgttctacggcagcgtgaagaccggctacaccatcggctacggcctgagcctggccaccctgctggtggccaccgccatcctgagcctgttcagaaagctgcactgcaccagaaactacatccacatgcacctgttcatcagcttcatcctgagagccgccgccgtgttcatcaaggacctggccctgttcgacagcggcgagagcgaccagtgcagcgagggcagcgtgggctgcaaggccgccatggtgttcttccagtactgcgtgatggccaacttcttctggctgctggtggagggcctgtacctgtacaccctgctggccgtgagcttcttcagcgagagaaagtacttctggggctacatcctgatcggctggggcgtgcccagcaccttcaccatggtgtggaccatcgccagaatccacttcgaggactacggctgctgggacaccatcaacagcagcctgtggtggatcatcaagggccccatcctgaccagcatcctggtgaacttcatcctgttcatctgcatcatcagaatcctgctgcagaagctgagaccccccgacatcagaaagagcgacagcagcccctacagcagactggccagaagcaccctgctgctgatccccctgttcggcgtgcactacatcatgttcgccttcttccccgacaacttcaagcccgaggtgaagatggtgttcgagctggtggtgggcagcttccagggcttcgtggtggccatcctgtactgcttcctgaacggcgaggtgcaggccgagctgagaagaaagtggagaagatggcacctgcagggcgtgctgggctggaaccccaagtacagacaccccagcggcggcagcaacggcgccacctgcagcacccaggtgagcatgctgaccagagtgagccccggcgccagaagaagcagcagcttccaggccgaggtgagcctggtgtag

SEQ ID NO: 104992 - DNA, 744 bp, Artificial Sequence
  Description of Artificial Sequence: Synthetic coding sequence
atgaccagacagagagtgtggatgagatgggccgtgagacagccctggagcttcagcaacatcgtgagctggctgaccagcagcggctgctggtggagagccagcacctgcaccccctgcctgcccagccccagcagcctgagcggcagcaccagcggcggcgtgcccagcaccttcaccatggtgtggaccatcgccagaatccacttcgaggactacggctgctgggacaccatcaacagcagcctgtggtggatcatcaagggccccatcctgaccagcatcctggtgaacttcatcctgttcatctgcatcatcagaatcctgctgcagaagctgagaccccccgacatcagaaagagcgacagcagcccctacagcagactggccagaagcaccctgctgctgatccccctgttcggcgtgcactacatcatgttcgccttcttccccgacaacttcaagcccgaggtgaagatggtgttcgagctggtggtgggcagcttccagggcttcgtggtggccatcctgtactgcttcctgaacggcgaggtgcaggccgagctgagaagaaagtggagaagatggcacctgcagggcgtgctgggctggaaccccaagtacagacaccccagcggcggcagcaacggcgccacctgcagcacccaggtgagcatgctgaccagagtgagccccggcgccagaagaagcagcagcttccaggccgaggtgagcctggtgtag

SEQ ID NO: 104993 - DNA, 1230 bp, Artificial Sequence
  Description of Artificial Sequence: Synthetic coding sequence
atgagagccggcagaagacccagactgggcccctgggccggcggctgcagcaagatgtgggacaacctgacctgctggcccgccacccccagaggccaggtggtggtgctggcctgccccctgatcttcaagctgttcagcagcatccagggcagaaacgtgagcagaagctgcaccgacgagggctggacccacctggagcccggcccctaccccatcgcctgcggcctggacgacaaggccgccagcctggacgagcagaccatgttctacggcagcgtgaagaccggctacaccatcggctacggcctgagcctggccaccctgctggtggccaccgccatcctgagcctgttcagaaagctgcactgcaccagaaactacatccacatgcacctgttcatcagcttcatcctgagagccgccgccgtgttcatcaaggacctggccctgttcgacagcggcgagagcgaccagtgcagcgagggcagcgtgggctgcaaggccgccatggtgttcttccagtactgcgtgatggccaacttcttctggctgctggtggagggcctgtacctgtacaccctgctggccgtgagcttcttcagcgagagaaagtacttctggggctacatcctgatcggctggggcgtgcccagcaccttcaccatggtgtggaccatcgccagaatccacttcgaggactacggctgctgggacaccatcaacagcagcctgtggtggatcatcaagggccccatcctgaccagcatcctggtgaacttcatcctgttcatctgcatcatcagaatcctgctgcagaagctgagaccccccgacatcagaaagagcgacagcagcccctacagcagactggccagaagcaccctgctgctgatccccctgttcggcgtgcactacatcatgttcgccttcttccccgacaacttcaagcccgaggtgaagatggtgttcgagctggtggtgggcagcttccagggcttcgtggtggccatcctgtactgcttcctgaacggcgaggtgcaggccgagctgagaagaaagtggagaagatggcacctgcagggcgtgctgggctggaaccccaagtacagacaccccagcggcggcagcaacggcgccacctgcagcacccaggtgagcatgctgaccagagtgagccccggcgccagaagaagcagcagcttccaggccgaggtgagcctggtgtag

SEQ ID NO: 104994 - DNA, 1317 bp, Artificial Sequence
  Description of Artificial Sequence: Synthetic coding sequence
atgagaaccctgctgccccccgccctgctgacctgctggctgctggcccccgtgaacagcatccaccccgagtgcagattccacctggagatccaggaggaggagaccaagtgcgccgagctgctgagaagccagaccgagaagcacaaggcctgcagcggcgtgtgggacaacatcacctgctggagacccgccaacgtgggcgagaccgtgaccgtgccctgccccaaggtgttcagcaacttctacagcaaggccggcaacatcagcaagaactgcaccagcgacggctggagcgagaccttccccgacttcgtggacgcctgcggctacagcgaccccgaggacgagagcaagatcaccttctacatcctggtgaaggccatctacaccctgggctacagcgtgagcctgatgagcctggccaccggcagcatcatcctgtgcctgttcagaaagctgcactgcaccagaaactacatccacctgaacctgttcctgagcttcatcctgagagccatcagcgtgctggtgaaggacgacgtgctgtacagcagcagcggcaccctgcactgccccgaccagcccagcagctgggtgggctgcaagctgagcctggtgttcctgcagtactgcatcatggccaacttcttctggctgctggtggagggcctgtacctgcacaccctgctggtggccatgctgccccccagaagatgcttcctggcctacctgctgatcggctggggcctgcccaccgtgtgcatcggcgcctggaccgccgccagactgtacctggaggacaccggctgctgggacaccaacgaccacagcgtgccctggtgggtgatcagaatccccatcctgatcagcatcatcgtgaacttcgtgctgttcatcagcatcatcagaatcctgctgcagaagctgaccagccccgacgtgggcggcaacgaccagagccagtacaagagactggccaagagcaccctgctgctgatccccctgttcggcgtgcactacatggtgttcgccgtgttccccatcagcatcagcagcaagtaccagatcctgttcgagctgtgcctgggcagcttccagggcctggtggtggccgtgctgtactgcttcctgaacagcgaggtgcagtgcgagctgaagagaaagtggagaagcagatgccccacccccagcgccagcagagactacagagtgtgcggcagcagcttcagcagaaacggcagcgagggcgccctgcagttccacagaggcagcagagcccagagcttcctgcagaccgagaccagcgtgatctag

SEQ ID NO: 104995 - DNA, 1269 bp, Artificial Sequence
  Description of Artificial Sequence: Synthetic coding sequence
atgcccctgtgggaggcccccagcgaccaccccgccaacccccccgccaccctgcagggccacaccagcctgcccggctgccaggaggagcccgccagagacccccagagcggcctgccccagatcaccagcgagagcagcagcttcagcgagggcagcctgcccagctggagcagcggccccgccggcgccaagctgaacgccagccacgagggcatcggcagcagcagcgacggcaacggcgacagcaaggccgccaccgagagagtggtgagcgccatggacaccgtgagaagaaagcaccccgagatcaccttctacatcctggtgaaggccatctacaccctgggctacagcgtgagcctgatgagcctggccaccggcagcatcatcctgtgcctgttcagaaagctgcactgcaccagaaactacatccacctgaacctgttcctgagcttcatcctgagagccatcagcgtgctggtgaaggacgacgtgctgtacagcagcagcggcaccctgcactgccccgaccagcccagcagctgggtgggctgcaagctgagcctggtgttcctgcagtactgcatcatggccaacttcttctggctgctggtggagggcctgtacctgcacaccctgctggtggccatgctgccccccagaagatgcttcctggcctacctgctgatcggctggggcctgcccaccgtgtgcatcggcgcctggaccgccgccagactgtacctggaggacaccggctgctgggacaccaacgaccacagcgtgccctggtgggtgatcagaatccccatcctgatcagcatcatcgtgaacttcgtgctgttcatcagcatcatcagaatcctgctgcagaagctgaccagccccgacgtgggcggcaacgaccagagccagtacaagagactggccaagagcaccctgctgctgatccccctgttcggcgtgcactacatggtgttcgccgtgttccccatcagcatcagcagcaagtaccagatcctgttcgagctgtgcctgggcagcttccagggcctggtggtggccgtgctgtactgcttcctgaacagcgaggtgcagtgcgagctgaagagaaagtggagaagcagatgccccacccccagcgccagcagagactacagagtgtgcggcagcagcttcagcagaaacggcagcgagggcgccctgcagttccacagaggcagcagagcccagagcttcctgcagaccgagaccagcgtgatctag

SEQ ID NO: 104996 - DNA, 234 bp, Artificial Sequence
  Description of Artificial Sequence: Synthetic coding sequence
atgagaaccctgctgccccccgccctgctgacctgctggctgctggcccccgtgaacagcatccaccccgagtgcagattccacctggagatccaggaggaggagaccaagtgcgccgagctgctgagaagccagaccgagaagcacaagggccacaccaagggcttcatcctgatccacgccggcggcctgaagagaatcctggacccccacacctaccccctggccccctag

SEQ ID NO: 104997 - DNA, 2022 bp, Artificial Sequence
  Description of Artificial Sequence: Synthetic coding sequence
atgtgcagcagagtgcccctgctgctgcccctgctgctgctgctggccctgggccccggcgtgcagggctgccccagcggctgccagtgcagccagccccagaccgtgttctgcaccgccagacagggcaccaccgtgcccagagacgtgccccccgacaccgtgggcctgtacgtgttcgagaacggcatcaccatgctggacgccggcagcttcgccggcctgcccggcctgcagctgctggacctgagccagaaccagatcgccagcctgcccagcggcgtgttccagcccctggccaacctgagcaacctggacctgaccgccaacagactgcacgagatcaccaacgagaccttcagaggcctgagaagactggagagactgtacctgggcaagaacagaatcagacacatccagcccggcgccttcgacaccctggacagactgctggagctgaagctgcaggacaacgagctgagagccctgccccccctgagactgcccagactgctgctgctggacctgagccacaacagcctgctggccctggagcccggcatcctggacaccgccaacgtggaggccctgagactggccggcctgggcctgcagcagctggacgagggcctgttcagcagactgagaaacctgcacgacctggacgtgagcgacaaccagctggagagagtgccccccgtgatcagaggcctgagaggcctgaccagactgagactggccggcaacaccagaatcgcccagctgagacccgaggacctggccggcctggccgccctgcaggagctggacgtgagcaacctgagcctgcaggccctgcccggcgacctgagcggcctgttccccagactgagactgctggccgccgccagaaaccccttcaactgcgtgtgccccctgagctggttcggcccctgggtgagagagagccacgtgaccctggccagccccgaggagaccagatgccacttcccccccaagaacgccggcagactgctgctggagctggactacgccgacttcggctgccccgccaccaccaccaccgccaccgtgcccaccaccagacccgtggtgagagagcccaccgccctgagcagcagcctggcccccacctggctgagccccaccgagcccgccaccgaggcccccagcccccccagcaccgccccccccaccgtgggccccgtgccccagccccaggactgcccccccagcacctgcctgaacggcggcacctgccacctgggcaccagacaccacctggcctgcctgtgccccgagggcttcaccggcctgtactgcgagagccagatgggccagggcaccagacccagccccacccccgtgacccccagaccccccagaagcctgaccctgggcatcgagcccgtgagccccaccagcctgagagtgggcctgcagagatacctgcagggcagcagcgtgcagctgagaagcctgagactgacctacagaaacctgagcggccccgacaagagactggtgaccctgagactgcccgccagcctggccgagtacaccgtgacccagctgagacccaacgccacctacagcgtgtgcgtgatgcccctgggccccggcagagtgcccgagggcgaggaggcctgcggcgaggcccacaccccccccgccgtgcacagcaaccacgcccccgtgacccaggccagagagggcaacctgcccctgctgatcgcccccgccctggccgccgtgctgctggccgccctggccgccgtgggcgccgcctactgcgtgagaagaggcagagccatggccgccgccgcccaggacaagggccaggtgggccccggcgccggccccctggagctggagggcgtgaaggtgcccctggagcccggccccaaggccaccgagggcggcggcgaggccctgcccagcggcagcgagtgcgaggtgcccctgatgggcttccccggccccggcctgcagagccccctgcacgccaagccctacatctag

SEQ ID NO: 104998 - DNA, 2538 bp, Artificial Sequence
  Description of Artificial Sequence: Synthetic coding sequence
atggagctgtggagacagtgcacccactggctgatccagtgcagagtgctgccccccagccacagagtgacctgggacggcgcccaggtgtgcgagctggcccaggccctgagagacggcgtgctgctgtgccagctgctgaacaacctgctgccccacgccatcaacctgagagaggtgaacctgagaccccagatgagccagttcctgtgcctgaagaacatcagaaccttcctgagcacctgctgcgagaagttcggcctgaagagaagcgagctgttcgaggccttcgacctgttcgacgtgcaggacttcggcaaggtgatctacaccctgagcgccctgagctggacccccatcgcccagaacagaggcatcatgcccttccccaccgaggaggagagcgtgggcgacgaggacatctacagcggcctgagcgaccagatcgacgacaccgtggaggaggacgaggacctgtacgactgcgtggagaacgaggaggccgagggcgacgagatctacgaggacctgatgagaagcgagcccgtgagcatgccccccaagatgaccgagtacgacaagagatgctgctgcctgagagagatccagcagaccgaggagaagtacaccgacaccctgggcagcatccagcagcacttcctgaagcccctgcagagattcctgaagccccaggacatcgagatcatcttcatcaacatcgaggacctgctgagagtgcacacccacttcctgaaggagatgaaggaggccctgggcacccccggcgccgccaacctgtaccaggtgttcatcaagtacaaggagagattcctggtgtacggcagatactgcagccaggtggagagcgccagcaagcacctggacagagtggccgccgccagagaggacgtgcagatgaagctggaggagtgcagccagagagccaacaacggcagattcaccctgagagacctgctgatggtgcccatgcagagagtgctgaagtaccacctgctgctgcaggagctggtgaagcacacccaggaggccatggagaaggagaacctgagactggccctggacgccatgagagacctggcccagtgcgtgaacgaggtgaagagagacaacgagaccctgagacagatcaccaacttccagctgagcatcgagaacctggaccagagcctggcccactacggcagacccaagatcgacggcgagctgaagatcaccagcgtggagagaagaagcaagatggacagatacgccttcctgctggacaaggccctgctgatctgcaagagaagaggcgacagctacgacctgaaggacttcgtgaacctgcacagcttccaggtgagagacgacagcagcggcgacagagacaacaagaagtggagccacatgttcctgctgatcgaggaccagggcgcccagggctacgagctgttcttcaagaccagagagctgaagaagaagtggatggagcagttcgagatggccatcagcaacatctaccccgagaacgccaccgccaacggccacgacttccagatgttcagcttcgaggagaccaccagctgcaaggcctgccagatgctgctgagaggcaccttctaccagggctacagatgccacagatgcagagccagcgcccacaaggagtgcctgggcagagtgcccccctgcggcagacacggccaggacttccccggcaccatgaagaaggacaagctgcacagaagagcccaggacaagaagagaaacgagctgggcctgcccaagatggaggtgttccaggagtactacggcctgccccccccccccggcgccatcggccccttcctgagactgaaccccggcgacatcgtggagctgaccaaggccgaggccgagcagaactggtgggagggcagaaacaccagcaccaacgagatcggctggttcccctgcaacagagtgaagccctacgtgcacggccccccccaggacctgagcgtgcacctgtggtacgccggccccatggagagagccggcgccgagagcatcctggccaacagaagcgacggcaccttcctggtgagacagagagtgaaggacgccgccgagttcgccatcagcatcaagtacaacgtggaggtgaagcacatcaagatcatgaccgccgagggcctgtacagaatcaccgagaagaaggccttcagaggcctgaccgagctggtggagttctaccagcagaacagcctgaaggactgcttcaagagcctggacaccaccctgcagttccccttcaaggagcccgagaagagaaccatcagcagacccgccgtgggcagcaccaagtacttcggcaccgccaaggccagatacgacttctgcgccagagacagaagcgagctgagcctgaaggagggcgacatcatcaagatcctgaacaagaagggccagcagggctggtggagaggcgagatctacggcagagtgggctggttccccgccaactacgtggaggaggactacagcgagtactgctag

SEQ ID NO: 104999 - DNA, 2247 bp, Artificial Sequence
  Description of Artificial Sequence: Synthetic coding sequence
atgagccagttcctgtgcctgaagaacatcagaaccttcctgagcacctgctgcgagaagttcggcctgaagagaagcgagctgttcgaggccttcgacctgttcgacgtgcaggacttcggcaaggtgatctacaccctgagcgccctgagctggacccccatcgcccagaacagaggcatcatgcccttccccaccgaggaggagagcgtgggcgacgaggacatctacagcggcctgagcgaccagatcgacgacaccgtggaggaggacgaggacctgtacgactgcgtggagaacgaggaggccgagggcgacgagatctacgaggacctgatgagaagcgagcccgtgagcatgccccacttcctgaagcccctgcagagattcctgaagccccaggacatcgagatcatcttcatcaacatcgaggacctgctgagagtgcacacccacttcctgaaggagatgaaggaggccctgggcacccccggcgccgccaacctgtaccaggtgttcatcaagtacaaggagagattcctggtgtacggcagatactgcagccaggtggagagcgccagcaagcacctggacagagtggccgccgccagagaggacgtgcagatgaagctggaggagtgcagccagagagccaacaacggcagattcaccctgagagacctgctgatggtgcccatgcagagagtgctgaagtaccacctgctgctgcaggagctggtgaagcacacccaggaggccatggagaaggagaacctgagactggccctggacgccatgagagacctggcccagtgcgtgaacgaggtgaagagagacaacgagaccctgagacagatcaccaacttccagctgagcatcgagaacctggaccagagcctggcccactacggcagacccaagatcgacggcgagctgaagatcaccagcgtggagagaagaagcaagatggacagatacgccttcctgctggacaaggccctgctgatctgcaagagaagaggcgacagctacgacctgaaggacttcgtgaacctgcacagcttccaggtgagagacgacagcagcggcgacagagacaacaagaagtggagccacatgttcctgctgatcgaggaccagggcgcccagggctacgagctgttcttcaagaccagagagctgaagaagaagtggatggagcagttcgagatggccatcagcaacatctaccccgagaacgccaccgccaacggccacgacttccagatgttcagcttcgaggagaccaccagctgcaaggcctgccagatgctgctgagaggcaccttctaccagggctacagatgccacagatgcagagccagcgcccacaaggagtgcctgggcagagtgcccccctgcggcagacacggccaggacttccccggcaccatgaagaaggacaagctgcacagaagagcccaggacaagaagagaaacgagctgggcctgcccaagatggaggtgttccaggagtactacggcctgccccccccccccggcgccatcggccccttcctgagactgaaccccggcgacatcgtggagctgaccaaggccgaggccgagcagaactggtgggagggcagaaacaccagcaccaacgagatcggctggttcccctgcaacagagtgaagccctacgtgcacggccccccccaggacctgagcgtgcacctgtggtacgccggccccatggagagagccggcgccgagagcatcctggccaacagaagcgacggcaccttcctggtgagacagagagtgaaggacgccgccgagttcgccatcagcatcaagtacaacgtggaggtgaagcacatcaagatcatgaccgccgagggcctgtacagaatcaccgagaagaaggccttcagaggcctgaccgagctggtggagttctaccagcagaacagcctgaaggactgcttcaagagcctggacaccaccctgcagttccccttcaaggagcccgagaagagaaccatcagcagacccgccgtgggcagcaccaagtacttcggcaccgccaaggccagatacgacttctgcgccagagacagaagcgagctgagcctgaaggagggcgacatcatcaagatcctgaacaagaagggccagcagggctggtggagaggcgagatctacggcagagtgggctggttccccgccaactacgtggaggaggactacagcgagtactgctag

SEQ ID NO: 105000 - DNA, 2442 bp, Artificial Sequence
  Description of Artificial Sequence: Synthetic coding sequence
atggagctgtggagacagtgcacccactggctgatccagtgcagagtgctgccccccagccacagagtgacctgggacggcgcccaggtgtgcgagctggcccaggccctgagagacggcgtgctgctgtgccagctgctgaacaacctgctgccccacgccatcaacctgagagaggtgaacctgagaccccagatgagccagttcctgtgcctgaagaacatcagaaccttcctgagcacctgctgcgagaagttcggcctgaagagaagcgagctgttcgaggccttcgacctgttcgacgtgcaggacttcggcaaggtgatctacaccctgagcgccctgagctggacccccatcgcccagaacagaggcatcatgcccttccccaccgaggaggagagcgtgggcgacgaggacatctacagcggcctgagcgaccagatcgacgacaccgtggaggaggacgaggacctgtacgactgcgtggagaacgaggaggccgagggcgacgagatctacgaggacctgatgagaagcgagcccgtgagcatgccccacttcctgaagcccctgcagagattcctgaagccccaggacatcgagatcatcttcatcaacatcgaggacctgctgagagtgcacacccacttcctgaaggagatgaaggaggccctgggcacccccggcgccgccaacctgtaccaggtgttcatcaagtacaaggagagattcctggtgtacggcagatactgcagccaggtggagagcgccagcaagcacctggacagagtggccgccgccagagaggacgtgcagatgaagctggaggagtgcagccagagagccaacaacggcagattcaccctgagagacctgctgatggtgcccatgcagagagtgctgaagtaccacctgctgctgcaggagctggtgaagcacacccaggaggccatggagaaggagaacctgagactggccctggacgccatgagagacctggcccagtgcgtgaacgaggtgaagagagacaacgagaccctgagacagatcaccaacttccagctgagcatcgagaacctggaccagagcctggcccactacggcagacccaagatcgacggcgagctgaagatcaccagcgtggagagaagaagcaagatggacagatacgccttcctgctggacaaggccctgctgatctgcaagagaagaggcgacagctacgacctgaaggacttcgtgaacctgcacagcttccaggtgagagacgacagcagcggcgacagagacaacaagaagtggagccacatgttcctgctgatcgaggaccagggcgcccagggctacgagctgttcttcaagaccagagagctgaagaagaagtggatggagcagttcgagatggccatcagcaacatctaccccgagaacgccaccgccaacggccacgacttccagatgttcagcttcgaggagaccaccagctgcaaggcctgccagatgctgctgagaggcaccttctaccagggctacagatgccacagatgcagagccagcgcccacaaggagtgcctgggcagagtgcccccctgcggcagacacggccaggacttccccggcaccatgaagaaggacaagctgcacagaagagcccaggacaagaagagaaacgagctgggcctgcccaagatggaggtgttccaggagtactacggcctgccccccccccccggcgccatcggccccttcctgagactgaaccccggcgacatcgtggagctgaccaaggccgaggccgagcagaactggtgggagggcagaaacaccagcaccaacgagatcggctggttcccctgcaacagagtgaagccctacgtgcacggccccccccaggacctgagcgtgcacctgtggtacgccggccccatggagagagccggcgccgagagcatcctggccaacagaagcgacggcaccttcctggtgagacagagagtgaaggacgccgccgagttcgccatcagcatcaagtacaacgtggaggtgaagcacatcaagatcatgaccgccgagggcctgtacagaatcaccgagaagaaggccttcagaggcctgaccgagctggtggagttctaccagcagaacagcctgaaggactgcttcaagagcctggacaccaccctgcagttccccttcaaggagcccgagaagagaaccatcagcagacccgccgtgggcagcaccaagtacttcggcaccgccaaggccagatacgacttctgcgccagagacagaagcgagctgagcctgaaggagggcgacatcatcaagatcctgaacaagaagggccagcagggctggtggagaggcgagatctacggcagagtgggctggttccccgccaactacgtggaggaggactacagcgagtactgctag

SEQ ID NO: 105001 - DNA, 2538 bp, Artificial Sequence; identical to SEQ ID NO: 104998
  Description of Artificial Sequence: Synthetic coding sequence

SEQ ID NO: 105002 - DNA, 2607 bp, Artificial Sequence
  Description of Artificial Sequence: Synthetic coding sequence
atggagcagtggagacagtgcggcagatggctgatcgactgcaaggtgctgccccccaaccacagagtggtgtggcccagcgccgtggtgttcgacctggcccaggccctgagagacggcgtgctgctgtgccagctgctgcacaacctgagccccggcagcatcgacctgaaggacatcaacttcagaccccagatgagccagttcctgtgcctgaagaacatcagaaccttcctgaaggtgtgccacgacaagttcggcctgagaaacagcgagctgttcgaccccttcgacctgttcgacgtgagagacttcggcaaggtgatcagcgccgtgagcagactgagcctgcacagcatcgcccagaacaagggcatcagacccttccccagcgaggagaccaccgagaacgacgacgacgtgtacagaagcctggaggagctggccgacgagcacgacctgggcgaggacatctacgactgcgtgccctgcgaggacggcggcgacgacatctacgaggacatcatcaaggtggaggtgcagcagcccatgaagatgggcatgaccgaggacgacaagagaaactgctgcctgctggagatccaggagaccgaggccaagtactacagaaccctggaggacatcgagaagaactacatgagccccctgagactggtgctgagccccgccgacatggccgccgtgttcatcaacctggaggacctgatcaaggtgcaccacagcttcctgagagccatcgacgtgagcgtgatggtgggcggcagcaccctggccaaggtgttcctggacttcaaggagagactgctgatctacggcgagtactgcagccacatggagcacgcccagaacaccctgaaccagctgctggccagcagagaggacttcagacagaaggtggaggagtgcaccctgaaggtgcaggacggcaagttcaagctgcaggacctgctggtggtgcccatgcagagagtgctgaagtaccacctgctgctgaaggagctgctgagccacagcgccgagagacccgagagacagcagctgaaggaggccctggaggccatgcaggacctggccatgtacatcaacgaggtgaagagagacaaggagaccctgagaaagatcagcgagttccagagcagcatcgagaacctgcaggtgaagctggaggagttcggcagacccaagatcgacggcgagctgaaggtgagaagcatcgtgaaccacaccaagcaggacagatacctgttcctgttcgacaaggtggtgatcgtgtgcaagagaaagggctacagctacgagctgaaggagatcatcgagctgctgttccacaagatgaccgacgaccccatgaacaacaaggacgtgaagaagtggagctacggcttctacctgatccacctgcagggcaagcagggcttccagttcttctgcaagaccgaggacatgaagagaaagtggatggagcagttcgagatggccatgagcaacatcaagcccgacaaggccaacgccaaccaccacagcttccagatgtacaccttcgacaagaccaccaactgcaaggcctgcaagatgttcctgagaggcaccttctaccagggctacatgtgcaccaagtgcggcgtgggcgcccacaaggagtgcctggaggtgatccccccctgcaagttcagaaccagcggcgacagagacgccagcggcgccggccccggccccaagatggtggccatgcagaactaccacggcaaccccgccccccccggcaagcccgtgctgaccttccagaccggcgacgtgctggagctgctgagaggcgaccccgagagcccctggtgggagggcagactggtgcagaccagaaagagcggctacttccccagcagcagcgtgaagccctgccccgtggacggcagaccccccatcagcagaccccccagcagagagatcgactacaccgcctacccctggttcgccggcaacatggagagacagcagaccgacaacctgctgaagagccacgccagcggcacctacctgatcagagagagacccgccgaggccgagagattcgccatcagcatcaagttcaacgacgaggtgaagcacatcaaggtggtggagaaggacaactggatccacatcaccgaggccaagaagttcgacagcctgctggagctggtggagtactaccagtgccacagcctgaaggagagcttcaagcagctggacaccaccctgaagtacccctacaagagcagagagagaagcgccagcagagccagcagcagaagccccgccagctgcgccagctacaacttcagcttcctgagcccccagggcctgagcttcgccagccagggccccagcgcccccttctggagcgtgttcacccccagagtgatcggcaccgccgtggccagatacaacttcgccgccagagacatgagagagctgagcctgagagagggcgacgtggtgagaatctacagcagaatcggcggcgaccagggctggtggaagggcgagaccaacggcagaatcggctggttccccagcacctacgtggaggaggagggcatccagtag

SEQ ID NO: 105003 - DNA, 2637 bp, Artificial Sequence
  Description of Artificial Sequence: Synthetic coding sequence
atggagcagtggagacagtgcggcagatggctgatcgactgcaaggtgctgccccccaaccacagagtggtgtggcccagcgccgtggtgttcgacctggcccaggccctgagagacggcgtgctgctgtgccagctgctgcacaacctgagccccggcagcatcgacctgaaggacatcaacttcagaccccagatgagccagttcctgtgcctgaagaacatcagaaccttcctgaaggtgtgccacgacaagttcggcctgagaaacagcgagctgttcgaccccttcgacctgttcgacgtgagagacttcggcaaggtgatcagcgccgtgagcagactgagcctgcacagcatcgcccagaacaagggcatcagacccttccccagcgaggagaccaccgagaacgacgacgacgtgtacagaagcctggaggagctggccgacgagcacgacctgggcgaggacatctacgactgcgtgccctgcgaggacggcggcgacgacatctacgaggacatcatcaaggtggaggtgcagcagcccatgatcagatacatgcagaagatgggcatgaccgaggacgacaagagaaactgctgcctgctggagatccaggagaccgaggccaagtactacagaaccctggaggacatcgagaagaactacatgagccccctgagactggtgctgagccccgccgacatggccgccgtgttcatcaacctggaggacctgatcaaggtgcaccacagcttcctgagagccatcgacgtgagcgtgatggtgggcggcagcaccctggccaaggtgttcctggacttcaaggagagactgctgatctacggcgagtactgcagccacatggagcacgcccagaacaccctgaaccagctgctggccagcagagaggacttcagacagaaggtggaggagtgcaccctgaaggtgcaggacggcaagttcaagctgcaggacctgctggtggtgcccatgcagagagtgctgaagtaccacctgctgctgaaggagctgctgagccacagcgccgagagacccgagagacagcagctgaaggaggccctggaggccatgcaggacctggccatgtacatcaacgaggtgaagagagacaaggagaccctgagaaagatcagcgagttccagagcagcatcgagaacctgcaggtgaagctggaggagttcggcagacccaagatcgacggcgagctgaaggtgagaagcatcgtgaaccacaccaagcaggacagatacctgttcctgttcgacaaggtggtgatcgtgtgcaagagaaagggctacagctacgagctgaaggagatcatcgagctgctgttccacaagatgaccgacgaccccatgaacaacaaggacgtgaagaagagccacggcaagatgtggagctacggcttctacctgatccacctgcagggcaagcagggcttccagttcttctgcaagaccgaggacatgaagagaaagtggatggagcagttcgagatggccatgagcaacatcaagcccgacaaggccaacgccaaccaccacagcttccagatgtacaccttcgacaagaccaccaactgcaaggcctgcaagatgttcctgagaggcaccttctaccagggctacatgtgcaccaagtgcggcgtgggcgcccacaaggagtgcctggaggtgatccccccctgcaagttcaccagccccgccgacctggacgccagcggcgccggccccggccccaagatggtggccatgcagaactaccacggcaaccccgccccccccggcaagcccgtgctgaccttccagaccggcgacgtgctggagctgctgagaggcgaccccgagagcccctggtgggagggcagactggtgcagaccagaaagagcggctacttccccagcagcagcgtgaagccctgccccgtggacggcagaccccccatcagcagaccccccagcagagagatcgactacaccgcctacccctggttcgccggcaacatggagagacagcagaccgacaacctgctgaagagccacgccagcggcacctacctgatcagagagagacccgccgaggccgagagattcgccatcagcatcaagttcaacgacgaggtgaagcacatcaaggtggtggagaaggacaactggatccacatcaccgaggccaagaagttcgacagcctgctggagctggtggagtactaccagtgccacagcctgaaggagagcttcaagcagctggacaccaccctgaagtacccctacaagagcagagagagaagcgccagcagagccagcagcagaagccccgccagctgcgccagctacaacttcagcttcctgagcccccagggcctgagcttcgccagccagggccccagcgcccccttctggagcgtgttcacccccagagtgatcggcaccgccgtggccagatacaacttcgccgccagagacatgagagagctgagcctgagagagggcgacgtggtgagaatctacagcagaatcggcggcgaccagggctggtggaagggcgagaccaacggcagaatcggctggttccccagcacctacgtggaggaggagggcatccagtag

SEQ ID NO: 105004 - DNA, 2607 bp, Artificial Sequence
  Description of Artificial Sequence: Synthetic coding sequence
atggagcagtggagacagtgcggcagatggctgatcgactgcaaggtgctgccccccaaccacagagtggtgtggcccagcgccgtggtgttcgacctggcccaggccctgagagacggcgtgctgctgtgccagctgctgcacaacctgagccccggcagcatcgacctgaaggacatcaacttcagaccccagatgagccagttcctgtgcctgaagaacatcagaaccttcctgaaggtgtgccacgacaagttcggcctgagaaacagcgagctgttcgaccccttcgacctgttcgacgtgagagacttcggcaaggtgatcagcgccgtgagcagactgagcctgcacagcatcgcccagaacaagggcatcagacccttccccagcgaggagaccaccgagaacgacgacgacgtgtacagaagcctggaggagctggccgacgagcacgacctgggcgaggacatctacgactgcgtgccctgcgaggacggcggcgacgacatctacgaggacatcatcaaggtggaggtgcagcagcccatgaagatgggcatgaccgaggacgacaagagaaactgctgcctgctggagatccaggagaccgaggccaagtactacagaaccctggaggacatcgagaagaactacatgagccccctgagactggtgctgagccccgccgacatggccgccgtgttcatcaacctggaggacctgatcaaggtgcaccacagcttcctgagagccatcgacgtgagcgtgatggtgggcggcagcaccctggccaaggtgttcctggacttcaaggagagactgctgatctacggcgagtactgcagccacatggagcacgcccagaacaccctgaaccagctgctggccagcagagaggacttcagacagaaggtggaggagtgcaccctgaaggtgcaggacggcaagttcaagctgcaggacctgctggtggtgcccatgcagagagtgctgaagtaccacctgctgctgaaggagctgctgagccacagcgccgagagacccgagagacagcagctgaaggaggccctggaggccatgcaggacctggccatgtacatcaacgaggtgaagagagacaaggagaccctgagaaagatcagcgagttccagagcagcatcgagaacctgcaggtgaagctggaggagttcggcagacccaagatcgacggcgagctgaaggtgagaagcatcgtgaaccacaccaagcaggacagatacctgttcctgttcgacaaggtggtgatcgtgtgcaagagaaagggctacagctacgagctgaaggagatcatcgagctgctgttccacaagatgaccgacgaccccatgaacaacaaggacgtgaagaagtggagctacggcttctacctgatccacctgcagggcaagcagggcttccagttcttctgcaagaccgaggacatgaagagaaagtggatggagcagttcgagatggccatgagcaacatcaagcccgacaaggccaacgccaaccaccacagcttccagatgtacaccttcgacaagaccaccaactgcaaggcctgcaagatgttcctgagaggcaccttctaccagggctacatgtgcaccaagtgcggcgtgggcgcccacaaggagtgcctggaggtgatccccccctgcaagttcaccagccccgccgacctggacgccagcggcgccggccccggccccaagatggtggccatgcagaactaccacggcaaccccgccccccccggcaagcccgtgctgaccttccagaccggcgacgtgctggagctgctgagaggcgaccccgagagcccctggtgggagggcagactggtgcagaccagaaagagcggctacttccccagcagcagcgtgaagccctgccccgtggacggcagaccccccatcagcagaccccccagcagagagatcgactacaccgcctacccctggttcgccggcaacatggagagacagcagaccgacaacctgctgaagagccacgccagcggcacctacctgatcagagagagacccgccgaggccgagagattcgccatcagcatcaagttcaacgacgaggtgaagcacatcaaggtggtggagaaggacaactggatccacatcaccgaggccaagaagttcgacagcctgctggagctggtggagtactaccagtgccacagcctgaaggagagcttcaagcagctggacaccaccctgaagtacccctacaagagcagagagagaagcgccagcagagccagcagcagaagccccgccagctgcgccagctacaacttcagcttcctgagcccccagggcctgagcttcgccagccagggccccagcgcccccttctggagcgtgttcacccccagagtgatcggcaccgccgtggccagatacaacttcgccgccagagacatgagagagctgagcctgagagagggcgacgtggtgagaatctacagcagaatcggcggcgaccagggctggtggaagggcgagaccaacggcagaatcggctggttccccagcacctacgtggaggaggagggcatccagtag

SEQ ID NO: 105005 - DNA, 2520 bp, Artificial Sequence
  Description of Artificial Sequence: Synthetic coding sequence
atggagcagtggagacagtgcggcagatggctgatcgactgcaaggtgctgccccccaaccacagagtggtgtggcccagcgccgtggtgttcgacctggcccaggccctgagagacggcgtgctgctgtgccagctgctgcacaacctgagccccggcagcatcgacctgaaggacatcaacttcagaccccagatgagccagttcctgtgcctgaagaacatcagaaccttcctgaaggtgtgccacgacaagttcggcctgagaaacagcgagctgttcgaccccttcgacctgttcgacgtgagagacttcggcaaggtgatcagcgccgtgagcagactgagcctgcacagcatcgcccagaacaagggcatcagacccttccccagcgaggagaccaccgagaacgacgacgacgtgtacagaagcctggaggagctggccgacgagcacgacctgggcgaggacatctacgactgcgtgccctgcgaggacggcggcgacgacatctacgaggacatcatcaaggtggaggtgcagcagcccatgaagatgggcatgaccgaggacgacaagagaaactgctgcctgctggagatccaggagaccgaggccaagtactacagaaccctggaggacatcgagaagaactacatgagccccctgagactggtgctgagccccgccgacatggccgccgtgttcatcaacctggaggacctgatcaaggtgcaccacagcttcctgagagccatcgacgtgagcgtgatggtgggcggcagcaccctggccaaggtgttcctggacttcaaggagagactgctgatctacggcgagtactgcagccacatggagcacgcccagaacaccctgaaccagctgctggccagcagagaggacttcagacagaaggtggaggagtgcaccctgaaggtgcaggacggcaagttcaagctgcaggacctgctggtggtgcccatgcagagagtgctgaagtaccacctgctgctgaaggagctgctgagccacagcgccgagagacccgagagacagcagctgaaggaggccctggaggccatgcaggacctggccatgtacatcaacgaggtgaagagagacaaggagaccctgagaaagatcagcgagttccagagcagcatcgagaacctgcaggtgaagctggaggagttcggcagacccaagatcgacggcgagctgaaggtgagaagcatcgtgaaccacaccaagcaggacagatacctgttcctgttcgacaaggtggtgatcgtgtgcaagagaaagggctacagctacgagctgaaggagatcatcgagctgctgttccacaagatgaccgacgaccccatgaacaacaaggacgtgaagaagtggagctacggcttctacctgatccacctgcagggcaagcagggcttccagttcttctgcaagaccgaggacatgaagagaaagtggatggagcagttcgagatggccatgagcaacatcaagcccgacaaggccaacgccaaccaccacagcttccagatgtacaccttcgacaagaccaccaactgcaaggcctgcaagatgttcctgagaggcaccttctaccagggctacatgtgcaccaagtgcggcgtgggcgcccacaaggagtgcctggaggtgatccccccctgcaagttcaccagccccgccgacctggacgccagcggcgccggccccggccccaagatggtggccatgcagaactaccacggcaaccccgccccccccggcaagcccgtgctgaccttccagaccggcgacgtgctggagctgctgagaggcgaccccgagagcccctggtgggagggcagactggtgcagaccagaaagagcggctacttccccagcagcagcgtgaagccctgccccgtggacggcagaccccccatcagcagaccccccagcagagagatcgactacaccgcctacccctggttcgccggcaacatggagagacagcagaccgacaacctgctgaagagccacgccagcggcacctacctgatcagagagagacccgccgaggccgagagattcgccatcagcatcaagttcaacgacgaggtgaagcacatcaaggtggtggagaaggacaactggatccacatcaccgaggccaagaagttcgacagcctgctggagctggtggagtactaccagtgccacagcctgaaggagagcttcaagcagctggacaccaccctgaagtacccctacaagagcagagagagaagcgccagcagagccagcagcagaagccccgtgttcacccccagagtgatcggcaccgccgtggccagatacaacttcgccgccagagacatgagagagctgagcctgagagagggcgacgtggtgagaatctacagcagaatcggcggcgaccagggctggtggaagggcgagaccaacggcagaatcggctggttccccagcacctacgtggaggaggagggcatccagtag

SEQ ID NO: 105006 - DNA, 2544 bp, Artificial Sequence
  Description of Artificial Sequence: Synthetic coding sequence
atggagccctggaagcagtgcgcccagtggctgatccactgcaaggtgctgcccaccaaccacagagtgacctgggacagcgcccaggtgttcgacctggcccagaccctgagagacggcgtgctgctgtgccagctgctgaacaacctgagagcccacagcatcaacctgaaggagatcaacctgagaccccagatgagccagttcctgtgcctgaagaacatcagaaccttcctgaccgcctgctgcgagaccttcggcatgagaaagagcgagctgttcgaggccttcgacctgttcgacgtgagagacttcggcaaggtgatcgagaccctgagcagactgagcagaacccccatcgccctggccaccggcatcagacccttccccaccgaggagagcatcaacgacgaggacatctacaagggcctgcccgacctgatcgacgagaccctggtggaggacgaggaggacctgtacgactgcgtgtacggcgaggacgagggcggcgaggtgtacgaggacctgatgaaggccgaggaggcccaccagcccaagtgccccgagaacgacatcagaagctgctgcctggccgagatcaagcagaccgaggagaagtacaccgagaccctggagagcatcgagaagtacttcatggcccccctgaagagattcctgaccgccgccgagttcgacagcgtgttcatcaacatccccgagctggtgaagctgcacagaaacctgatgcaggagatccacgacagcatcgtgaacaagaacgaccagaacctgtaccaggtgttcatcaactacaaggagagactggtgatctacggccagtactgcagcggcgtggagagcgccatcagcagcctggactacatcagcaagaccaaggaggacgtgaagctgaagctggaggagtgcagcaagagagccaacaacggcaagttcaccctgagagacctgctggtggtgcccatgcagagagtgctgaagtaccacctgctgctgcaggagctggtgaagcacaccaccgaccccaccgagaaggccaacctgaagctggccctggacgccatgaaggacctggcccagtacgtgaacgaggtgaagagagacaacgagaccctgagagagatcaagcagttccagctgagcatcgagaacctgaaccagcccgtgctgctgttcggcagaccccagggcgacggcgagatcagaatcaccaccctggacaagcacaccaagcaggagagacacatcttcctgttcgacctggccgtgatcgtgtgcaagagaaagggcgacaactacgagatgaaggagatcatcgacctgcagcagtacaagatcgccaacaaccccaccaccgacaaggagaacaagaagtggagctacggcttctacctgatccacacccagggccagaacggcctggagttctactgcaagaccaaggacctgaagaagaagtggctggagcagttcgagatggccctgagcaacatcagacccgactacgccgacagcaacttccacgacttcaagatgcacaccttcaccagagtgaccagctgcaaggtgtgccagatgctgctgagaggcaccttctaccagggctacctgtgcttcaagtgcggcgccagagcccacaaggagtgcctgggcagagtggacaactgcggcagagtgaacagcggcgagcagggcaccctgaagctgcccgagaagagaaccaacggcctgagaagaacccccaagcaggtggaccccggcctgcccaagatgcaggtgatcagaaactacagcggcacccccccccccgccctgcacgagggcccccccctgcagctgcaggccggcgacaccgtggagctgctgaagggcgacgcccacagcctgttctggcagggcagaaacctggccagcggcgaggtgggcttcttccccagcgacgccgtgaagccctgcccctgcgtgcccaagcccgtggactacagctgccagccctggtacgccggcgccatggagagactgcaggccgagaccgagctgatcaacagagtgaacagcacctacctggtgagacacagaaccaaggagagcggcgagtacgccatcagcatcaagtacaacaacgaggccaagcacatcaagatcctgaccagagacggcttcttccacatcgccgagaacagaaagttcaagagcctgatggagctggtggagtactacaagcaccacagcctgaaggagggcttcagaaccctggacaccaccctgcagttcccctacaaggagcccgagcacagcgccggccagagaggcaacagagccggcaacagcctgctgagccccaaggtgctgggcatcgccatcgccagatacgacttctgcgccagagacatgagagagctgagcctgctgaagggcgacgtggtgaagatctacaccaagatgagcgccaacggctggtggagaggcgaggtgaacggcagagtgggctggttccccagcacctacgtggaggaggacgagtag

SEQ ID NO: 105007 - DNA, 1671 bp, Artificial Sequence
  Description of Artificial Sequence: Synthetic coding sequence
atgagccagttcctgtgcctgaagaacatcagaaccttcctgaccgcctgctgcgagaccttcggcatgagaaagagcgagctgttcgaggccttcgacctgttcgacgtgagagacttcggcaaggtgatcgagaccctgagcagactgagcagaacccccatcgccctggccaccggcatcagacccttccccaccgaggagagcatcaacgacgaggacatctacaagggcctgcccgacctgatcgacgagaccctggtggaggacgaggaggacctgtacgactgcgtgtacggcgaggacgagggcggcgaggtgtacgaggacctgatgaaggccgaggaggcccaccagcccaagtgccccgagaacgacatcagaagctgctgcctggccgagatcaagcagaccgaggagaagtacaccgagaccctggagagcatcgagaagtacttcatggcccccctgaagagattcctgaccgccgccgagttcgacagcgtgttcatcaacatccccgagctggtgaagctgcacagaaacctgatgcaggagatccacgacagcatcgtgaacaagaacgaccagaacctgtaccaggtgttcatcaactacaaggagagactggtgatctacggccagtactgcagcggcgtggagagcgccatcagcagcctggactacatcagcaagaccaaggaggacgtgaagctgaagctggaggagtgcagcaagagagccaacaacggcaagttcaccctgagagacctgctggtggtgcccatgcagagagtgctgaagtaccacctgctgctgcaggagctggtgaagcacaccaccgaccccaccgagaaggccaacctgaagctggccctggacgccatgaaggacctggcccagtacgtgaacgaggtgaagagagacaacgagaccctgagagagatcaagcagttccagctgagcatcgagaacctgaaccagcccgtgctgctgttcggcagaccccagggcgacggcgagatcagaatcaccaccctggacaagcacaccaagcaggagagacacatcttcctgttcgacctggccgtgatcgtgtgcaagagaaagggcgacaactacgagatgaaggagatcatcgacctgcagcagtacaagatcgccaacaaccccaccaccgacaaggagaacaagaagtggagctacggcttctacctgatccacacccagggccagaacggcctggagttctactgcaagaccaaggacctgaagaagaagtggctggagcagttcgagatggccctgagcaacatcagacccgactacgccgacagcaacttccacgacttcaagatgcacaccttcaccagagtgaccagctgcaaggtgtgccagatgctgctgagaggcaccttctaccagggctacctgtgcttcaagtgcggcgccagagcccacaaggagtgcctgggcagagtggacaactgcggcagagtgaacagcggcgagcagggcaccctgaagctgcccgagaagagaaccaacggcctgagaagaacccccaagcaggtggaccccgacgtgccctgcctgctgcacttcttcatcagcatggcccccgccaccagaagcatcgtgaagagccagaagaagaacaagaagttctag

SEQ ID NO: 105008 - DNA, 864 bp, Artificial Sequence
  Description of Artificial Sequence: Synthetic coding sequence
atgcccatcttcaccttcctgagcgagcagggcaccctgaagctgcccgagaagagaaccaacggcctgagaagaacccccaagcaggtggaccccggcctgcccaagatgcaggtgatcagaaactacagcggcacccccccccccgccctgcacgagggcccccccctgcagctgcaggccggcgacaccgtggagctgctgaagggcgacgcccacagcctgttctggcagggcagaaacctggccagcggcgaggtgggcttcttccccagcgacgccgtgaagccctgcccctgcgtgcccaagcccgtggactacagctgccagccctggtacgccggcgccatggagagactgcaggccgagaccgagctgatcaacagagtgaacagcacctacctggtgagacacagaaccaaggagagcggcgagtacgccatcagcatcaagtacaacaacgaggccaagcacatcaagatcctgaccagagacggcttcttccacatcgccgagaacagaaagttcaagagcctgatggagctggtggagtactacaagcaccacagcctgaaggagggcttcagaaccctggacaccaccctgcagttcccctacaaggagcccgagcacagcgccggccagagaggcaacagagccggcaacagcctgctgagccccaaggtgctgggcatcgccatcgccagatacgacttctgcgccagagacatgagagagctgagcctgctgaagggcgacgtggtgaagatctacaccaagatgagcgccaacggctggtggagaggcgaggtgaacggcagagtgggctggttccccagcacctacgtggaggaggacgagtag

SEQ ID NO: 105009 - DNA, 2628 bp, Artificial Sequence
  Description of Artificial Sequence: Synthetic coding sequence
atggagccctggaagcagtgcgcccagtggctgatccactgcaaggtgctgcccaccaaccacagagtgacctgggacagcgcccaggtgttcgacctggcccagaccctgagagacggcgtgctgctgtgccagctgctgaacaacctgagagcccacagcatcaacctgaaggagatcaacctgagaccccagatgagccagttcctgtgcctgaagaacatcagaaccttcctgaccgcctgctgcgagaccttcggcatgagaaagagcgagctgttcgaggccttcgacctgttcgacgtgagagacttcggcaaggtgatcgagaccctgagcagactgagcagaacccccatcgccctggccaccggcatcagacccttccccaccgaggagagcatcaacgacgaggacatctacaagggcctgcccgacctgatcgacgagaccctggtggaggacgaggaggacctgtacgactgcgtgtacggcgaggacgagggcggcgaggtgtacgaggacctgatgaaggccgaggaggcccaccagcccaagtgccccgagaacgacatcagaagctgctgcctggccgagatcaagcagaccgaggagaagtacaccgagaccctggagagcatcgagaagtacttcatggcccccctgaagagattcctgaccgccgccgagttcgacagcgtgttcatcaacatccccgagctggtgaagctgcacagaaacctgatgcaggagatccacgacagcatcgtgaacaagaacgaccagaacctgtaccaggtgttcatcaactacaaggagagactggtgatctacggccagtactgcagcggcgtggagagcgccatcagcagcctggactacatcagcaagaccaaggaggacgtgaagctgaagctggaggagtgcagcaagagagccaacaacggcaagttcaccctgagagacctgctggtggtgcccatgcagagagtgctgaagtaccacctgctgctgcaggagctggtgaagcacaccaccgaccccaccgagaaggccaacctgaagctggccctggacgccatgaaggacctggcccagtacgtgaacgaggtgaagagagacaacgagaccctgagagagatcaagcagttccagctgagcatcgagaacctgaaccagcccgtgctgctgttcggcagaccccagggcgacggcgagatcagaatcaccaccctggacaagcacaccaagcaggagagacacatcttcctgttcgacctggccgtgatcgtgtgcaagagaaagggcgacaactacgagatgaaggagatcatcgacctgcagcagtacaagatcgccaacaaccccaccaccgacaaggagaacaagaagtggagctacggcttctacctgatccacacccagggccagaacggcctggagttctactgcaagaccaaggacctgaagaagaagtggctggagcagttcgagatggccctgagcaacatcagacccgactacgccgacagcaacttccacgacttcaagatgcacaccttcaccagagtgaccagctgcaaggtgtgccagatgctgctgagaggcaccttctaccagggctacctgtgcttcaagtgcggcgccagagcccacaaggagtgcctgggcagagtggacaactgcggcagagtgaacagcggcgagcagggcaccctgaagctgcccgagaagagaaccaacggcctgagaagaacccccaagcaggtggaccccggcctgcccaagatgcaggtgatcagaaactacagcggcacccccccccccgccctgcacgagggcccccccctgcagctgcaggccggcgacaccgtggagctgctgaagggcgacgcccacagcctgttctggcagggcagaaacctggccagcggcgaggtgggcttcttccccagcgacgccgtgaagccctgcccctgcgtgcccaagcccgtggactacagctgccagccctggtacgccggcgccatggagagactgcaggccgagaccgagctgatcaacagagtgaacagcacctacctggtgagacacagaaccaaggagagcggcgagtacgccatcagcatcaagtacaacaacgaggccaagcacatcaagatcctgaccagagacggcttcttccacatcgccgagaacagaaagttcaagagcctgatggagctggtggagtactacaagcaccacagcctgaaggagggcttcagaaccctggacaccaccctgcagttcccctacaaggagcccgagcacagcgccggccagagaggcaacagagccggcaacagcagccccagcctgttctgcggcttcagcttcgtgaccccccccgactacagcttcgtgccccccagcagcacccccttctggagcgtgctgagccccaaggtgctgggcatcgccatcgccagatacgacttctgcgccagagacatgagagagctgagcctgctgaagggcgacgtggtgaagatctacaccaagatgagcgccaacggctggtggagaggcgaggtgaacggcagagtgggctggttccccagcacctacgtggaggaggacgagtag

SEQ ID NO: 105010 - DNA, 756 bp, Artificial Sequence
  Description of Artificial Sequence: Synthetic coding sequence
atgcaggtgatcagaaactacagcggcacccccccccccgccctgcacgagggcccccccctgcagctgcaggccggcgacaccgtggagctgctgaagggcgacgcccacagcctgttctggcagggcagaaacctggccagcggcgaggtgggcttcttccccagcgacgccgtgaagccctgcccctgcgtgcccaagcccgtggactacagctgccagccctggtacgccggcgccatggagagactgcaggccgagaccgagctgatcaacagagtgaacagcacctacctggtgagacacagaaccaaggagagcggcgagtacgccatcagcatcaagtacaacaacgaggccaagcacatcaagatcctgaccagagacggcttcttccacatcgccgagaacagaaagttcaagagcctgatggagctggtggagtactacaagcaccacagcctgaaggagggcttcagaaccctggacaccaccctgcagttcccctacaaggagcccgagcacagcgccggccagagaggcaacagagccggcaacagcctgctgagccccaaggtgctgggcatcgccatcgccagatacgacttctgcgccagagacatgagagagctgagcctgctgaagggcgacgtggtgaagatctacaccaagatgagcgccaacggctggtggagaggcgaggtgaacggcagagtgggctggttccccagcacctacgtggaggaggacgagtag

SEQ ID NO: 105011 - DNA, 912 bp, Artificial Sequence
  Description of Artificial Sequence: Synthetic coding sequence
atgagcagcgccagattcgacagcagcgacagaagcgcctggtacatgggccccgtgagcagacaggaggcccagaccagactgcagggccagagacacggcatgttcctggtgagagacagcagcacctgccccggcgactacgtgctgagcgtgagcgagaacagcagagtgagccactacatcatcaacagcctgcccaacagaagattcaagatcggcgaccaggagttcgaccacctgcccgccctgctggagttctacaagatccactacctggacaccaccaccctgatcgagcccgcccccagataccccagcccccccatgggcagcgtgagcgcccccaacctgcccaccgccgaggacaacctggagtacgtgagaaccctgtacgacttccccggcaacgacgccgaggacctgcccttcaagaagggcgagatcctggtgatcatcgagaagcccgaggagcagtggtggagcgccagaaacaaggacggcagagtgggcatgatccccgtgccctacgtggagaagctggtgagaagcagcccccacggcaagcacggcaacagaaacagcaacagctacggcatccccgagcccgcccacgcctacgcccagccccagaccaccacccccctgcccgccgtgagcggcagccccggcgccgccatcacccccctgcccagcacccagaacggccccgtgttcgccaaggccatccagaagagagtgccctgcgcctacgacaagaccgccctggccctggaggtgggcgacatcgtgaaggtgaccagaatgaacatcaacggccagtgggagggcgaggtgaacggcagaaagggcctgttccccttcacccacgtgaagatcttcgacccccagaaccccgacgagaacgagtag

SEQ ID NO: 105012 - DNA, 912 bp, Artificial Sequence; identical to SEQ ID NO: 105011
  Description of Artificial Sequence: Synthetic coding sequence

SEQ ID NO: 105013 - DNA, 3132 bp, Artificial Sequence
  Description of Artificial Sequence: Synthetic coding sequence
atggagttcgtgagagccctgtggctgggcctggccctggccctgggccccggcagcgccggcggccacccccagccctgcggcgtgctggccagactgggcggcagcgtgagactgggcgccctgctgcccagagcccccctggccagagccagagccagagccgccctggccagagccgccctggcccccagactgccccacaacctgagcctggagctggtggtggccgccccccccgccagagaccccgccagcctgaccagaggcctgtgccaggccctggtgccccccggcgtggccgccctgctggccttccccgaggccagacccgagctgctgcagctgcacttcctggccgccgccaccgagacccccgtgctgagcctgctgagaagagaggccagagcccccctgggcgcccccaaccccttccacctgcagctgcactgggccagccccctggagaccctgctggacgtgctggtggccgtgctgcaggcccacgcctgggaggacgtgggcctggccctgtgcagaacccaggaccccggcggcctggtggccctgtggaccagcagagccggcagacccccccagctggtgctggacctgagcagaagagacaccggcgacgccggcctgagagccagactggcccccatggccgcccccgtgggcggcgaggcccccgtgcccgccgccgtgctgctgggctgcgacatcgccagagccagaagagtgctggaggccgtgccccccggcccccactggctgctgggcacccccctgccccccaaggccctgcccaccgccggcctgccccccggcctgctggccctgggcgaggtggccagaccccccctggaggccgccatccacgacatcgtgcagctggtggccagagccctgggcagcgccgcccaggtgcagcccaagagagccctgctgcccgcccccgtgaactgcggcgacctgcagcccgccggccccgagagccccggcagattcctggccagattcctggccaacaccagcttccagggcagaaccggccccgtgtgggtgaccggcagcagccaggtgcacatgagcagacacttcaaggtgtggagcctgagaagagaccccagaggcgcccccgcctgggccaccgtgggcagctggagagacggccagctggacctggagcccggcggcgccagcgccagacccccccccccccagggcgcccaggtgtggcccaagctgagagtggtgaccctgctggagcaccccttcgtgttcgccagagaccccgacgaggacggccagtgccccgccggccagctgtgcctggaccccggcaccaacgacagcgccaccctggacgccctgttcgccgccctggccaacggcagcgcccccagagccctgagaaagtgctgctacggctactgcatcgacctgctggagagactggccgaggacacccccttcgacttcgagctgtacctggtgggcgacggcaagtacggcgccctgagagacggcagatggaccggcctggtgggcgacctgctggccggcagagcccacatggccgtgaccagcttcagcatcaacagcgccagaagccaggtggtggacttcaccagccccttcttcagcaccagcctgggcatcatggtgagagccagagacaccgccagccccatcggcgccttcatgtggcccctgcactggagcacctggctgggcgtgttcgccgccctgcacctgaccgccctgttcctgaccgtgtacgagtggagaagcccctacggcctgacccccagaggcagaaacagaagcaccgtgttcagctacagcagcgccctgaacctgtgctacgccatcctgttcagaagaaccgtgagcagcaagacccccaagtgccccaccggcagactgctgatgaacctgtgggccatcttctgcctgctggtgctgagcagctacaccgccaacctggccgccgtgatggtgggcgacaagaccttcgaggagctgagcggcatccacgaccccaagctgcaccaccccgcccagggcttcagattcggcaccgtgtgggagagcagcgccgaggcctacatcaagaagagcttccccgacatgcacgcccacatgagaagacacagcgcccccaccacccccagaggcgtggccatgctgaccagcgacccccccaagctgaacgccttcatcatggacaagagcctgctggactacgaggtgagcatcgacgccgactgcaagctgctgaccgtgggcaagcccttcgccatcgagggctacggcatcggcctgccccagaacagccccctgaccagcaacctgagcgagttcatcagcagatacaagagcagcggcttcatcgacctgctgcacgacaagtggtacaagatggtgccctgcggcaagagagtgttcgccgtgaccgagaccctgcagatgagcatctaccacttcgccggcctgttcgtgctgctgtgcctgggcctgggcagcgccctgctgagcagcctgggcgagcacgccttcttcagactggccctgcccagaatcagaaagggcagcagactgcagtactggctgcacaccagccagaagatccacagagccctgaacaccgagccccccgagggcagcaaggaggagaccgccgaggccgagcccagcggccccgaggtggagcagcagcagcagcagcaggaccagcccaccgcccccgagggctggaagagagccagaagagccgtggacaaggagagaagagtgagattcctgctggagcccgccgtggtggtggcccccgaggccgacgccgaggccgaggccgcccccagagagggccccgtgtggctgtgcagctacggcagaccccccgccgccagacccaccggcgccccccagcccggcgagctgcaggagctggagagaagaatcgaggtggccagagagagactgagacaggccctggtgagaagaggccagctgctggcccagctgggcgacagcgccagacacagacccagaagactgctgcaggccagagccgcccccgccgaggcccccccccacagcggcagacccggcagccaggagtag

SEQ ID NO: 105014 - DNA, 2502 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcaccagaatcaccaccgccatcagagagaccgagagcatcgagaagcacgccaaggccctggtgggcctgtgggacagctgcctggagcacaacctgagacccttcggcaaggacgaggacaccccccacgccaagatcgccagcgacatcatgagctgcatcctgcagaactacaacagaccccccgtgatggccctggccatccccatcgccgtgaagttcctgcacagaggcaacaaggagctgtgcagaaacatgagcaactacctgagcctggccgccatcaccaaggccgacctgctggccgaccacaccgaggtgatcgtgaagagcatcctgcagggcaacaccatgctgctgagagtgctgcccgccgtgtacgagaagcagccccagcccatcaacagacacctgaccgagctgctggccctgatgagccagctggagcagcccgagcagtaccacctgctgagactgctgcacgtggccgccaagaagaagcagctggaggtggtgcagaagtgcatccccttcctgatcggccacctgaaggacagcacccacaacgacatcatcctgaacatcctgatcgagatcgccgtgtacgagcccgtggccctgaacagcttcctgcccatgctgaaggagatcggcgagagattcccctacctgaccggccagatggccagaatctacggcgccgtgggccacgtggacgaggagagagccagaagctgcctgacctacctggtgagccagctggccaacatggagcacagcttccaccacatcctgctgctggagatcaagagcatcaccgacaccttcagcagcatcctgggcccccagagcagagacatcttcagaatgagcaacagcttcaccgccatcgccaagctgctgaccagacagctggagaacaccaaggccggcagcggcagaagaaagatcagcaccgagatcgagttccccgagaagctggaggagaccaagctgatcgtgaccgagaacgaggaccacgagaagctgcaggtgaagatccaggccttcgaggacaagatcaacgccggcagcaacacccccggcagcatcagaagatacagcctgggccaggtgagcaaggaggagagaaagaacatcagattcaacagaagcaagagcctggccttccacaccatgctgaccaagggcgtgggcagcgacgacggcgaggacgagaacagaggcgacatccccgccagcatcagcctgagcgagatcgaccccctgggccagggcaacgacaagctgcccttcaagaccgacaccgagagaagccagctgggcgagagcagcgtgagctaccccaacatcatccacatcgacagcgagaacctgagcgagaccgtgaaggagaacagccaggaggagacccccgagaccaccgccagccccatcgagtaccaggacaagctgtacctgcacctgaagaagaacctgagcaaggtgaaggcctacgccatggagatcggcaagaagatccccgtgcccgaccagtgcaccatcgaggacaccgtgagaagctgcgtggccaagctgttcttcacctgcagcctgaagggccactactgcctgtacagcaagagcagcttcatcctgatcagccaggagccccagccctggatccagatcatgttcctgttccagcagagcctgttccccgagcccctgagcatccagagccacagcgtgcagttcctgagagccctgtgggagaagacccaggccggcggcgcccacagcttcgagaccgccatgatggagagcaccttcccccagcagaaggacctggaccaggtgcagctgcacctggaggaggtgagattcttcgacgtgttcggcttcagcgagaccgccggcgcctggcagtgcttcatgtgcaacaaccccgagaaggccaccgtggtgaaccaggacggccagcccctgatcgagggcaagctgaaggagaagcaggtgagatggaagttcatcaagagatggaagaccagatacttcaccctggccggcaaccagctgctgttccagaagggcaagagcaaggacgaccccgacgactgccccatcgagctgagcaaggtgcagagcgtgaaggccgtggccaagaagagaagagacagaagcctgcccagagccttcgagatcttcaccgacaacaagacctacgtgttcaaggccaaggacgagaagaacgccgaggagtggctgcagtgcatcaacgtggccgtggcccaggccaaggagagagagagcagagaggtgaccacctacctgtag

SEQ ID NO: 105015 - DNA, 2502 bp, Artificial Sequence; identical to SEQ ID NO: 105014
  Description of Artificial Sequence: Synthetic coding sequence

SEQ ID NO: 105016 - DNA, 2367 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcaccagaatcaccaccgccatcagagagaccgagagcatcgagaagcacgccaaggccctggtgggcctgtgggacagctgcctggagcacaacctgagacccttcggcaaggacgaggacaccccccacgccaagatcgccagcgacatcatgagctgcatcctgcagaactacaacagaccccccgtgatggccctggccatccccatcgccgtgaagttcctgcacagaggcaacaaggagctgtgcagaaacatgagcaactacctgagcctggccgccatcaccaaggccgacctgctggccgaccacaccgaggtgatcgtgaagagcatcctgcagggcaacaccatgctgctgagagtgctgcccgccgtgtacgagaagcagccccagcccatcaacagacacctgaccgagctgctggccctgatgagccagctggagcagcccgagcagtaccacctgctgagactgctgcacgtggccgccaagaagaagcagctggaggtggtgcagaagtgcatccccttcctgatcggccacctgaaggacagcacccacaacgacatcatcctgaacatcctgatcgagatcgccgtgtacgagcccgtggccctgaacagcttcctgcccatgctgaaggagatcggcgagagattcccctacctgaccggccagatggccagaatctacggcgccgtgggccacgtggacgaggagagagccagaagctgcctgacctacctggtgagccagctggccaacatggagcacagcttccaccacatcctgctgctggagatcaagagcatcaccgacaccttcagcagcatcctgggcccccagagcagagacatcttcagaatgagcaacagcttcaccgccatcgccaagctgctgaccagacagctggagaacaccaaggccggcagcggcagaagaaagatcagcaccgagatcgagttccccgagaagctggaggagaccaagctgatcgtgaccgagaacgaggaccacgagaagctgcaggtgaagatccaggccttcgaggacaagatcaacgccggcagcaacacccccggcagcatcagaagatacagcctgggccaggtgagcaaggaggagagaaagaacatcagattcaacagaagcaagagcctggccttccacaccatgctgaccaagggcgtgggcagcgacgacggcgaggacgagaacagaggcgacatccccgccagcatcagcctgagcgagatcgaccccctgggccagggcaacgacaagctgcccttcaagaccgacaccgagagaagccagctgggcgagagcagcgtgagctaccccaacatcatccacatcgacagcgagaacctgagcgagaccgtgaaggagaacagccaggaggagacccccgagaccaccgccagccccatcgagtaccaggacaagctgtacctgcacctgaagaagaacctgagcaaggtgaaggcctacgccatggagatcggcaagaagatccccgtgcccgaccagtgcaccatcgaggacaccgtgagaagctgcgtggccaagctgttcttcacctgcagcctgaagggccactactgcctgtacagcaagagcagcttcatcctgatcagccaggagccccagccctggatccagatcatgttcctgttccagcaggacctggaccaggtgcagctgcacctggaggaggtgagattcttcgacgtgttcggcttcagcgagaccgccggcgcctggcagtgcttcatgtgcaacaaccccgagaaggccaccgtggtgaaccaggacggccagcccctgatcgagggcaagctgaaggagaagcaggtgagatggaagttcatcaagagatggaagaccagatacttcaccctggccggcaaccagctgctgttccagaagggcaagagcaaggacgaccccgacgactgccccatcgagctgagcaaggtgcagagcgtgaaggccgtggccaagaagagaagagacagaagcctgcccagagccttcgagatcttcaccgacaacaagacctacgtgttcaaggccaaggacgagaagaacgccgaggagtggctgcagtgcatcaacgtggccgtggcccaggccaaggagagagagagcagagaggtgaccacctacctgtag

SEQ ID NO: 105017 - DNA, 192 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcacctag

SEQ ID NO: 105018 - DNA, 642 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcaccagaatcaccaccgccatcagagagaccgagagcatcgagaagcacgccaaggccctggtgggcctgtgggacagctgcctggagcacaacctgagacccttcggcaaggacgaggacaccccccacgccaagatcgccagcgacatcatgagctgcatcctgcagaactacaacagaccccccgtgatggccctggccatccccatcgccgtgaagttcctgcacagaggcaacaaggagctgtgcagaaacatgagcaactacctgagcctggccgccatcaccaaggccgacctgctggccgaccacaccgaggtgatcgtgaagagcatcctgcagggcatggtgagaaagctgagcctgggcacctgcttcggcagatacctgaaggtgttcagcagcagcatctacggcctgtgggaggccagacccagagtgctggaggccaactag

SEQ ID NO: 105019 - DNA, 498 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcaccagaatcaccaccgccatcagagagaccgagagcatcgagaagcacgccaaggccctggtgggcctgtgggacagctgcctggagcacaacctgagacccttcggcaaggacgaggacaccccccacgccaagatcgccagcgacatcatgagctgcatcctgcagaactacaacagaccccccgtgatggccctggccatccccatcgccgtgaagttcctgcacagaggcaacaaggagctgtgcagaaacatgagcaactacctgagcctggccgccatcaccaaggccgacctgctggccgactag

SEQ ID NO: 105020 - DNA, 168 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccagtag

SEQ ID NO: 105021 - DNA, 642 bp, Artificial Sequence; identical to SEQ ID NO: 105018
  Description of Artificial Sequence: Synthetic coding sequence

SEQ ID NO: 105022 - DNA, 534 bp, Artificial Sequence
  Description of Artificial Sequence: Synthetic coding sequence
atgcaccagctgttcagactggtgctgggccagaaggacctgagcagagccggcgacctgttcagcctggacgacagcgagatcgaggacagcctgaccgaggccctggagcagatcaagatcatcagcagcagcagcgactaccagaccaacaacaacgaccaggccgtggtggagatctgcatcaccagaatcaccaccgccatcagagagaccgagagcatcgagaagcacgccaaggccctggtgggcctgtgggacagctgcctggagcacaacctgagacccttcggcaaggacgaggacaccccccacgccaagatcgccagcgacatcatgagctgcatcctgcagaactacaacagaccccccgtgatggccctggccatccccatcgccgtgaagttcctgcacagaggcaacaaggagctgtgcagaaacatgagcaactacctgagcctggccgccatcaccaaggccgacctgctggccgaccacaccgaggtgatcgtgaagagcatcctgcaggtgtag

SEQ ID NO: 105023 - DNA, 2367 bp, Artificial Sequence; identical to SEQ ID NO: 105016
  Description of Artificial Sequence: Synthetic coding sequence

SEQ ID NO: 105024 - DNA, 3768 bp, Artificial Sequence
  Description of Artificial Sequence: Synthetic coding sequence
atggagctggccgccctgtgcagatggggcctgctgctggccctgctgccccccggcgccgccagcacccaggtgtgcaccggcaccgacatgaagctgagactgcccgccagccccgagacccacctggacatgctgagacacctgtaccagggctgccaggtggtgcagggcaacctggagctgacctacctgcccaccaacgccagcctgagcttcctgcaggacatccaggaggtgcagggctacgtgctgatcgcccacaaccaggtgagacaggtgcccctgcagagactgagaatcgtgagaggcacccagctgttcgaggacaactacgccctggccgtgctggacaacggcgaccccctgaacaacaccacccccgtgaccggcgccagccccggcggcctgagagagctgcagctgagaagcctgaccgagatcctgaagggcggcgtgctgatccagagaaacccccagctgtgctaccaggacaccatcctgtggaaggacatcttccacaagaacaaccagctggccctgaccctgatcgacaccaacagaagcagagcctgccacccctgcagccccatgtgcaagggcagcagatgctggggcgagagcagcgaggactgccagagcctgaccagaaccgtgtgcgccggcggctgcgccagatgcaagggccccctgcccaccgactgctgccacgagcagtgcgccgccggctgcaccggccccaagcacagcgactgcctggcctgcctgcacttcaaccacagcggcatctgcgagctgcactgccccgccctggtgacctacaacaccgacaccttcgagagcatgcccaaccccgagggcagatacaccttcggcgccagctgcgtgaccgcctgcccctacaactacctgagcaccgacgtgggcagctgcaccctggtgtgccccctgcacaaccaggaggtgaccgccgaggacggcacccagagatgcgagaagtgcagcaagccctgcgccagagtgtgctacggcctgggcatggagcacctgagagaggtgagagccgtgaccagcgccaacatccaggagttcgccggctgcaagaagatcttcggcagcctggccttcctgcccgagagcttcgacggcgaccccgccagcaacaccgcccccctgcagcccgagcagctgcaggtgttcgagaccctggaggagatcaccggctacctgtacatcagcgcctggcccgacagcctgcccgacctgagcgtgttccagaacctgcaggtgatcagaggcagaatcctgcacaacggcgcctacagcctgaccctgcagggcctgggcatcagctggctgggcctgagaagcctgagagagctgggcagcggcctggccctgatccaccacaacacccacctgtgcttcgtgcacaccgtgccctgggaccagctgttcagaaacccccaccaggccctgctgcacaccgccaacagacccgaggacgagtgcgtgggcgagggcctggcctgccaccagctgtgcgccagaggccactgctggggccccggccccacccagtgcgtgaactgcagccagttcctgagaggccaggagtgcgtggaggagtgcagagtgctgcagggcctgcccagagagtacgtgaacgccagacactgcctgccctgccaccccgagtgccagccccagaacggcagcgtgacctgcttcggccccgaggccgaccagtgcgtggcctgcgcccactacaaggacccccccttctgcgtggccagatgccccagcggcgtgaagcccgacctgagctacatgcccatctggaagttccccgacgaggagggcgcctgccagccctgccccatcaactgcacccacagctgcgtggacctggacgacaagggctgccccgccgagcagagagccagccccctgaccagcatcatcagcgccgtggtgggcatcctgctggtggtggtgctgggcgtggtgttcggcatcctgatcaagagaagacagcagaagatcagaaagtacaccatgagaagactgctgcaggagaccgagctggtggagcccctgacccccagcggcgccatgcccaaccaggcccagatgagaatcctgaaggagaccgagctgagaaaggtgaaggtgctgggcagcggcgccttcggcaccgtgtacaagggcatctggatccccgacggcgagaacgtgaagatccccgtggccatcaaggtgctgagagagaacaccagccccaaggccaacaaggagatcctggacgaggcctacgtgatggccggcgtgggcagcccctacgtgagcagactgctgggcatctgcctgaccagcaccgtgcagctggtgacccagctgatgccctacggctgcctgctggaccacgtgagagagaacagaggcagactgggcagccaggacctgctgaactggtgcatgcagatcgccaagggcatgagctacctggaggacgtgagactggtgcacagagacctggccgccagaaacgtgctggtgaagagccccaaccacgtgaagatcaccgacttcggcctggccagactgctggacatcgacgagaccgagtaccacgccgacggcggcaaggtgcccatcaagtggatggccctggagagcatcctgagaagaagattcacccaccagagcgacgtgtggagctacggcgtgaccgtgtgggagctgatgaccttcggcgccaagccctacgacggcatccccgccagagagatccccgacctgctggagaagggcgagagactgccccagccccccatctgcaccatcgacgtgtacatgatcatggtgaagtgctggatgatcgacagcgagtgcagacccagattcagagagctggtgagcgagttcagcagaatggccagagacccccagagattcgtggtgatccagaacgaggacctgggccccgccagccccctggacagcaccttctacagaagcctgctggaggacgacgacatgggcgacctggtggacgccgaggagtacctggtgccccagcagggcttcttctgccccgaccccgcccccggcgccggcggcatggtgcaccacagacacagaagcagcagcaccagaagcggcggcggcgacctgaccctgggcctggagcccagcgaggaggaggcccccagaagccccctggcccccagcgagggcgccggcagcgacgtgttcgacggcgacctgggcatgggcgccgccaagggcctgcagagcctgcccacccacgaccccagccccctgcagagatacagcgaggaccccaccgtgcccctgcccagcgagaccgacggctacgtggcccccctgacctgcagcccccagcccgagtacgtgaaccagcccgacgtgagaccccagccccccagccccagagagggccccctgcccgccgccagacccgccggcgccaccctggagagacccaagaccctgagccccggcaagaacggcgtggtgaaggacgtgttcgccttcggcggcgccgtggagaaccccgagtacctgaccccccagggcggcgccgccccccagccccaccccccccccgccttcagccccgccttcgacaacctgtactactgggaccaggacccccccgagagaggcgccccccccagcaccttcaagggcacccccaccgccgagaaccccgagtacctgggcctggacgtgcccgtgtag

SEQ ID NO: 105025 - DNA, 3678 bp, Artificial Sequence
  Description of Artificial Sequence: Synthetic coding sequence
atgaagctgagactgcccgccagccccgagacccacctggacatgctgagacacctgtaccagggctgccaggtggtgcagggcaacctggagctgacctacctgcccaccaacgccagcctgagcttcctgcaggacatccaggaggtgcagggctacgtgctgatcgcccacaaccaggtgagacaggtgcccctgcagagactgagaatcgtgagaggcacccagctgttcgaggacaactacgccctggccgtgctggacaacggcgaccccctgaacaacaccacccccgtgaccggcgccagccccggcggcctgagagagctgcagctgagaagcctgaccgagatcctgaagggcggcgtgctgatccagagaaacccccagctgtgctaccaggacaccatcctgtggaaggacatcttccacaagaacaaccagctggccctgaccctgatcgacaccaacagaagcagagcctgccacccctgcagccccatgtgcaagggcagcagatgctggggcgagagcagcgaggactgccagagcctgaccagaaccgtgtgcgccggcggctgcgccagatgcaagggccccctgcccaccgactgctgccacgagcagtgcgccgccggctgcaccggccccaagcacagcgactgcctggcctgcctgcacttcaaccacagcggcatctgcgagctgcactgccccgccctggtgacctacaacaccgacaccttcgagagcatgcccaaccccgagggcagatacaccttcggcgccagctgcgtgaccgcctgcccctacaactacctgagcaccgacgtgggcagctgcaccctggtgtgccccctgcacaaccaggaggtgaccgccgaggacggcacccagagatgcgagaagtgcagcaagccctgcgccagagtgtgctacggcctgggcatggagcacctgagagaggtgagagccgtgaccagcgccaacatccaggagttcgccggctgcaagaagatcttcggcagcctggccttcctgcccgagagcttcgacggcgaccccgccagcaacaccgcccccctgcagcccgagcagctgcaggtgttcgagaccctggaggagatcaccggctacctgtacatcagcgcctggcccgacagcctgcccgacctgagcgtgttccagaacctgcaggtgatcagaggcagaatcctgcacaacggcgcctacagcctgaccctgcagggcctgggcatcagctggctgggcctgagaagcctgagagagctgggcagcggcctggccctgatccaccacaacacccacctgtgcttcgtgcacaccgtgccctgggaccagctgttcagaaacccccaccaggccctgctgcacaccgccaacagacccgaggacgagtgcgtgggcgagggcctggcctgccaccagctgtgcgccagaggccactgctggggccccggccccacccagtgcgtgaactgcagccagttcctgagaggccaggagtgcgtggaggagtgcagagtgctgcagggcctgcccagagagtacgtgaacgccagacactgcctgccctgccaccccgagtgccagccccagaacggcagcgtgacctgcttcggccccgaggccgaccagtgcgtggcctgcgcccactacaaggacccccccttctgcgtggccagatgccccagcggcgtgaagcccgacctgagctacatgcccatctggaagttccccgacgaggagggcgcctgccagccctgccccatcaactgcacccacagctgcgtggacctggacgacaagggctgccccgccgagcagagagccagccccctgaccagcatcatcagcgccgtggtgggcatcctgctggtggtggtgctgggcgtggtgttcggcatcctgatcaagagaagacagcagaagatcagaaagtacaccatgagaagactgctgcaggagaccgagctggtggagcccctgacccccagcggcgccatgcccaaccaggcccagatgagaatcctgaaggagaccgagctgagaaaggtgaaggtgctgggcagcggcgccttcggcaccgtgtacaagggcatctggatccccgacggcgagaacgtgaagatccccgtggccatcaaggtgctgagagagaacaccagccccaaggccaacaaggagatcctggacgaggcctacgtgatggccggcgtgggcagcccctacgtgagcagactgctgggcatctgcctgaccagcaccgtgcagctggtgacccagctgatgccctacggctgcctgctggaccacgtgagagagaacagaggcagactgggcagccaggacctgctgaactggtgcatgcagatcgccaagggcatgagctacctggaggacgtgagactggtgcacagagacctggccgccagaaacgtgctggtgaagagccccaaccacgtgaagatcaccgacttcggcctggccagactgctggacatcgacgagaccgagtaccacgccgacggcggcaaggtgcccatcaagtggatggccctggagagcatcctgagaagaagattcacccaccagagcgacgtgtggagctacggcgtgaccgtgtgggagctgatgaccttcggcgccaagccctacgacggcatccccgccagagagatccccgacctgctggagaagggcgagagactgccccagccccccatctgcaccatcgacgtgtacatgatcatggtgaagtgctggatgatcgacagcgagtgcagacccagattcagagagctggtgagcgagttcagcagaatggccagagacccccagagattcgtggtgatccagaacgaggacctgggccccgccagccccctggacagcaccttctacagaagcctgctggaggacgacgacatgggcgacctggtggacgccgaggagtacctggtgccccagcagggcttcttctgccccgaccccgcccccggcgccggcggcatggtgcaccacagacacagaagcagcagcaccagaagcggcggcggcgacctgaccctgggcctggagcccagcgaggaggaggcccccagaagccccctggcccccagcgagggcgccggcagcgacgtgttcgacggcgacctgggcatgggcgccgccaagggcctgcagagcctgcccacccacgaccccagccccctgcagagatacagcgaggaccccaccgtgcccctgcccagcgagaccgacggctacgtggcccccctgacctgcagcccccagcccgagtacgtgaaccagcccgacgtgagaccccagccccccagccccagagagggccccctgcccgccgccagacccgccggcgccaccctggagagacccaagaccctgagccccggcaagaacggcgtggtgaaggacgtgttcgccttcggcggcgccgtggagaaccccgagtacctgaccccccagggcggcgccgccccccagccccaccccccccccgccttcagccccgccttcgacaacctgtactactgggaccaggacccccccgagagaggcgccccccccagcaccttcaagggcacccccaccgccgagaaccccgagtacctgggcctggacgtgcccgtgtag

SEQ ID NO: 105026 - DNA, 2940 bp, Artificial Sequence
  Description of Artificial Sequence: Synthetic coding sequence
atggagctggccgccctgtgcagatggggcctgctgctggccctgctgccccccggcgccgccagcacccaggacaactacctgagcaccgacgtgggcagctgcaccctggtgtgccccctgcacaaccaggaggtgaccgccgaggacggcacccagagatgcgagaagtgcagcaagccctgcgccagagtgtgctacggcctgggcatggagcacctgagagaggtgagagccgtgaccagcgccaacatccaggagttcgccggctgcaagaagatcttcggcagcctggccttcctgcccgagagcttcgacggcgaccccgccagcaacaccgcccccctgcagcccgagcagctgcaggtgttcgagaccctggaggagatcaccggctacctgtacatcagcgcctggcccgacagcctgcccgacctgagcgtgttccagaacctgcaggtgatcagaggcagaatcctgcacaacggcgcctacagcctgaccctgcagggcctgggcatcagctggctgggcctgagaagcctgagagagctgggcagcggcctggccctgatccaccacaacacccacctgtgcttcgtgcacaccgtgccctgggaccagctgttcagaaacccccaccaggccctgctgcacaccgccaacagacccgaggacgagtgcgtgggcgagggcctggcctgccaccagctgtgcgccagaggccactgctggggccccggccccacccagtgcgtgaactgcagccagttcctgagaggccaggagtgcgtggaggagtgcagagtgctgcagggcctgcccagagagtacgtgaacgccagacactgcctgccctgccaccccgagtgccagccccagaacggcagcgtgacctgcttcggccccgaggccgaccagtgcgtggcctgcgcccactacaaggacccccccttctgcgtggccagatgccccagcggcgtgaagcccgacctgagctacatgcccatctggaagttccccgacgaggagggcgcctgccagccctgccccatcaactgcacccacagctgcgtggacctggacgacaagggctgccccgccgagcagagagccagccccctgaccagcatcatcagcgccgtggtgggcatcctgctggtggtggtgctgggcgtggtgttcggcatcctgatcaagagaagacagcagaagatcagaaagtacaccatgagaagactgctgcaggagaccgagctggtggagcccctgacccccagcggcgccatgcccaaccaggcccagatgagaatcctgaaggagaccgagctgagaaaggtgaaggtgctgggcagcggcgccttcggcaccgtgtacaagggcatctggatccccgacggcgagaacgtgaagatccccgtggccatcaaggtgctgagagagaacaccagccccaaggccaacaaggagatcctggacgaggcctacgtgatggccggcgtgggcagcccctacgtgagcagactgctgggcatctgcctgaccagcaccgtgcagctggtgacccagctgatgccctacggctgcctgctggaccacgtgagagagaacagaggcagactgggcagccaggacctgctgaactggtgcatgcagatcgccaagggcatgagctacctggaggacgtgagactggtgcacagagacctggccgccagaaacgtgctggtgaagagccccaaccacgtgaagatcaccgacttcggcctggccagactgctggacatcgacgagaccgagtaccacgccgacggcggcaaggtgcccatcaagtggatggccctggagagcatcctgagaagaagattcacccaccagagcgacgtgtggagctacggcgtgaccgtgtgggagctgatgaccttcggcgccaagccctacgacggcatccccgccagagagatccccgacctgctggagaagggcgagagactgccccagccccccatctgcaccatcgacgtgtacatgatcatggtgaagtgctggatgatcgacagcgagtgcagacccagattcagagagctggtgagcgagttcagcagaatggccagagacccccagagattcgtggtgatccagaacgaggacctgggccccgccagccccctggacagcaccttctacagaagcctgctggaggacgacgacatgggcgacctggtggacgccgaggagtacctggtgccccagcagggcttcttctgccccgaccccgcccccggcgccggcggcatggtgcaccacagacacagaagcagcagcaccagaagcggcggcggcgacctgaccctgggcctggagcccagcgaggaggaggcccccagaagccccctggcccccagcgagggcgccggcagcgacgtgttcgacggcgacctgggcatgggcgccgccaagggcctgcagagcctgcccacccacgaccccagccccctgcagagatacagcgaggaccccaccgtgcccctgcccagcgagaccgacggctacgtggcccccctgacctgcagcccccagcccgagtacgtgaaccagcccgacgtgagaccccagccccccagccccagagagggccccctgcccgccgccagacccgccggcgccaccctggagagacccaagaccctgagccccggcaagaacggcgtggtgaaggacgtgttcgccttcggcggcgccgtggagaaccccgagtacctgaccccccagggcggcgccgccccccagccccaccccccccccgccttcagccccgccttcgacaacctgtactactgggaccaggacccccccgagagaggcgccccccccagcaccttcaagggcacccccaccgccgagaaccccgagtacctgggcctggacgtgcccgtgtag

SEQ ID NO: 105027 - DNA, 1812 bp, Artificial Sequence
  Description of Artificial Sequence: Synthetic coding sequence
atgaagctgagactgcccgccagccccgagacccacctggacatgctgagacacctgtaccagggctgccaggtggtgcagggcaacctggagctgacctacctgcccaccaacgccagcctgagcttcctgcaggacatccaggaggtgcagggctacgtgctgatcgcccacaaccaggtgagacaggtgcccctgcagagactgagaatcgtgagaggcacccagctgttcgaggacaactacgccctggccgtgctggacaacggcgaccccctgaacaacaccacccccgtgaccggcgccagccccggcggcctgagagagctgcagctgagaagcctgaccgagatcctgaagggcggcgtgctgatccagagaaacccccagctgtgctaccaggacaccatcctgtggaaggacatcttccacaagaacaaccagctggccctgaccctgatcgacaccaacagaagcagagcctgccacccctgcagccccatgtgcaagggcagcagatgctggggcgagagcagcgaggactgccagagcctgaccagaaccgtgtgcgccggcggctgcgccagatgcaagggccccctgcccaccgactgctgccacgagcagtgcgccgccggctgcaccggccccaagcacagcgactgcctggcctgcctgcacttcaaccacagcggcatctgcgagctgcactgccccgccctggtgacctacaacaccgacaccttcgagagcatgcccaaccccgagggcagatacaccttcggcgccagctgcgtgaccgcctgcccctacaactacctgagcaccgacgtgggcagctgcaccctggtgtgccccctgcacaaccaggaggtgaccgccgaggacggcacccagagatgcgagaagtgcagcaagccctgcgccagagtgtgctacggcctgggcatggagcacctgagagaggtgagagccgtgaccagcgccaacatccaggagttcgccggctgcaagaagatcttcggcagcctggccttcctgcccgagagcttcgacggcgaccccgccagcaacaccgcccccctgcagcccgagcagctgcaggtgttcgagaccctggaggagatcaccggctacctgtacatcagcgcctggcccgacagcctgcccgacctgagcgtgttccagaacctgcaggtgatcagaggcagaatcctgcacaacggcgcctacagcctgaccctgcagggcctgggcatcagctggctgggcctgagaagcctgagagagctgggcagcggcctggccctgatccaccacaacacccacctgtgcttcgtgcacaccgtgccctgggaccagctgttcagaaacccccaccaggccctgctgcacaccgccaacagacccgaggacgagtgcgtgggcgagggcctggcctgccaccagctgtgcgccagaggccactgctggggccccggccccacccagtgcgtgaactgcagccagttcctgagaggccaggagtgcgtggaggagtgcagagtgctgcagggcctgcccagagagtacgtgaacgccagacactgcctgccctgccaccccgagtgccagccccagaacggcagcgtgacctgcttcggccccgaggccgaccagtgcgtggcctgcgcccactacaaggacccccccttctgcgtggccagatgccccagcggcgtgaagcccgacctgagctacatgcccatctggaagttccccgacgaggagggcgcctgccagccctgccccatcaactgcacccacagctag

SEQ ID NO: 105028 - DNA, 3678 bp, Artificial Sequence; identical to SEQ ID NO: 105025
  Description of Artificial Sequence: Synthetic coding sequence

SEQ ID NO: 105029 - DNA, 3723 bp, Artificial Sequence
  Description of Artificial Sequence: Synthetic coding sequence
atgcccagaggcagctggaagccccaggtgtgcaccggcaccgacatgaagctgagactgcccgccagccccgagacccacctggacatgctgagacacctgtaccagggctgccaggtggtgcagggcaacctggagctgacctacctgcccaccaacgccagcctgagcttcctgcaggacatccaggaggtgcagggctacgtgctgatcgcccacaaccaggtgagacaggtgcccctgcagagactgagaatcgtgagaggcacccagctgttcgaggacaactacgccctggccgtgctggacaacggcgaccccctgaacaacaccacccccgtgaccggcgccagccccggcggcctgagagagctgcagctgagaagcctgaccgagatcctgaagggcggcgtgctgatccagagaaacccccagctgtgctaccaggacaccatcctgtggaaggacatcttccacaagaacaaccagctggccctgaccctgatcgacaccaacagaagcagagcctgccacccctgcagccccatgtgcaagggcagcagatgctggggcgagagcagcgaggactgccagagcctgaccagaaccgtgtgcgccggcggctgcgccagatgcaagggccccctgcccaccgactgctgccacgagcagtgcgccgccggctgcaccggccccaagcacagcgactgcctggcctgcctgcacttcaaccacagcggcatctgcgagctgcactgccccgccctggtgacctacaacaccgacaccttcgagagcatgcccaaccccgagggcagatacaccttcggcgccagctgcgtgaccgcctgcccctacaactacctgagcaccgacgtgggcagctgcaccctggtgtgccccctgcacaaccaggaggtgaccgccgaggacggcacccagagatgcgagaagtgcagcaagccctgcgccagagtgtgctacggcctgggcatggagcacctgagagaggtgagagccgtgaccagcgccaacatccaggagttcgccggctgcaagaagatcttcggcagcctggccttcctgcccgagagcttcgacggcgaccccgccagcaacaccgcccccctgcagcccgagcagctgcaggtgttcgagaccctggaggagatcaccggctacctgtacatcagcgcctggcccgacagcctgcccgacctgagcgtgttccagaacctgcaggtgatcagaggcagaatcctgcacaacggcgcctacagcctgaccctgcagggcctgggcatcagctggctgggcctgagaagcctgagagagctgggcagcggcctggccctgatccaccacaacacccacctgtgcttcgtgcacaccgtgccctgggaccagctgttcagaaacccccaccaggccctgctgcacaccgccaacagacccgaggacgagtgcgtgggcgagggcctggcctgccaccagctgtgcgccagaggccactgctggggccccggccccacccagtgcgtgaactgcagccagttcctgagaggccaggagtgcgtggaggagtgcagagtgctgcagggcctgcccagagagtacgtgaacgccagacactgcctgccctgccaccccgagtgccagccccagaacggcagcgtgacctgcttcggccccgaggccgaccagtgcgtggcctgcgcccactacaaggacccccccttctgcgtggccagatgccccagcggcgtgaagcccgacctgagctacatgcccatctggaagttccccgacgaggagggcgcctgccagccctgccccatcaactgcacccacagctgcgtggacctggacgacaagggctgccccgccgagcagagagccagccccctgaccagcatcatcagcgccgtggtgggcatcctgctggtggtggtgctgggcgtggtgttcggcatcctgatcaagagaagacagcagaagatcagaaagtacaccatgagaagactgctgcaggagaccgagctggtggagcccctgacccccagcggcgccatgcccaaccaggcccagatgagaatcctgaaggagaccgagctgagaaaggtgaaggtgctgggcagcggcgccttcggcaccgtgtacaagggcatctggatccccgacggcgagaacgtgaagatccccgtggccatcaaggtgctgagagagaacaccagccccaaggccaacaaggagatcctggacgaggcctacgtgatggccggcgtgggcagcccctacgtgagcagactgctgggcatctgcctgaccagcaccgtgcagctggtgacccagctgatgccctacggctgcctgctggaccacgtgagagagaacagaggcagactgggcagccaggacctgctgaactggtgcatgcagatcgccaagggcatgagctacctggaggacgtgagactggtgcacagagacctggccgccagaaacgtgctggtgaagagccccaaccacgtgaagatcaccgacttcggcctggccagactgctggacatcgacgagaccgagtaccacgccgacggcggcaaggtgcccatcaagtggatggccctggagagcatcctgagaagaagattcacccaccagagcgacgtgtggagctacggcgtgaccgtgtgggagctgatgaccttcggcgccaagccctacgacggcatccccgccagagagatccccgacctgctggagaagggcgagagactgccccagccccccatctgcaccatcgacgtgtacatgatcatggtgaagtgctggatgatcgacagcgagtgcagacccagattcagagagctggtgagcgagttcagcagaatggccagagacccccagagattcgtggtgatccagaacgaggacctgggccccgccagccccctggacagcaccttctacagaagcctgctggaggacgacgacatgggcgacctggtggacgccgaggagtacctggtgccccagcagggcttcttctgccccgaccccgcccccggcgccggcggcatggtgcaccacagacacagaagcagcagcaccagaagcggcggcggcgacctgaccctgggcctggagcccagcgaggaggaggcccccagaagccccctggcccccagcgagggcgccggcagcgacgtgttcgacggcgacctgggcatgggcgccgccaagggcctgcagagcctgcccacccacgaccccagccccctgcagagatacagcgaggaccccaccgtgcccctgcccagcgagaccgacggctacgtggcccccctgacctgcagcccccagcccgagtacgtgaaccagcccgacgtgagaccccagccccccagccccagagagggccccctgcccgccgccagacccgccggcgccaccctggagagacccaagaccctgagccccggcaagaacggcgtggtgaaggacgtgttcgccttcggcggcgccgtggagaaccccgagtacctgaccccccagggcggcgccgccccccagccccaccccccccccgccttcagccccgccttcgacaacctgtactactgggaccaggacccccccgagagaggcgccccccccagcaccttcaagggcacccccaccgccgagaaccccgagtacctgggcctggacgtgcccgtgtag

SEQ ID NO: 105030 - DNA, 2259 bp, Artificial Sequence
  Description of Artificial Sequence: Synthetic coding sequence
atgggcaccagcgccctgtgggccctgtggctgctgctggccctgtgctgggcccccagagagagcggcgccaccggcaccggcagaaaggccaagtgcgagcccagccagttccagtgcaccaacggcagatgcatcaccctgctgtggaagtgcgacggcgacgaggactgcgtggacggcagcgacgagctggactgcgccccccccacctgcggcgcccacgagttccagtgcagcaccagcagctgcatccccatcagctgggtgtgcgacgacgacgccgactgcagcgaccagagcgacgagagcctggagcagtgcggcagacagcccgtgatccacaccaagtgccccgccagcgagatccagtgcggcagcggcgagtgcatccacaagaagtggagatgcgacggcgaccccgactgcaaggacggcagcgacgaggtgaactgccccagcagaacctgcagacccgaccagttcgagtgcgaggacggcagctgcatccacggcagcagacagtgcaacggcatcagagactgcgtggacggcagcgacgaggtgaactgcaagaacgtgaaccagtgcctgggccccggcaagttcaagtgcagaagcggcgagtgcatcgacatcagcaaggtgtgcaaccaggagcaggactgcagagactggagcgacgagcccctgaaggagtgccacatcaacgagtgcctggtgaacaacggcggctgcagccacatctgcaaggacctggtgatcggctacgagtgcgactgcgccgccggcttcgagctgatcgacagaaagacctgcggcgacatcgacgagtgccagaaccccggcatctgcagccagatctgcatcaacctgaagggcggctacaagtgcgagtgcagcagaggctaccagatggacctggccaccggcgtgtgcaaggccgtgggcaaggagcccagcctgatcttcaccaacagaagagacatcagaaagatcggcctggagagaaaggagtacatccagctggtggagcagctgagaaacaccgtggccctggacgccgacatcgccgcccagaagctgttctgggccgacctgagccagaaggccatcttcagcgccagcatcgacgacaaggtgggcagacacgtgaagatgatcgacaacgtgtacaaccccgccgccatcgccgtggactgggtgtacaagaccatctactggaccgacgccgccagcaagaccatcagcgtggccaccctggacggcaccaagagaaagttcctgttcaacagcgacctgagagagcccgccagcatcgccgtggaccccctgagcggcttcgtgtactggagcgactggggcgagcccgccaagatcgagaaggccggcatgaacggcttcgacagaagacccctggtgaccgccgacatccagtggcccaacggcatcaccctggacctgatcaagagcagactgtactggctggacagcaagctgcacatgctgagcagcgtggacctgaacggccaggacagaagaatcgtgctgaagagcctggagttcctggcccaccccctggccctgaccatcttcgaggacagagtgtactggatcgacggcgagaacgaggccgtgtacggcgccaacaagttcaccggcagcgagctggccaccctggtgaacaacctgaacgacgcccaggacatcatcgtgtaccacgagctggtgcagcccagcggcaagaactggtgcgaggaggacatggagaacggcggctgcgagtacctgtgcctgcccgccccccagatcaacgaccacagccccaagtacacctgcagctgccccagcggctacaacgtggaggagaacggcagagactgccagagcaccgccaccaccgtgacctacagcgagaccaaggacaccaacaccaccgagatcagcgccaccagcggcctggtgcccggcggcatcaacgtgaccaccgccgtgagcgaggtgagcgtgccccccaagggcaccagcgccgcctgggccatcctgcccctgctgctgctggtgatggccgccgtgggcggctacctgatgtggagaaactggcagcacaagaacatgaagagcatgaacttcgacaaccccgtgtacctgaagaccaccgaggaggacctgagcatcgacatcggcagacacagcgccagcgtgggccacacctaccccgccatcagcgtggtgagcaccgacgacgacctggcctag

SEQ ID NO: 105031 - DNA, 522 bp, Artificial Sequence
  Description of Artificial Sequence: Synthetic coding sequence
atgggcaccagcgccctgtgggccctgtggctgctgctggccctgtgctgggcccccagagagagcggcgccaccggcaccggcagaaaggccaagtgcgagcccagccagttccagtgcaccaacggcagatgcatcaccctgctgtggaagtgcgacggcgacgaggactgcgtggacggcagcgacgagaagaactgcgtgaagaagacctgcgccgagagcgacttcgtgtgcaacaacggccagtgcgtgcccagcagatggaagtgcgacggcgaccccgactgcgaggacggcagcgacgagagccccgagcagtgcagaaacatcacctgcagccccgacgagttcacctgcagcagcggcagatgcatcagcagaaacttcgtgtgcaacggccaggacgactgcagcgacggcagcgacgagctggactgcgccccccccacctgcggcgcccacgagttccagtgcagcaccagcagctgcatccccatcagctgggtgtgcgacgactag

SEQ ID NO: 105032 - DNA, 2538 bp, Artificial Sequence
  Description of Artificial Sequence: Synthetic coding sequence
atgggcaccagcgccctgtgggccctgtggctgctgctggccctgtgctgggcccccagagagagcggcgccaccggcaccggcagaaaggccaagtgcgagcccagccagttccagtgcaccaacggcagatgcatcaccctgctgtggaagtgcgacggcgacgaggactgcgtggacggcagcgacgagaagaactgcgtgaagaagacctgcgccgagagcgacttcgtgtgcaacaacggccagtgcgtgcccagcagatggaagtgcgacggcgaccccgactgcgaggacggcagcgacgagagccccgagcagtgccacatgagaacctgcagaatccacgagatcagctgcggcgcccacagcacccagtgcatccccgtgagctggagatgcgacggcgagaacgactgcgacagcggcgaggacgaggagaactgcggcaacatcacctgcagccccgacgagttcacctgcagcagcggcagatgcatcagcagaaacttcgtgtgcaacggccaggacgactgcagcgacggcagcgacgagctggactgcgccccccccacctgcggcgcccacgagttccagtgcagcaccagcagctgcatccccatcagctgggtgtgcgacgacgacgccgactgcagcgaccagagcgacgagagcctggagcagtgcggcagacagcccgtgatccacaccaagtgccccgccagcgagatccagtgcggcagcggcgagtgcatccacaagaagtggagatgcgacggcgaccccgactgcaaggacggcagcgacgaggtgaactgccccagcagaacctgcagacccgaccagttcgagtgcgaggacggcagctgcatccacggcagcagacagtgcaacggcatcagagactgcgtggacggcagcgacgaggtgaactgcaagaacgtgaaccagtgcctgggccccggcaagttcaagtgcagaagcggcgagtgcatcgacatcagcaaggtgtgcaaccaggagcaggactgcagagactggagcgacgagcccctgaaggagtgccacatcaacgagtgcctggtgaacaacggcggctgcagccacatctgcaaggacctggtgatcggctacgagtgcgactgcgccgccggcttcgagctgatcgacagaaagacctgcggcgacatcgacgagtgccagaaccccggcatctgcagccagatctgcatcaacctgaagggcggctacaagtgcgagtgcagcagaggctaccagatggacctggccaccggcgtgtgcaaggccgtgggcaaggagcccagcctgatcttcaccaacagaagagacatcagaaagatcggcctggagagaaaggagtacatccagctggtggagcagctgagaaacaccgtggccctggacgccgacatcgccgcccagaagctgttctgggccgacctgagccagaaggccatcttcagcgccagcatcgacgacaaggtgggcagacacgtgaagatgatcgacaacgtgtacaaccccgccgccatcgccgtggactgggtgtacaagaccatctactggaccgacgccgccagcaagaccatcagcgtggccaccctggacggcaccaagagaaagttcctgttcaacagcgacctgagagagcccgccagcatcgccgtggaccccctgagcggcttcgtgtactggagcgactggggcgagcccgccaagatcgagaaggccggcatgaacggcttcgacagaagacccctggtgaccgccgacatccagtggcccaacggcatcaccctggacctgatcaagagcagactgtactggctggacagcaagctgcacatgctgagcagcgtggacctgaacggccaggacagaagaatcgtgctgaagagcctggagttcctggcccaccccctggccctgaccatcttcgaggacagagtgtactggatcgacggcgagaacgaggccgtgtacggcgccaacaagttcaccggcagcgagctggccaccctggtgaacaacctgaacgacgcccaggacatcatcgtgtaccacgagctggtgcagcccagcggcaagaactggtgcgaggaggacatggagaacggcggctgcgagtacctgtgcctgcccgccccccagatcaacgaccacagccccaagtacacctgcagctgccccagcggctacaacgtggaggagaacggcagagactgccagagaatcaacgtgaccaccgccgtgagcgaggtgagcgtgccccccaagggcaccagcgccgcctgggccatcctgcccctgctgctgctggtgatggccgccgtgggcggctacctgatgtggagaaactggcagcacaagaacatgaagagcatgaacttcgacaaccccgtgtacctgaagaccaccgaggaggacctgagcatcgacatcggcagacacagcgccagcgtgggccacacctaccccgccatcagcgtggtgagcaccgacgacgacctggcctag

SEQ ID NO: 105033 - DNA, 2622 bp, Artificial Sequence
  Description of Artificial Sequence: Synthetic coding sequence
atgggcaccagcgccctgtgggccctgtggctgctgctggccctgtgctgggcccccagagagagcggcgccaccggcaccggcagaaaggccaagtgcgagcccagccagttccagtgcaccaacggcagatgcatcaccctgctgtggaagtgcgacggcgacgaggactgcgtggacggcagcgacgagaagaactgcgtgaagaagacctgcgccgagagcgacttcgtgtgcaacaacggccagtgcgtgcccagcagatggaagtgcgacggcgaccccgactgcgaggacggcagcgacgagagccccgagcagtgccacatgagaacctgcagaatccacgagatcagctgcggcgcccacagcacccagtgcatccccgtgagctggagatgcgacggcgagaacgactgcgacagcggcgaggacgaggagaactgcggcaacatcacctgcagccccgacgagttcacctgcagcagcggcagatgcatcagcagaaacttcgtgtgcaacggccaggacgactgcagcgacggcagcgacgagctggactgcgccccccccacctgcggcgcccacgagttccagtgcagcaccagcagctgcatccccatcagctgggtgtgcgacgacgacgccgactgcagcgaccagagcgacgagagcctggagcagtgcggcagacagcccgtgatccacaccaagtgccccgccagcgagatccagtgcggcagcggcgagtgcatccacaagaagtggagatgcgacggcgaccccgactgcaaggacggcagcgacgaggtgaactgccccagcagaacctgcagacccgaccagttcgagtgcgaggacggcagctgcatccacggcagcagacagtgcaacggcatcagagactgcgtggacggcagcgacgaggtgaactgcaagaacgtgaaccagtgcctgggccccggcaagttcaagtgcagaagcggcgagtgcatcgacatcagcaaggtgtgcaaccaggagcaggactgcagagactggagcgacgagcccctgaaggagtgccacatcaacgagtgcctggtgaacaacggcggctgcagccacatctgcaaggacctggtgatcggctacgagtgcgactgcgccgccggcttcgagctgatcgacagaaagacctgcggcgacatcgacgagtgccagaaccccggcatctgcagccagatctgcatcaacctgaagggcggctacaagtgcgagtgcagcagaggctaccagatggacctggccaccggcgtgtgcaaggccgtgggcaaggagcccagcctgatcttcaccaacagaagagacatcagaaagatcggcctggagagaaaggagtacatccagctggtggagcagctgagaaacaccgtggccctggacgccgacatcgccgcccagaagctgttctgggccgacctgagccagaaggccatcttcagcgccagcatcgacgacaaggtgggcagacacgtgaagatgatcgacaacgtgtacaaccccgccgccatcgccgtggactgggtgtacaagaccatctactggaccgacgccgccagcaagaccatcagcgtggccaccctggacggcaccaagagaaagttcctgttcaacagcgacctgagagagcccgccagcatcgccgtggaccccctgagcggcttcgtgtactggagcgactggggcgagcccgccaagatcgagaaggccggcatgaacggcttcgacagaagacccctggtgaccgccgacatccagtggcccaacggcatcaccctggacctgatcaagagcagactgtactggctggacagcaagctgcacatgctgagcagcgtggacctgaacggccaggacagaagaatcgtgctgaagagcctggagttcctggcccaccccctggccctgaccatcttcgaggacagagtgtactggatcgacggcgagaacgaggccgtgtacggcgccaacaagttcaccggcagcgagctggccaccctggtgaacaacctgaacgacgcccaggacatcatcgtgtaccacgagctggtgcagcccagcggcaagaactggtgcgaggaggacatggagaacggcggctgcgagtacctgtgcctgcccgccccccagatcaacgaccacagccccaagtacacctgcagctgccccagcggctacaacgtggaggagaacggcagagactgccagagcaccgccaccaccgtgacctacagcgagaccaaggacaccaacaccaccgagatcagcgccaccagcggcctggtgcccggcggcatcaacgtgaccaccgccgtgagcgaggtgagcgtgccccccaagggcaccagcgccgcctgggccatcctgcccctgctgctgctggtgatggccgccgtgggcggctacctgatgtggagaaactggcagcacaagaacatgaagagcatgaacttcgacaaccccgtgtacctgaagaccaccgaggaggacctgagcatcgacatcggcagacacagcgccagcgtgggccacacctaccccgccatcagcgtggtgagcaccgacgacgacctggcctag

SEQ ID NO: 105034 - DNA, 729 bp, Artificial Sequence
  Description of Artificial Sequence: Synthetic coding sequence
atgagcgacgagagagaggtggccgaggccgccaccggcgaggacgccagcagccccccccccaagaccgaggccgccagcgacccccagcaccccgccgccagcgagggcgccgccgccgccgccgccagcccccccctgctgagatgcctggtgctgaccggcttcggcggctacgacaaggtgaagctgcagagcagacccgccgccccccccgcccccggccccggccagctgaccctgagactgagagcctgcggcctgaacttcgccgacctgatggccagacagggcctgtacgacagactgccccccctgcccgtgacccccggcatggagggcgccggcgtggtgatcgccgtgggcgagggcgtgagcgacagaaaggccggcgacagagtgatggtgctgaacagaagcggcatgtggcaggaggaggtgaccgtgcccagcgtgcagaccttcctgatccccgaggccatgaccttcgaggaggccgccgccctgctggtgaactacatcaccgcctacatggtgctgttcgacttcggcaacctgcagcccggccacagcgtgctggtgcacatggccgccggcggcgtgggcatggccgccgtgcagctgccctacagcggcgagtgcgacagcgtgagaaacggcctgggccagcaggccagaggcaccgagggcgagtggggccacaccagccacagactgagccacgactag

SEQ ID NO: 105035 - DNA, 1182 bp, Artificial Sequence
  Description of Artificial Sequence: Synthetic coding sequence
atgagcgacgagagagaggtggccgaggccgccaccggcgaggacgccagcagccccccccccaagaccgaggccgccagcgacccccagcaccccgccgccagcgagggcgccgccgccgccgccgccagcccccccctgctgagatgcctggtgctgaccggcttcggcggctacgacaaggtgaagctgcagagcagacccgccgccccccccgcccccggccccggccagctgaccctgagactgagagcctgcggcctgaacttcgccgacctgatggccagacagggcctgtacgacagactgccccccctgcccgtgacccccggcatggagggcgccggcgtggtgatcgccgtgggcgagggcgtgagcgacagaaaggccggcgacagagtgatggtgctgaacagaagcggcatgtggcaggaggaggtgaccgtgcccagcgtgcagaccttcctgatccccgaggccatgaccttcgaggaggccgccgccctgctggtgaactacatcaccgcctacatggtgctgttcgacttcggcaacctgcagcccggccacagcgtgctggtgcacatggccgccggcggcgtgggcatggccgccgtgcagctgtgcagaaccgtggagaacgtgaccgtgttcggcaccgccagcgccagcaagcacgaggccctgaaggagaacggcgtgacccaccccatcgactaccacaccaccgactacgtggacgagatcaagaagatcagccccaagggcgtggacatcgtgatggaccccctgggcggcagcgacaccgccaagggctacaacctgctgaagcccatgggcaaggtggtgacctacggcatggccaacctgctgaccggccccaagagaaacctgatggccctggccagaacctggtggaaccagttcagcgtgaccgccctgcagctgctgcaggccaacagagccgtgtgcggcttccacctgggctacctggacggcgaggtggagctggtgagcggcgtggtggccagactgctggccctgtacaaccagggccacatcaagccccacatcgacagcgtgtggcccttcgagaaggtggccgacgccatgaagcagatgcaggagaagaagaacgtgggcaaggtgctgctggtgcccggccccgagaaggagaactag

SEQ ID NO: 105036 - DNA, 780 bp, Artificial Sequence
  Description of Artificial Sequence: Synthetic coding sequence
atggtgctgaacagaagcggcatgtggcaggaggaggtgaccgtgcccagcgtgcagaccttcctgatccccgaggccatgaccttcgaggaggccgccgccctgctggtgaactacatcaccgcctacatggtgctgttcgacttcggcaacctgcagcccggccacagcgtgctggtgcacatggccgccggcggcgtgggcatggccgccgtgcagctgtgcagaaccgtggagaacgtgaccgtgttcggcaccgccagcgccagcaagcacgaggccctgaaggagaacggcgtgacccaccccatcgactaccacaccaccgactacgtggacgagatcaagaagatcagccccaagggcgtggacatcgtgatggaccccctgggcggcagcgacaccgccaagggctacaacctgctgaagcccatgggcaaggtggtgacctacggcatggccaacctgctgaccggccccaagagaaacctgatggccctggccagaacctggtggaaccagttcagcgtgaccgccctgcagctgctgcaggccaacagagccgtgtgcggcttccacctgggctacctggacggcgaggtggagctggtgagcggcgtggtggccagactgctggccctgtacaaccagggccacatcaagccccacatcgacagcgtgtggcccttcgagaaggtggccgacgccatgaagcagatgcaggagaagaagaacgtgggcaaggtgctgctggtgcccggccccgagaaggagaactag

SEQ ID NO: 105037 - DNA, 903 bp, Artificial Sequence
  Description of Artificial Sequence: Synthetic coding sequence
atggccagacagggcctgtacgacagactgccccccctgcccgtgacccccggcatggagggcgccggcgtggtgatcgccgtgggcgagggcgtgagcgacagaaaggccggcgacagagtgatggtgctgaacagaagcggcatgtggcaggaggaggtgaccgtgcccagcgtgcagaccttcctgatccccgaggccatgaccttcgaggaggccgccgccctgctggtgaactacatcaccgcctacatggtgctgttcgacttcggcaacctgcagcccggccacagcgtgctggtgcacatggccgccggcggcgtgggcatggccgccgtgcagctgtgcagaaccgtggagaacgtgaccgtgttcggcaccgccagcgccagcaagcacgaggccctgaaggagaacggcgtgacccaccccatcgactaccacaccaccgactacgtggacgagatcaagaagatcagccccaagggcgtggacatcgtgatggaccccctgggcggcagcgacaccgccaagggctacaacctgctgaagcccatgggcaaggtggtgacctacggcatggccaacctgctgaccggccccaagagaaacctgatggccctggccagaacctggtggaaccagttcagcgtgaccgccctgcagctgctgcaggccaacagagccgtgtgcggcttccacctgggctacctggacggcgaggtggagctggtgagcggcgtggtggccagactgctggccctgtacaaccagggccacatcaagccccacatcgacagcgtgtggcccttcgagaaggtggccgacgccatgaagcagatgcaggagaagaagaacgtgggcaaggtgctgctggtgcccggccccgagaaggagaactag

SEQ ID NO: 105038 - DNA, 654 bp, Artificial Sequence
  Description of Artificial Sequence: Synthetic coding sequence
atgagcagcgacttcgagggctacgagcaggacttcgccgtgctgaccgccgagatcaccagcaagatcgccagagtgcccagactgccccccgacgagaagaagcagatggtggccaacgtggagaagcagctggaggaggccaaggagctgctggagcagatggacctggaggtgagagagatccccccccagagcagaggcatgtacagcaacagaatgagaagctacaagcaggagatgggcaagctggagaccgacttcaagagaagcagaatcgcctacagcgacgaggtgagaaacgagctgctgggcgacgacggcaacagcagcgagaaccagagagcccacctgctggacaacaccgagagactggagagaagcagcagaagactggaggccggctaccagatcgccgtggagaccgagcagatcggccaggagatgctggagaacctgagccacgacagagagaagatccagagagccagagagagactgagagagaccgacgccaacctgggcaagagcagcagaatcctgaccggcatgctgagaagaatcatccagaacagaatcctgctggtgatcctgggcatcatcgtggtgatcaccatcctgatggccatcaccttcagcgtgagaagacactag

SEQ ID NO: 105039 - DNA, 612 bp, Artificial Sequence
  Description of Artificial Sequence: Synthetic coding sequence
atgagcagcgacttcgagggctacgagcaggacttcgccgtgctgaccgccgagatcaccagcaagatcgccagagtgcccagactgccccccgacgagaagaagcagatggtggccaacgtggagaagcagctggaggaggccaaggagctgctggagcagatggacctggaggtgagagagatccccccccagagcagaggcatgtacagcaacagaatgagaagctacaagcaggagatgggcaagctggagaccgacttcaagagaagcagaatcgcctacagcgacgaggtgagaaacgagctgctgggcgacgacggcaacagcagcgagaaccagagagcccacctgctggacaacaccgagagactggagagaagcagcagaagactggaggccggctaccagatcgccgtggagaccgagcagatcggccaggagatgctggagaacctgagccacgacagagagaagatccagagagccagagagagactgagagagaccgacgccaacctgggcaagagcagcagaatcctgaccggcatgctgagaagaggctgcagcgtgaagaagcagtgcaacctgagcctggcccccaaggcctag

SEQ ID NO: 105040 - DNA, 432 bp, Artificial Sequence
  Description of Artificial Sequence: Synthetic coding sequence
atgagcgcccccgcccagccccccgccgagggcaccgagggcaccgcccccggcggcggcccccccggccccccccccaacatgaccagcaacagaagactgcagcagacccaggcccaggtggaggaggtggtggacatcatcagagtgaacgtggacaaggtgctggagagagaccagaagctgagcgagctggacgacagagccgacgccctgcaggccggcgccagccagttcgagagcagcgccgccaagctgaagagaaagtactggtggaagaactgcaagatgatgatcatgctgggcagatggcagctgacccagtactgcctggtgatgtggagcttccccagctggaccagacccgaggagggccccggcggcggccccaagagcaacctggtgagcgtgcagtaccccttcagaaagtag

SEQ ID NO: 105041 - DNA, 354 bp, Artificial Sequence
  Description of Artificial Sequence: Synthetic coding sequence
atgagcgcccccgcccagccccccgccgagggcaccgagggcaccgcccccggcggcggcccccccggccccccccccaacatgaccagcaacagaagactgcagcagacccaggcccaggtggaggaggtggtggacatcatcagagtgaacgtggacaaggtgctggagagagaccagaagctgagcgagctggacgacagagccgacgccctgcaggccggcgccagccagttcgagagcagcgccgccaagctgaagagaaagtactggtggaagaactgcaagatgatgatcatgctgggcgccatctgcgccatcatcgtggtggtgatcgtgagcaagtacagatag

SEQ ID NO: 105042 - DNA, 357 bp, Artificial Sequence
  Description of Artificial Sequence: Synthetic coding sequence
atgagcgcccccgcccagccccccgccgagggcaccgagggcaccgcccccggcggcggcccccccggccccccccccaacatgaccagcaacagaagactgcagcagacccaggcccaggtggaggaggtggtggacatcatcagagtgaacgtggacaaggtgctggagagagaccagaagctgagcgagctggacgacagagccgacgccctgcaggccggcgccagccagttcgagagcagcgccgccaagctgaagagaaagtactggtggaagaactgcaagatgatgatcatgctgggcgccatctgcgccatcatcgtggtggtgatcgtgatctacttcttcacctag

SEQ ID NO: 105043 - DNA, 744 bp, Artificial Sequence
  Description of Artificial Sequence: Synthetic coding sequence
atgagcgcccccgcccagccccccgccgagggcaccgagggcaccgcccccggcggcggcccccccggccccccccccaacatgaccagcaacagaagactgcagcagacccaggcccaggtggaggaggtggtggacatcatcagagtgaacgtggacaaggtgctggagagagaccagaagctgagcgagctggacgacagagccgacgccctgcaggccggcgccagccagttcgagagcagcgccgccaagctgaagagaaagtactggtggaagaactgcaagatgatgatcatgctgggcgccatctgcgccatcatcgtggtggtgatcgtgatctacttctacctgagaatgtaccaccccttccccgtggtgcactgccacccccacagctgccccctgcccagcgtgtgcagcctgaacaccctgccccacccccccagcagcatccccgcccaggccagccccagccccatcccccccttcagcctgagaagcttcgccctgtgccccagcaccctggagatgctgctggtggcccagagcaagagcctgcccgaggagcagcagctggccccccccccctgcctgctgttcctgtacagccaggtgccccccaagccccagagagtgggcggccagggcaagggccagggcggcgagtggctgagaagaagcacccacgaggccgcccagacctgggaggagaagagcatcggcgcccacggcgacttctag

SEQ ID NO: 105044 - DNA, 351 bp, Artificial Sequence
  Description of Artificial Sequence: Synthetic coding sequence
atgagcgcccccgcccagccccccgccgagggcaccgagggcaccgcccccggcggcggcccccccggccccccccccaacatgaccagcaacagaagactgcagcagacccaggcccaggtggaggaggtggtggacatcatcagagtgaacgtggacaaggtgctggagagagaccagaagctgagcgagctggacgacagagccgacgccctgcaggccggcgccagccagttcgagagcagcgccgccaagctgaagagaaagtactggtggaagaactgcaagatgatgatcatgctgggcgccatctgcgccatcatcgtggtggtgatcgtgagaagagactag

SEQ ID NO: 105045 - DNA, 351 bp, Artificial Sequence
  Description of Artificial Sequence: Synthetic coding sequence
atgagcgccaccgccgccaccgccccccccgccgcccccgccggcgagggcggcccccccgcccccccccccaacctgaccagcaacagaagactgcagcagacccaggcccaggtggacgaggtggtggacatcatgagagtgaacgtggacaaggtgctggagagagaccagaagctgagcgagctggacgacagagccgacgccctgcaggccggcgccagccagttcgagaccagcgccgccaagctgaagagaaagtactggtggaagaacctgaagatgatgatcatcctgggcgtgatctgcgccatcatcctgatcatcatcatcgtgtacttcagcacctag

SEQ ID NO: 105046 - DNA, 303 bp, Artificial Sequence
  Description of Artificial Sequence: Synthetic coding sequence
atgagcaccggccccaccgccgccaccggcagcaacagaagactgcagcagacccagaaccaggtggacgaggtggtggacatcatgagagtgaacgtggacaaggtgctggagagagaccagaagctgagcgagctggacgacagagccgacgccctgcaggccggcgccagccagttcgagaccagcgccgccaagctgaagagaaagtactggtggaagaactgcaagatgtgggccatcggcatcaccgtgctggtgatcttcatcatcatcatcatcgtgtgggtggtgagcagctag

SEQ ID NO: 105047 - DNA, 351 bp, Artificial Sequence
  Description of Artificial Sequence: Synthetic coding sequence
atggccggcatcgagctggagagatgccagcagcaggccaacgaggtgaccgagatcatgagaaacaacttcggcaaggtgctggagagaggcgtgaagctggccgagctgcagcagagaagcgaccagctgctggacatgagcagcaccttcaacaagaccacccagaacctggcccagaagaagtgctgggagaacatcagatacagaatctgcgtgggcctggtggtggtgggcgtgctgctgatcatcctgatcgtgctgctggtggtgttcctgccccagagcagcgacagcagcagcgcccccagaacccaggacgccggcatcgccagcggccccggcaactag

SEQ ID NO: 105048 - DNA, 783 bp, Artificial Sequence
  Description of Artificial Sequence: Synthetic coding sequence
atggccatcctgttcgccgtggtggccagaggcaccaccatcctggccaagcacgcctggtgcggcggcaacttcctggaggtgaccgagcagatcctggccaagatccccagcgagaacaacaagctgacctacagccacggcaactacctgttccactacatctgccaggacagaatcgtgtacctgtgcatcaccgacgacgacttcgagagaagcagagccttcaacttcctgaacgagatcaagaagagattccagaccacctacggcagcagagcccagaccgccctgccctacgccatgaacagcgagttcagcagcgtgctggccgcccagctgaagcaccacagcgagaacaagggcctggacaaggtgatggagacccaggcccaggtggacgagctgaagggcatcatggtgagaaacatcgtgtgccacctgcagaactaccagcagaagagctgcagcagccacgtgtacgaggagccccaggcccactactaccaccaccacagaatcaactgcgtgcacctgtaccactgcttcaccagcctgtggtggatctacatggccaagctgtgcgaggagatcggcaagaagaagctgcccctgaccaaggacatgagagagcagggcgtgaagagcaacccctgcgacagcagcctgagccacaccgacagatggtacctgcccgtgagcagcaccctgttcagcctgttcaagatcctgttccacgccagcagattcatcttcgtgctgagcaccagcctgttcctgtag

SEQ ID NO: 105049 - DNA, 663 bp, Artificial Sequence
  Description of Artificial Sequence: Synthetic coding sequence
atggccatcctgttcgccgtggtggccagaggcaccaccatcctggccaagcacgcctggtgcggcggcaacttcctggaggtgaccgagcagatcctggccaagatccccagcgagaacaacaagctgacctacagccacggcaactacctgttccactacatctgccaggacagaatcgtgtacctgtgcatcaccgacgacgacttcgagagaagcagagccttcaacttcctgaacgagatcaagaagagattccagaccacctacggcagcagagcccagaccgccctgccctacgccatgaacagcgagttcagcagcgtgctggccgcccagctgaagcaccacagcgagaacaagggcctggacaaggtgatggagacccaggcccaggtggacgagctgaagggcatcatggtgagaaacatcgacctggtggcccagagaggcgagagactggagctgctgatcgacaagaccgagaacctggtggacagcagcgtgaccttcaagaccaccagcagaaacctggccagagccatgtgcatgaagaacctgaagctgaccatcatcatcatcatcgtgagcatcgtgttcatctacatcatcgtgagccccctgtgcggcggcttcacctggcccagctgcgtgaagaagtag

SEQ ID NO: 105050 - DNA, 540 bp, Artificial Sequence
  Description of Artificial Sequence: Synthetic coding sequence
atggccatcctgttcgccgtggtggccagaggcaccaccatcctggccaagcacgcctggtgcggcggcaacttcctggaggacttcgagagaagcagagccttcaacttcctgaacgagatcaagaagagattccagaccacctacggcagcagagcccagaccgccctgccctacgccatgaacagcgagttcagcagcgtgctggccgcccagctgaagcaccacagcgagaacaagggcctggacaaggtgatggagacccaggcccaggtggacgagctgaagggcatcatggtgagaaacatcgacctggtggcccagagaggcgagagactggagctgctgatcgacaagaccgagaacctggtggacagcagcgtgaccttcaagaccaccagcagaaacctggccagagccatgtgcatgaagaacctgaagctgaccatcatcatcatcatcgtgagcatcgtgttcatctacatcatcgtgagccccctgtgcggcggcttcacctggcccagctgcgtgaagaagtag

SEQ ID NO: 105051 - DNA, 303 bp, Artificial Sequence
  Description of Artificial Sequence: Synthetic coding sequence
atggaggaggccagcgagggcggcggcaacgacagagtgagaaacctgcagagcgaggtggagggcgtgaagaacatcatgacccagaacgtggagagaatcctggccagaggcgagaacctggagcacctgagaaacaagaccgaggacctggaggccaccagcgagcacttcaagaccaccagccagaaggtggccagaaagttctggtggaagaacgtgaagatgatcgtgctgatctgcgtgatcgtgttcatcatcatcctgttcatcgtgctgttcgccaccggcgccttcagctag

SEQ ID NO: 105052 - DNA, 777 bp, Artificial Sequence
  Description of Artificial Sequence: Synthetic coding sequence
atggaggagatgaagaagaccgccatcagactgcccaagggcaagcagaagcccatcaagaccgagtggaacagcagatgcgtgctgttcacctacttccagggcgacatcagcagcgtggtggacgagcacttcagcagagccctgagcaacatcaagagcccccaggagctgacccccagcagccagagcgagggcgtgatgctgaagaacgacgacagcatgagccccaaccagtggagatacagcagcccctggaccaagccccagcccgaggtgcccgtgaccaacagagccgccaactgcaacctgcacgtgcccggccccatggccgtgaaccagttcagccccagcctggccagaagagccagcgtgagacccggcgagctgtggcacttcagcagcctggccggcaccagcagcctggagcccggctacagccaccccttccccgccagacacctggtgcccgagccccagcccgacggcaagagagagcccctgctgagcctgctgcagcaggacagatgcctggccagaccccaggagagcgccgccagagagaacggcaaccccggccagatcgccggcagcaccggcctgctgttcaacctgccccccggcagcgtgcactacaagaagctgtacgtgagcagaggcagcgccagcaccagcctgcccaacgagaccctgagcgagctggagacccccggcaagtacagcctgaccccccccaaccactggggccacccccacagatacctgcagcacctgtag

SEQ ID NO: 105053 - DNA, 348 bp, Artificial Sequence
  Description of Artificial Sequence: Synthetic coding sequence
atgaagaagaccgccatcagactgcccaagggcaagcagaagcccatcaagaccgagtggaacagcagatgcgtgctgttcacctacttccagggcgacatcagcagcgtggtggacgagcacttcagcagagccctgagcaacatcaagagcccccaggagctgacccccagcagccagagcgagggcgtgatgctgaagaacgacaagaagctgtacgtgagcagaggcagcgccagcaccagcctgcccaacgagaccctgagcgagctggagacccccggcaagtacagcctgaccccccccaaccactggggccacccccacagatacctgcagcacctgtag

SEQ ID NO: 105054 - DNA, 492 bp, Artificial Sequence
  Description of Artificial Sequence: Synthetic coding sequence
tgaatcagcagcgtggtggacgagcacttcagcagagccctgagcaacatcaagagcccccaggagctgacccccagcagccagagcgagggcgtgatgctgaagaacgacgacagcatgagccccaaccagtggagatacagcagcccctggaccaagccccagcccgaggtgcccgtgaccaacagagccgccaactgcaacctgcacgtgcccggccccatggccgtgaaccagttcagccccagcctggccagaagagccagcgtgagacccggcgagctgtggcacttcagcagcctggccggcaccagcagcctggagcccggctacagccaccccttccccgccagacacctggtgcccgagccccagcccgacggcaagcacaagaagctgtacgtgagcagaggcagcgccagcaccagcctgcccaacgagaccctgagcgagctggagacccccggcaagtacagcctgacccccccctag

SEQ ID NO: 105055 - DNA, 183 bp, Artificial Sequence
  Description of Artificial Sequence: Synthetic coding sequence
acccccagcagccagagcgagggcgtgatgctgaagaacgacaagaagctgtacgtgagcagaggcagcgccagcaccagcctgcccaacgagaccctgagcgagctggagacccccggcaagtacagcctgaccccccccaaccactggggccacccccacagatacctgcagcacctgtag

SEQ ID NO: 105056 - DNA, 954 bp, Artificial Sequence
  Description of Artificial Sequence: Synthetic coding sequence
atgagctgcctggacgtgatgtaccaggtgtacggccccccccagccctacttcgccgccgcctacaccccctaccaccagaagctggcctactacagcaagatgcaggaggcccaggagtgcaacgccagccccagcagcagcggcagcggcagcagcagcttcagcagccagacccccgccagcatcaaggaggaggagggcagccccgagaaggagagaccccccgaggccgagtacatcaacagcagatgcgtgctgttcacctacttccagggcgacatcagcagcgtggtggacgagcacttcagcagagccctgagccagcccagcagctacagccccagctgcaccagcagcaaggcccccagaagcagcggcccctggagagactgcagcttccccatgagccagagaagcttccccgccagcttctggaacagcgcctaccaggcccccgtgcccccccccctgggcagccccctggccaccgcccacagcgagctgcccttcgccgccgccgacccctacagccccgccgccctgcacggccacctgcaccagggcgccaccgagccctggcaccacgcccacccccaccacgcccacccccaccacccctacgccctgggcggcgccctgggcgcccaggccgccccctaccccagacccgccgccgtgcacgaggtgtacgccccccacttcgaccccagatacggccccctgctgatgcccgccgccagcggcagacccgccagactggccaccgcccccgcccccgcccccggcagccccccctgcgagctgagcggcaagggcgagcccgccggcgccgcctgggccggccccggcggccccttcgccagccccagcggcgacgtggcccagggcctgggcctgagcgtggacagcgccagaagatacagcctgtgcggcgccagcctgctgagctag

SEQ ID NO: 105057 - DNA, 432 bp, Artificial Sequence
  Description of Artificial Sequence: Synthetic coding sequence
atgagctgcctggacgtgatgtaccaggtgtacggccccccccagccctacttcgccgccgcctacaccccctaccaccagaagctggcctactacagcaagatgcaggaggcccaggagtgcaacgccagccccagcagcagcggcagcggcagcagcagcttcagcagccagacccccgccagcatcaaggaggaggagggcagccccgagaaggagagaccccccgaggccgagtacatcaacagcagatgcgtgctgttcacctacttccagggcgacatcagcagcgtggtggacgagcacttcagcagagccctgagccagcccagcagctacagccccagctgcaccagcagcaaggcccccagaagcagcggcccctggagagccagaagatacagcctgtgcggcgccagcctgctgagctag

SEQ ID NO: 105058 - DNA, 963 bp, Artificial Sequence
  Description of Artificial Sequence: Synthetic coding sequence
atgagctgcgccgaggtgatgtaccacccccagccctacggcgccagccagtacctgcccaaccccatggccgccaccacctgccccaccgcctactaccagcccgccccccagcccggccagcagaagaagctggccgtgttcagcaagatgcaggacagcctggaggtgaccctgcccagcaagcaggaggaggaggacgaggaggaggaggaggaggagaaggaccagcccgccgagatggagtacctgaacagcagatgcgtgctgttcacctacttccagggcgacatcggcagcgtggtggacgagcacttcagcagagccctgggccaggccatcaccctgcaccccgagagcgccatcagcaagagcaagatgggcctgacccccctgtggagagacagcagcgccctgagcagccagagaaacagcttccccaccagcttctggaccagcagctaccagcccccccccgccccctgcctgggcggcgtgcaccccgacttccaggtgaccggcccccccggcaccttcagcgccgccgaccccagcccctggcccggccacaacctgcaccagaccggccccgcccccccccccgccgtgagcgagagctggccctaccccctgaccagccaggtgagccccagctacagccacatgcacgacgtgtacatgagacaccaccacccccacgcccacatgcaccacagacacagacaccaccaccaccaccaccacccccccgccggcagcgccctggaccccagctacggccccctgctgatgcccagcgtgcacgccgccagaatccccgccccccagtgcgacatcaccaagaccgagcccaccaccgtgaccagcgccaccagcgcctgggccggcgccttccacggcaccgtggacatcgtgcccagcgtgggcttcgacaccggctggagcgccatggccagaagctag

SEQ ID NO: 105059 - DNA, 981 bp, Artificial Sequence
  Description of Artificial Sequence: Synthetic coding sequence
atgagctgcgccgaggtgatgtaccacccccagccctacggcgccagccagtacctgcccaaccccatggccgccaccacctgccccaccgcctactaccagcccgccccccagcccggccagcagaagaagctggccgtgttcagcaagatgcaggacagcctggaggtgaccctgcccagcaagcaggaggaggaggacgaggaggaggaggaggaggagaaggaccagcccgccgagatggagtacctgaacagcagatgcgtgctgttcacctacttccagggcgacatcggcagcgtggtggacgagcacttcagcagagccctgggccaggccatcaccctgcaccccgagagcgccatcagcaagagcaagatgggcctgacccccctgtggagagacagcagcgccctgagcagccagagaaacagcttccccaccagcttctggaccagcagctaccagcccccccccgccccctgcctgggcggcgtgcaccccgacttccaggtgaccggcccccccggcaccttcagcgccgccgaccccagcccctggcccggccacaacctgcaccagaccggccccgcccccccccccgccgtgagcgagagctggccctaccccctgaccagccaggtgagccccagctacagccacatgcacgacgtgtacatgagacaccaccacccccacgcccacatgcaccacagacacagacaccaccaccaccaccaccacccccccgccggcagcgccctggaccccagctacggccccctgctgatgcccagcgtgcacgccgccagaatccccgccccccagtgcgacatcaccaagaccgagcccaccaccgtgaccagcgccaccagcgcctgggccggcgccttccacggcaccgtggacatcgtgcccagcgtgggcttcgacaccggcctgcagcaccaggacaagagcaaggagagcccctggtactag

SEQ ID NO: 105060 - DNA, 1326 bp, Artificial Sequence
  Description of Artificial Sequence: Synthetic coding sequence
atgaaggccgccgtggacctgaagcccaccctgaccatcatcaagaccgagaaggtggacctggagctgttccccagccccgacatggagtgcgccgacgtgcccctgctgacccccagcagcaaggagatgatgagccaggccctgaaggccaccttcagcggcttcaccaaggagcagcagagactgggcatccccaaggaccccagacagtggaccgagacccacgtgagagactgggtgatgtgggccgtgaacgagttcagcctgaagggcgtggacttccagaagttctgcatgaacggcgccgccctgtgcgccctgggcaaggactgcttcctggagctggcccccgacttcgtgggcgacatcctgtgggagcacctggagatcctgcagaaggaggacgtgaagccctaccaggtgaacggcgtgaaccccgcctaccccgagagcagatacaccagcgactacttcatcagctacggcatcgagcacgcccagtgcgtgccccccagcgagttcagcgagcccagcttcatcaccgagagctaccagaccctgcaccccatcagcagcgaggagctgctgagcctgaagtacgagaacgactaccccagcgtgatcctgagagaccccctgcagaccgacaccctgcagaacgactacttcgccatcaagcaggaggtggtgacccccgacaacatgtgcatgggcagaaccagcagaggcaagctgggcggccaggacagcttcgagagcatcgagagctacgacagctgcgacagactgacccagagctggagcagccagagcagcttcaacagcctgcagagagtgcccagctacgacagcttcgacagcgaggactaccccgccgccctgcccaaccacaagcccaagggcaccttcaaggactacgtgagagacagagccgacctgaacaaggacaagcccgtgatccccgccgccgccctggccggctacaccggcagcggccccatccagctgtggcagttcctgctggagctgctgaccgacaagagctgccagagcttcatcagctggaccggcgacggctgggagttcaagctgagcgaccccgacgaggtggccagaagatggggcaagagaaagaacaagcccaagatgaactacgagaagctgagcagaggcctgagatactactacgacaagaacatcatccacaagaccgccggcaagagatacgtgtacagattcgtgtgcgacctgcagagcctgctgggctacacccccgaggagctgcacgccatgctggacgtgaagcccgacgccgacgagtag

SEQ ID NO: 105061 - DNA, 1065 bp, Artificial Sequence
  Description of Artificial Sequence: Synthetic coding sequence
atgaaggccgccgtggacctgaagcccaccctgaccatcatcaagaccgagaaggtggacctggagctgttccccagccccgacatggagtgcgccgacgtgcccctgctgacccccagcagcaaggagatgatgagccaggccctgaaggccaccttcagcggcttcaccaaggagcagcagagactgggcatccccaaggaccccagacagtggaccgagacccacgtgagagactgggtgatgtgggccgtgaacgagttcagcctgaagggcgtggacttccagaagttctgcatgaacggcgccgccctgtgcgccctgggcaaggactgcttcctggagctggcccccgacttcgtgggcgacatcctgtgggagcacctggagatcctgcagaaggaggacgtgaagccctaccaggtgaacggcgtgaaccccgcctaccccgagagcagatacaccagcgactacttcatcagctacggcatcgagcacgcccagtgcgtgccccccagcgagttcagcgagcccagcttcatcaccgagagctaccagaccctgcaccccatcagcagcgaggagctgctgagcctgaagtacgagaacgactaccccagcgtgatcctgagagaccccctgcagaccgacaccctgcagaacgactacttcgccatcaagcaggaggtggtgacccccgacaacatgtgcatgggcagaaccagcagaggcagcggccccatccagctgtggcagttcctgctggagctgctgaccgacaagagctgccagagcttcatcagctggaccggcgacggctgggagttcaagctgagcgaccccgacgaggtggccagaagatggggcaagagaaagaacaagcccaagatgaactacgagaagctgagcagaggcctgagatactactacgacaagaacatcatccacaagaccgccggcaagagatacgtgtacagattcgtgtgcgacctgcagagcctgctgggctacacccccgaggagctgcacgccatgctggacgtgaagcccgacgccgacgagtag

SEQ ID NO: 105062 - DNA, 1458 bp, Artificial Sequence
  Description of Artificial Sequence: Synthetic coding sequence
atgagctacttcgtggacagcgccggcagcagccccgtgccctacagcgcccccagacccgccgtggtgagacagggccccagcaacacctacgaggaccccagaatgaactgcggcttccagagcaactaccaccagcagagaccctgctaccccttctgggacgagatggccacccaggaggtgcccaccggcctggagcactgcgtgagcgacatggagtgcgccgacgtgcccctgctgacccccagcagcaaggagatgatgagccaggccctgaaggccaccttcagcggcttcaccaaggagcagcagagactgggcatccccaaggaccccagacagtggaccgagacccacgtgagagactgggtgatgtgggccgtgaacgagttcagcctgaagggcgtggacttccagaagttctgcatgaacggcgccgccctgtgcgccctgggcaaggactgcttcctggagctggcccccgacttcgtgggcgacatcctgtgggagcacctggagatcctgcagaaggaggacgtgaagccctaccaggtgaacggcgtgaaccccgcctaccccgagagcagatacaccagcgactacttcatcagctacggcatcgagcacgcccagtgcgtgccccccagcgagttcagcgagcccagcttcatcaccgagagctaccagaccctgcaccccatcagcagcgaggagctgctgagcctgaagtacgagaacgactaccccagcgtgatcctgagagaccccctgcagaccgacaccctgcagaacgactacttcgccatcaagcaggaggtggtgacccccgacaacatgtgcatgggcagaaccagcagaggcaagctgggcggccaggacagcttcgagagcatcgagagctacgacagctgcgacagactgacccagagctggagcagccagagcagcttcaacagcctgcagagagtgcccagctacgacagcttcgacagcgaggactaccccgccgccctgcccaaccacaagcccaagggcaccttcaaggactacgtgagagacagagccgacctgaacaaggacaagcccgtgatccccgccgccgccctggccggctacaccggcagcggccccatccagctgtggcagttcctgctggagctgctgaccgacaagagctgccagagcttcatcagctggaccggcgacggctgggagttcaagctgagcgaccccgacgaggtggccagaagatggggcaagagaaagaacaagcccaagatgaactacgagaagctgagcagaggcctgagatactactacgacaagaacatcatccacaagaccgccggcaagagatacgtgtacagattcgtgtgcgacctgcagagcctgctgggctacacccccgaggagctgcacgccatgctggacgtgaagcccgacgccgacgagtag

SEQ ID NO: 105063 - DNA, 1065 bp, Artificial Sequence; identical to SEQ ID NO: 105061
  Description of Artificial Sequence: Synthetic coding sequence

SEQ ID NO: 105064 - DNA, 819 bp, Artificial Sequence
  Description of Artificial Sequence: Synthetic coding sequence
atgaaggccgccgtggacctgaagcccaccctgaccatcatcaagaccgagaaggtggacctggagctgttccccagccccgacatggagtgcgccgacgtgcccctgctgacccccagcagcaaggagatgatgagccaggccctgaaggccaccttcagcggcttcaccaaggagcagcagagactgggcatccccaaggaccccagacagtggaccgagacccacgtgagagactgggtgatgtgggccgtgaacgagttcagcctgaagggcgtggacttccagaagttctgcatgaacggcgccgccctgtgcgccctgggcaaggactgcttcctggagctggcccccgacttcgtgggcgacatcctgtgggagcacctggagatcctgcagaaggaggacgtgaagccctaccaggtgaacggcgtgaaccccgcctaccccgagagcagatacaccagcgactacttcatcagctacggcatcgagcacgcccagtgcgtgccccccagcgagttcagcgagcccagcttcatcaccgagagctaccagaccctgcaccccatcagcagcgaggagctgctgagcctgaagtacgagaacgactaccccagcgtgatcctgagagaccccctgcagaccgacaccctgcagaacgactacttcgccatcaagcaggaggtggtgacccccgacaacatgtgcatgggcagaaccagcagaggcaagctgggcggccaggacagcttcgagagcatcgagagctacgacagctgcggccaggagatgggcaaggaggagaagcagacctag

SEQ ID NO: 105065 - DNA, 678 bp, Artificial Sequence
  Description of Artificial Sequence: Synthetic coding sequence
atgaaggccgccgtggacctgaagcccaccctgaccatcatcaagaccgagaaggtggacctggagctgttccccagccccggcaagctgggcggccaggacagcttcgagagcatcgagagctacgacagctgcgacagactgacccagagctggagcagccagagcagcttcaacagcctgcagagagtgcccagctacgacagcttcgacagcgaggactaccccgccgccctgcccaaccacaagcccaagggcaccttcaaggactacgtgagagacagagccgacctgaacaaggacaagcccgtgatccccgccgccgccctggccggctacaccggcagcggccccatccagctgtggcagttcctgctggagctgctgaccgacaagagctgccagagcttcatcagctggaccggcgacggctgggagttcaagctgagcgaccccgacgaggtggccagaagatggggcaagagaaagaacaagcccaagatgaactacgagaagctgagcagaggcctgagatactactacgacaagaacatcatccacaagaccgccggcaagagatacgtgtacagattcgtgtgcgacctgcagagcctgctgggctacacccccgaggagctgcacgccatgctggacgtgaagcccgacgccgacgagtag

SEQ ID NO: 105066 - DNA, 1848 bp, Artificial Sequence
  Description of Artificial Sequence: Synthetic coding sequence
atgaaggccctgagactgagcgccagcgccctgttctgcctgctgctgatcaacggcctgggcgccgccccccccggcagacccgaggcccagcccccccccctgagcagcgagcacaaggagcccgtggccggcgacgccgtgcccggccccaaggacggcagcgcccccgaggtgagaggcgccagaaacagcgagccccaggacgagggcgagctgttccagggcgtggaccccagagccctggccgccgtgctgctgcaggccctggacagacccgccagcccccccgcccccagcggcagccagcagggccccgaggaggaggccgccgaggccctgctgaccgagaccgtgagaagccagacccacagcctgcccgcccccgagagccccgagcccgccgccccccccagaccccagacccccgagaacggccccgaggccagcgaccccagcgaggagctggaggccctggccagcctgctgcaggagctgagagacttcagccccagcagcgccaagagacagcaggagaccgccgccgccgagaccgagaccagaacccacaccctgaccagagtgaacctggagagccccggccccgagagagtgtggagagccagctggggcgagttccaggccagagtgcccgagagagcccccctgcccccccccgcccccagccagttccaggccagaatgcccgacagcggccccctgcccgagacccacaagttcggcgagggcgtgagcagccccaagacccacctgggcgaggccctggcccccctgagcaaggcctaccagggcgtggccgcccccttccccaaggccagaagacccgagagcgccctgctgggcggcagcgaggccggcgagagactgctgcagcagggcctggcccaggtggaggccggcagaagacaggccgaggccaccagacaggccgccgcccaggaggagagactggccgacctggccagcgacctgctgctgcagtacctgctgcagggcggcgccagacagagaggcctgggcggcagaggcctgcaggaggccgccgaggagagagagagcgccagagaggaggaggaggccgagcaggagagaagaggcggcgaggagagagtgggcgaggaggacgaggaggccgccgaggccgaggccgaggccgaggaggccgagagagccagacagaacgccctgctgttcgccgaggaggaggacggcgaggccggcgccgaggacaagagaagccaggaggagacccccggccacagaagaaaggaggccgagggcaccgaggagggcggcgaggaggaggacgacgaggagatggacccccagaccatcgacagcctgatcgagctgagcaccaagctgcacctgcccgccgacgacgtggtgagcatcatcgaggaggtggaggagaagagaaagagaaagaagaacgccccccccgagcccgtgcccccccccagagccgcccccgcccccacccacgtgagaagcccccagccccccccccccgcccccgcccccgccagagacgagctgcccgactggaacgaggtgctgcccccctgggacagagaggaggacgaggtgtacccccccggcccctaccaccccttccccaactacatcagacccagaaccctgcagccccccagcgccctgagaagaagacactaccaccacgccctgccccccagcagacactaccccggcagagaggcccaggccagaagagcccaggaggaggccgaggccgaggagagaagactgcaggagcaggaggagctggagaactacatcgagcacgtgctgctgagaagaccctag

SEQ ID NO: 105067 - DNA, 1848 bp, Artificial Sequence; identical to SEQ ID NO: 105066
  Description of Artificial Sequence: Synthetic coding sequence

SEQ ID NO: 105068 - DNA, 1134 bp, Artificial Sequence
  Description of Artificial Sequence: Synthetic coding sequence
atgaaggccctgagactgagcgccagcgccctgttctgcctgctgctgatcaacggcctgggcgccgccccccccggcagacccgaggcccagcccccccccctgagcagcgagcacaaggagcccgtggccggcgacgccgtgcccggccccaaggacggcagcgcccccgaggtgagaggcgccagaaacagcgagccccaggacgagggcgagctgttccagggcgtggaccccagagccctggccgccgtgctgctgcaggccctggacagacccgccagcccccccgcccccagcggcagccagcagggccccgaggaggaggccgccgaggccctgctgaccgagaccgtgagaagccagacccacagcctgcccgcccccgagagccccgagcccgccgccccccccagaccccagacccccgagaacggccccgaggccagcgaccccagcgaggagctggaggccctggccagcctgctgcaggagctgagagacttcagccccagcagcgccaagagacagcaggagaccgccgccgccgagaccgagaccagaacccacaccctgaccagagtgaacctggagagccccggccccgagagagtgtggagagccagctggggcgagttccaggccagagtgcccgagagagcccccctgcccccccccgcccccagccagttccaggccagaatgcccgacagcggccccctgcccgagacccacaagttcggcgagggcgtgagcagccccaagacccacctgggcgaggccctggcccccctgagcaaggcctaccagggcgtggccgcccccttccccaaggccagaagacccgagagcgccctgctgggcggcagcgaggccggcgagagactgctgcagcagggcctggcccaggtggaggccggcagaagacaggccgaggccaccagacaggccgccgcccaggaggagagactggccgacctggccagcgacctgctgctgcagttcgccgccggcagaggccccgccgccagaccctgccccctggccctgcccctgagccccggctgcgtgggcacctgccagacccccctgcccggccccgagcccgagctgcccgagctgaccagaggctag

SEQ ID NO: 105069 - DNA, 2484 bp, Artificial Sequence
  Description of Artificial Sequence: Synthetic coding sequence
atgaccaagctgagcgcccaggtgaagggcagcctgaacatcaccacccccggcctgcagatctggagaatcgaggccatgcagatggtgcccgtgcccagcagcaccttcggcagcttcttcgacggcgactgctacatcatcctggccatccacaagaccgccagcagcctgagctacgacatccactactggatcggccaggacagcagcctggacgagcagggcgccgccgccatctacaccacccagatggacgacttcctgaagggcagagccgtgcagcacagagaggtgcagggcaacgagagcgaggccttcagaggctacttcaagcagggcctggtgatcagaaagggcggcgtggccagcggcatgaagcacgtggagaccaacagctacgacgtgcagagactgctgcacgtgaagggcaagagaaacgtggtggccggcgaggtggagatgagctggaagagcttcaacagaggcgacgtgttcctgctggacctgggcaagctgatcatccagtggaacggccccgagagcaccagaatggagagactgagaggcatgaccctggccaaggagatcagagaccaggagagaggcggcagaacctacgtgggcgtggtggacggcgagaacgagctggccagccccaagctgatggaggtgatgaaccacgtgctgggcaagagaagagagctgaaggccgccgtgcccgacaccgtggtggagcccgccctgaaggccgccctgaagctgtaccacgtgagcgacagcgagggcaacctggtggtgagagaggtggccaccagacccctgacccaggacctgctgagccacgaggactgctacatcctggaccagggcggcctgaagatctacgtgtggaagggcaagaaggccaacgagcaggagaagaagggcgccatgagccacgccctgaacttcatcaaggccaagcagtacccccccagcacccaggtggaggtgcagaacgacggcgccgagagcgccgtgttccagcagctgttccagaagtggaccgccagcaacagaaccagcggcctgggcaagacccacaccgtgggcagcgtggccaaggtggagcaggtgaagttcgacgccaccagcatgcacgtgaagccccaggtggccgcccagcagaagatggtggacgacggcagcggcgaggtgcaggtgtggagaatcgagaacctggagctggtgcccgtggacagcaagtggctgggccacttctacggcggcgactgctacctgctgctgtacacctacctgatcggcgagaagcagcactacctgctgtacgtgtggcagggcagccaggccagccaggacgagatcaccgccagcgcctaccaggccgtgatcctggaccagaagtacaacggcgagcccgtgcagatcagagtgcccatgggcaaggagcccccccacctgatgagcatcttcaagggcagaatggtggtgtaccagggcggcaccagcagaaccaacaacctggagaccggccccagcaccagactgttccaggtgcagggcaccggcgccaacaacaccaaggccttcgaggtgcccgccagagccaacttcctgaacagcaacgacgtgttcgtgctgaagacccagagctgctgctacctgtggtgcggcaagggctgcagcggcgacgagagagagatggccaagatggtggccgacaccatcagcagaaccgagaagcaggtggtggtggagggccaggagcccgccaacttctggatggccctgggcggcaaggccccctacgccaacaccaagagactgcaggaggagaacctggtgatcacccccagactgttcgagtgcagcaacaagaccggcagattcctggccaccgagatccccgacttcaaccaggacgacctggaggaggacgacgtgttcctgctggacgtgtgggaccaggtgttcttctggatcggcaagcacgccaacgaggaggagaagaaggccgccgccaccaccgcccaggagtacctgaagacccaccccagcggcagagaccccgagacccccatcatcgtggtgaagcagggccacgagccccccaccttcaccggctggttcctggcctgggaccccttcaagtggagcaacaccaagagctacgaggacctgaaggccgagctgggcaacagcagagactggagccagatcaccgccgaggtgaccagccccaaggtggacgtgttcaacgccaacagcaacctgagcagcggccccctgcccatcttccccctggagcagctggtgaacaagcccgtggaggagctgcccgagggcgtggaccccagcagaaaggaggagcacctgagcatcgaggacttcacccaggccttcggcatgacccccgccgccttcagcgccctgcccagatggaagcagcagaacctgaagaaggagaagggcctgttctag

SEQ ID NO: 105070 - DNA, 1551 bp, Artificial Sequence
  Description of Artificial Sequence: Synthetic coding sequence
atgagccacgccctgaacttcatcaaggccaagcagtacccccccagcacccaggtggaggtgcagaacgacggcgccgagagcgccgtgttccagcagctgttccagaagtggaccgccagcaacagaaccagcggcctgggcaagacccacaccgtgggcagcgtggccaaggtggagcaggtgaagttcgacgccaccagcatgcacgtgaagccccaggtggccgcccagcagaagatggtggacgacggcagcggcgaggtgcaggtgtggagaatcgagaacctggagctggtgcccgtggacagcaagtggctgggccacttctacggcggcgactgctacctgctgctgtacacctacctgatcggcgagaagcagcactacctgctgtacgtgtggcagggcagccaggccagccaggacgagatcaccgccagcgcctaccaggccgtgatcctggaccagaagtacaacggcgagcccgtgcagatcagagtgcccatgggcaaggagcccccccacctgatgagcatcttcaagggcagaatggtggtgtaccagggcggcaccagcagaaccaacaacctggagaccggccccagcaccagactgttccaggtgcagggcaccggcgccaacaacaccaaggccttcgaggtgcccgccagagccaacttcctgaacagcaacgacgtgttcgtgctgaagacccagagctgctgctacctgtggtgcggcaagggctgcagcggcgacgagagagagatggccaagatggtggccgacaccatcagcagaaccgagaagcaggtggtggtggagggccaggagcccgccaacttctggatggccctgggcggcaaggccccctacgccaacaccaagagactgcaggaggagaacctggtgatcacccccagactgttcgagtgcagcaacaagaccggcagattcctggccaccgagatccccgacttcaaccaggacgacctggaggaggacgacgtgttcctgctggacgtgtgggaccaggtgttcttctggatcggcaagcacgccaacgaggaggagaagaaggccgccgccaccaccgcccaggagtacctgaagacccaccccagcggcagagaccccgagacccccatcatcgtggtgaagcagggccacgagccccccaccttcaccggctggttcctggcctgggaccccttcaagtggagcaacaccaagagctacgaggacctgaaggccgagctgggcaacagcagagactggagccagatcaccgccgaggtgaccagccccaaggtggacgtgttcaacgccaacagcaacctgagcagcggccccctgcccatcttccccctggagcagctggtgaacaagcccgtggaggagctgcccgagggcgtggaccccagcagaaaggaggagcacctgagcatcgaggacttcacccaggccttcggcatgacccccgccgccttcagcgccctgcccagatggaagcagcagaacctgaagaaggagaagggcctgttctag

SEQ ID NO: 105071 - DNA, 1266 bp, Artificial Sequence
  Description of Artificial Sequence: Synthetic coding sequence
atgaccaagctgagcgcccaggtgaagggcagcctgaacatcaccacccccggcctgcagatctggagaatcgaggccatgcagatggtgcccgtgcccagcagcaccttcggcagcttcttcgacggcgactgctacatcatcctggccatccacaagaccgccagcagcctgagctacgacatccactactggatcggccaggacagcagcctggacgagcagggcgccgccgccatctacaccacccagatggacgacttcctgaagggcagagccgtgcagcacagagaggtgcagggcaacgagagcgaggccttcagaggctacttcaagcagggcctggtgatcagaaagggcggcgtggccagcggcatgaagcacgtggagaccaacagctacgacgtgcagagactgctgcacgtgaagggcaagagaaacgtggtggccggcgaggtggagatgagctggaagagcttcaacagaggcgacgtgttcctgctggacctgggcaagctgatcatccagtggaacggccccgagagcaccagaatggagagactgagaggcatgaccctggccaaggagatcagagaccaggagagaggcggcagaacctacgtgggcgtggtggacggcgagaacgagctggccagccccaagctgatggaggtgatgaaccacgtgctgggcaagagaagagagctgaaggccgccgtgcccgacaccgtggtggagcccgccctgaaggccgccctgaagctgtaccacgtgagcgacagcgagggcaacctggtggtgagagaggtggccaccagacccctgacccaggacctgctgagccacgaggactgctacatcctggaccagggcggcctgaagatctacgtgtggaagggcaagaaggccaacgagcaggagaagaagggcgccatgagccacgccctgaacttcatcaaggccaagcagtacccccccagcacccaggtggaggtgcagaacgacggcgccgagagcgccgtgttccagcagctgttccagaagtggaccgccagcaacagaaccagcggcctgggcaagacccacaccgtgggcagcgtgggcgagggccaggccggcgccgtgagagagcccggcagcagaagctgggccagaagagccacctggagcaccacccacccccccagcctgacctgcatcttcaacgaggacttctacgccggcagcggcctggtgctggccgacggcgacgtggacaagctgtag

SEQ ID NO: 105072 - DNA, 576 bp, Artificial Sequence
  Description of Artificial Sequence: Synthetic coding sequence
atgggcaagcagaacagcaagctggcccccgaggtgatggaggacctggtgaagagcaccgagttcaacgagcacgagctgaagcagtggtacaagggcttcctgaaggactgccccagcggcagactgaacctggaggagttccagcagctgtacgtgaagttcttcccctacggcgacgccagcaagttcgcccagcacgccttcagaaccttcgacaagaacggcgacggcaccatcgacttcagagagttcatctgcgccctgagcatcaccagcagaggcagcttcgagcagaagctgaactgggccttcaacatgtacgacctggacggcgacggcaagatcaccagagtggagatgctggagatcatcgaggccatctacaagatggtgggcaccgtgatcatgatgaagatgaacgaggacggcctgacccccgagcagagagtggacaagatcttcagcaagatggacaagaacaaggacgaccagatcaccctggacgagttcaaggaggccgccaagagcgaccccagcatcgtgctgctgctgcagtgcgacatccagaagtag

SEQ ID NO: 105073 - DNA, 576 bp, Artificial Sequence; identical to SEQ ID NO: 105072
  Description of Artificial Sequence: Synthetic coding sequence

SEQ ID NO: 105074 - DNA, 576 bp, Artificial Sequence; identical to SEQ ID NO: 105072
  Description of Artificial Sequence: Synthetic coding sequence

SEQ ID NO: 105075 - DNA, 315 bp, Artificial Sequence
  Description of Artificial Sequence: Synthetic coding sequence
atgggcaagcagaacagcaagctggcccccgaggtgatggaggacctggtgaagagcaccgagttcaacgagcacgagctgaagcagtggtacaagggcttcctgaaggactgccccagcggcagactgaacctggaggagttccagcagctgtacgtgaagttcttcccctacggcgacgccagcaagttcgcccagcacgccttcagaaccttcgacaagaacggcgacggcaccatcgacttcagagagttcatctgcgccctgagcatcaccagcagaggcagcttcgagcagaagctgaactgggcctag

SEQ ID NO: 105076 - DNA, 357 bp, Artificial Sequence
  Description of Artificial Sequence: Synthetic coding sequence
atgggcaagcagaacagcaagctggcccccgaggtgatggaggacctggtgaagagcaccgagttcaacgagcacgagctgaagcagtggtacaagggcttcctgaaggactgccccagcggcagactgaacctggaggagttccagcagctgtacgtgaagttcttcccctacggcgacgccagcaagttcgcccagcacgccttcagaaccttcgacaagaacggcgacggcaccatcgacttcagagagttcatctgcgccctgagcatcaccagcagaggcagcttcgagcagaagctgaactgggccttcaacatgtacgacctggacggcgacggcaagatcaccagatag

SEQ ID NO: 105077 - DNA, 720 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccaggtgagcggcgtgcccttcctgagaagcaaggacaccaccgagaacgtgagcttcccccacagcgtgagccagagcgccgtgcccagcctgtag

SEQ ID NO: 105078 - DNA, 1098 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccaggtgtggttccagaacagaagagccaagtggagaaagagagagaagagatggggcggcagcagcgtgatggccgagtacggcctgtacggcgccatggtgagacactgcatccccctgcccgacagcgtgctgaacagcgccgagggcggcctgctgggcagctgcgccccctggctgctgggcatgcacaagaagagcatgggcatgatcagaaagcccggcagcgaggacaagctggccggcctgtggggcagcgaccacttcaaggagggcagcagccagagcgagagcggcagccagagaggcagcgacaaggtgagccccgagaacggcctggaggacgtggccatcgacctgagcagcagcgccagacaggagaccaagaaggtgcaccccggcgccggcgcccagggcggcagcaacagcaccgccctggagggcccccagcccggcaaggtgggcgccacctag

SEQ ID NO: 105079 - DNA, 432 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgccatgtag

SEQ ID NO: 105080 - DNA, 843 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccaggtgtggttccagaacagaagagccaagtggagaaagagagagaagagatggggcggcagcagcgtgatggccgagtacggcctgtacggcgccatggtgagacactgcatccccctgcccgacagcgtgctgaacagcgccgagggcggcctgctgggcagctgcgccccctggctgctggagggcgagaccctgggctgcagagagatgaagtag

SEQ ID NO: 105081 - DNA, 657 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccagagagtgagacactgggccgccgagaagtag

SEQ ID NO: 105082 - DNA, 906 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccaggtgtggttccagaacagaagagccaagtggagaaagagagagaagagatggggcggcagcagcgtgatggccgagtacggcctgtacggcgccatggtgagacactgcatccccctgcccgacagcgtgctgaacagcgccgagggcggcctgctgggcagctgcgccccctggctgctggtgcagaccagcgcccccggcggcagcagaagcctggacttcgccggcgacacccaggccccccagaccccctggtggtgcctgatgaccttcagctag

SEQ ID NO: 105083 - DNA, 711 bp, Artificial Sequence
  Description of Artificial Sequence: Synthetic coding sequence
atgaccggcagagacagcctgagcgacggcagaaccagcagcagagccctggtgcccggcggcagccccagaggcagcagacccagaggcttcgccatcaccgacctgctgggcctggaggccgagctgcccgcccccgccggccccggccagggcagcggctgcgagggccccgccgtggccccctgccccggccccggcctggacggcagcagcctggccagaggcgccctgcccctgggcctgggcctgctgtgcggcttcggcacccagccccccgccgccgccagagccccctgcctgctgctggccgacgtgcccttcctgccccccagaggccccgagcccgccgcccccctggcccccagcagacccccccccgccctgggcagacagaagagaagcgacagcgtgagcaccagcgacgaggacagccagagcgaggacagaaacgacctgaaggccagccccaccctgggcaagagaaagaagagaagacacagaaccgtgttcaccgcccaccagctggaggagctggagaaggccttcagcgaggcccactaccccgacgtgtacgccagagagatgctggccgtgaagaccgagctgcccgaggacagaatccagtgcaagctgctgctgctggaggcccccgtgcactggaccctgcaggagacccacagactgcccagacccagaggcggcgcctag

SEQ ID NO: 105084 - DNA, 1110 bp, Artificial Sequence
  Description of Artificial Sequence: Synthetic coding sequence
atgagagcctgcatcagcctggtgctggccgtgctgtgcggcctggcctgggccgaggaccacaaggagagcgagcccctgccccagctggaggaggagaccgaggaggccctggccagcaacctgtacagcgcccccaccagctgccagggcagatgctacgaggccttcgacaagcaccaccagtgccactgcaacgccagatgccaggagttcggcaactgctgcaaggacttcgagagcctgtgcagcgaccacgaggtgagccacagcagcgacgccatcaccaaggaggagatccagagcatcagcgagaagatctacagagccgacaccaacaaggcccagaaggaggacatcgtgctgaacagccagaactgcatcagccccagcgagaccagaaaccaggtggacagatgccccaagcccctgttcacctacgtgaacgagaagctgttcagcaagcccacctacgccgccttcatcaacctgctgaacaactaccagagagccaccggccacggcgagcacttcagcgcccaggagctggccgagcaggacgccttcctgagagagatcatgaagaccgccgtgatgaaggagctgtacagcttcctgcaccaccagaacagatacggcagcgagcaggagttcgtggacgacctgaagaacatgtggttcggcctgtacagcagaggcaacgaggagggcgacagcagcggcttcgagcacgtgttcagcggcgaggtgaagaagggcaaggtgaccggcttccacaactggatcagattctacctggaggagaaggagggcctggtggactactacagccacatctacgacggcccctgggacagctaccccgacgtgctggccatgcagttcaactgggacggctactacaaggaggtgggcagcgccttcatcggcagcagccccgagttcgagttcgccctgtacagcctgtgcttcatcgccagacccggcaaggtgtgccagctgagcctgggcggctaccccctggccgtgagaacctacacctgggacaagagcacctacggcaacggcaagaagtacatcgccaccgcctacatcgtgagcagcacctag

SEQ ID NO: 105085 - DNA, 1284 bp, Artificial Sequence; identical to SEQ ID NO: 82100
  Description of Artificial Sequence: Synthetic coding sequence

SEQ ID NO: 105086 - DNA, 1188 bp, Artificial Sequence
  Description of Artificial Sequence: Synthetic coding sequence
atgagcatggagcacgccgccctgaccgccaccggcgccggcggcagctggagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagagaaagagagagatgatcctgaagagaaaggaggaggaggccctgaaggacagcctgagacccaagctgagcgaggagcagcagagaatcatcgccatcctgctggacgcccaccacaagacctacgaccccacctacagcgacttctgccagttcagaccccccgtgagagtgaacgacggcggcggcagccaccccagcagacccaacagcagacacacccccagcttcagcggcgacagcagcagcagctgcagcgaccactgcatcaccagcagcgacatgatggacagcagcagcttcagcaacctggacctgagcgaggaggacagcgacgaccccagcgtgaccctggagctgagccagctgagcatgctgccccacctggccgacctggtgagctacagcatccagaaggtgatcggcttcgccaagatgatccccggcttcagagacctgaccagcgaggaccagatcgtgctgctgaagagcagcgccatcgaggtgatcatgctgagaagcaacgagagcttcaccatggacgacatgagctggacctgcggcaaccaggactacaagtacagagtgagcgacgtgaccaaggccggccacagcctggagctgatcgagcccctgatcaagttccaggtgggcctgaagaagctgaacctgcacgaggaggagcacgtgctgctgatggccatctgcatcgtgagccccgacagacccggcgtgcaggacgccgccctgatcgaggccatccaggacagactgagcaacaccctgcagacctacatcagatgcagacaccccccccccggcagccacctgctgtacgccaagatgatccagaagctggccgacctgagaagcctgaacgaggagcacagcaagcagtacagatgcctgagcttccagcccgagtgcagcatgaagctgacccccctggtgctggaggtgttcggcaacgagatcagctag

SEQ ID NO: 105087 - DNA, 753 bp, Artificial Sequence
  Description of Artificial Sequence: Synthetic coding sequence
atggaggccatggccgccagcaccagcctgcccgaccccggcgacttcgacagaaacgtgcccagaatctgcggcgtgtgcggcgacagagccaccggcttccacttcaacgccatgacctgcgagggctgcaagggcttcttcagaagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagagaaagagagagatgatcctgaagagaaaggaggaggaggccctgaaggacagcctgagacccaagctgagcgaggagcagcagagaatcatcgccatcctgctggacgcccaccacaagacctacgaccccacctacagcgacttctgccagttcagaccccccgtgagagtgaacgacggcggcggcagccaccccagcagacccaacagcagacacacccccagcttcagcggcgacagcagcagcagctgcagcgaccactgcatcaccagcagcgacatgatggacagcagcagcttcagcaacctggacctgagcgaggaggacagcgacgaccccagcgtgaccctggagctgagccagctgagcatgctgccccacctggccgacctggtgagctacagcatccagaaggtgatcggcttcgccaagatgatccccggctag

SEQ ID NO: 105088 - DNA, 306 bp, Artificial Sequence
  Description of Artificial Sequence: Synthetic coding sequence
atggaggccatggccgccagcaccagcctgcccgaccccggcgacttcgacagaaacgtgcccagaatctgcggcgtgtgcggcgacagagccaccggcttccacttcaacgccatgacctgcgagggctgcaagggcttcttcagaagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagtag

SEQ ID NO: 105089 - DNA, 1284 bp, Artificial Sequence; identical to SEQ ID NO: 82100
  Description of Artificial Sequence: Synthetic coding sequence

SEQ ID NO: 105090 - DNA, 321 bp, Artificial Sequence
  Description of Artificial Sequence: Synthetic coding sequence
atggaggccatggccgccagcaccagcctgcccgaccccggcgacttcgacagaaacgtgcccagaatctgcggcgtgtgcggcgacagagccaccggcttccacttcaacgccatgacctgcgagggctgcaagggcttcttcagaagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagagaaagagagagatgtag

SEQ ID NO: 105091 - DNA, 1434 bp, Artificial Sequence
  Description of Artificial Sequence: Synthetic coding sequence
atggagtggagaaacaagaagagaagcgactggctgagcatggtgctgagaaccgccggcgtggaggaggccttcggcagcgaggtgagcgtgagaccccacagaagagcccccctgggcagcacctacctgccccccgcccccagcggcatggaggccatggccgccagcaccagcctgcccgaccccggcgacttcgacagaaacgtgcccagaatctgcggcgtgtgcggcgacagagccaccggcttccacttcaacgccatgacctgcgagggctgcaagggcttcttcagaagaagcatgaagagaaaggccctgttcacctgccccttcaacggcgactgcagaatcaccaaggacaacagaagacactgccaggcctgcagactgaagagatgcgtggacatcggcatgatgaaggagttcatcctgaccgacgaggaggtgcagagaaagagagagatgatcctgaagagaaaggaggaggaggccctgaaggacagcctgagacccaagctgagcgaggagcagcagagaatcatcgccatcctgctggacgcccaccacaagacctacgaccccacctacagcgacttctgccagttcagaccccccgtgagagtgaacgacggcggcggcagccaccccagcagacccaacagcagacacacccccagcttcagcggcgacagcagcagcagctgcagcgaccactgcatcaccagcagcgacatgatggacagcagcagcttcagcaacctggacctgagcgaggaggacagcgacgaccccagcgtgaccctggagctgagccagctgagcatgctgccccacctggccgacctggtgagctacagcatccagaaggtgatcggcttcgccaagatgatccccggcttcagagacctgaccagcgaggaccagatcgtgctgctgaagagcagcgccatcgaggtgatcatgctgagaagcaacgagagcttcaccatggacgacatgagctggacctgcggcaaccaggactacaagtacagagtgagcgacgtgaccaaggccggccacagcctggagctgatcgagcccctgatcaagttccaggtgggcctgaagaagctgaacctgcacgaggaggagcacgtgctgctgatggccatctgcatcgtgagccccgacagacccggcgtgcaggacgccgccctgatcgaggccatccaggacagactgagcaacaccctgcagacctacatcagatgcagacaccccccccccggcagccacctgctgtacgccaagatgatccagaagctggccgacctgagaagcctgaacgaggagcacagcaagcagtacagatgcctgagcttccagcccgagtgcagcatgaagctgacccccctggtgctggaggtgttcggcaacgagatcagctag

SEQ ID NO: 105092 - DNA, 279 bp, Artificial Sequence
  Description of Artificial Sequence: Synthetic coding sequence
atgggcagcacctggggcagccccggctgggtgagactggccctgtgcctgaccggcctggtgctgagcctgtacgccctgcacgtgaaggccgccagagccagagacagagactacagagccctgtgcgacgtgggcaccgccatcagctgcagcagagtgttcagcagcagactgcccgccgacaccctgggcctgtgccccgacgccgccgagctgcccggcgtgagcagatggttctgcctgcccggcctggaccccgtgctgagagccctgtag

SEQ ID NO: 105093 - DNA, 492 bp, Artificial Sequence
  Description of Artificial Sequence: Synthetic coding sequence
atgggcagcacctggggcagccccggctgggtgagactggccctgtgcctgaccggcctggtgctgagcctgtacgccctgcacgtgaaggccgccagagccagagacagagactacagagccctgtgcgacgtgggcaccgccatcagctgcagcagagtgttcagcagcagatggggcagaggcttcggcctggtggagcacgtgctgggccaggacagcatcctgaaccagagcaacagcatcttcggctgcatcttctacaccctgcagctgctgctgggctgcctgagaaccagatgggccagcgtgctgatgctgctgagcagcctggtgagcctggccggcagcgtgtacctggcctggatcctgttcttcgtgctgtacgacttctgcatcgtgtgcatcaccacctacgccatcaacgtgagcctgatgtggctgagcttcagaaaggtgcaggagccccagggcaaggccaagagacactag

SEQ ID NO: 105094 - DNA, 5823 bp, Artificial Sequence; identical to SEQ ID NO: 89974
  Description of Artificial Sequence: Synthetic coding sequence

SEQ ID NO: 105095 - DNA, 357 bp, Artificial Sequence
  Description of Artificial Sequence: Synthetic coding sequence
atggcccccctgagacccctgctgatcctggccctgctggcctgggtggccctggccgaccaggagagctgcaagggcagatgcaccgagggcttcaacgtggacaagaagtgccagtgcgacgagctgtgcagctactaccagagctgctgcaccgactacaccgccgagtgcaagccccaggtgaccagaggcgacgtgttcaccatgcccgaggacgagtacaccgtgtacgacgacggcgaggagaagaacaacgccaccgtgcacgagcaggtgggcggccccagcctgaccagcgacctgcaggcccagagcaagggcaaccccgagcagacccccgtgctgaagccctag

SEQ ID NO: 105096 - DNA, 495 bp, Artificial Sequence
  Description of Artificial Sequence: Synthetic coding sequence
atgagcgtggaccccctgagcagcaaggccctgaagatcaagagagagctgagcgagaacaccccccacctgagcgacgaggccctgatgggcctgagcgtgagagagctgaacagacacctgagaggcctgagcgccgaggaggtgaccagactgaagcagagaagaagaaccctgaagaacagaggctacgccgccagctgcagagtgaagagagtgtgccagaaggaggagctgcagaagcagaagagcgagctggagagagaggtggacaagctggccagagagaacgccgccatgagactggagctggacgccctgagaggcaagtgcgaggccctgcagggcttcgccagaagcgtggccgccgccagaggccccgccaccctggtggcccccgccagcgtgatcaccatcgtgaagagcacccccggcagcggcagcggccccgcccacggccccgaccccgcccacggccccgccagctgcagctag

SEQ ID NO: 105097 - DNA, 495 bp, Artificial Sequence; identical to SEQ ID NO: 105096
  Description of Artificial Sequence: Synthetic coding sequence

SEQ ID NO: 105098 - DNA, 381 bp, Artificial Sequence
  Description of Artificial Sequence: Synthetic coding sequence
atgagcgtggaccccctgagcagcaaggccctgaagatcaagagagagctgagcgagaacaccccccacctgagcgacgaggccctgatgggcctgagcgtgagagagctgaacagacacctgagaggcctgagcgccgaggaggtgaccagactgaagcagagaagaagaaccctgaagaacagaggctacgccgccagctgcagagtgaagagagtgtgccagaaggaggagctgcagaagcagaagagcgagctggagagagaggtggacaagctggccagagagaacgccgccatgagactggagctggacgccctgagaggcaagtgcgaggccctgcagggcttcgccagaagcgtggccgccgccagaggctag

SEQ ID NO: 105099 - DNA, 495 bp, Artificial Sequence; identical to SEQ ID NO: 105096
  Description of Artificial Sequence: Synthetic coding sequence

SEQ ID NO: 105100 - DNA, 282 bp, Artificial Sequence
  Description of Artificial Sequence: Synthetic coding sequence
atgggcctgagcgtgagagagctgaacagacacctgagaggcctgagcgccgaggaggtgaccagactgaagcagagaagaagaaccctgaagaacagaggctacgccgccagctgcagagtgaagagagtgtgccagaaggaggagctgcagaagcagaagagcgagctggagagagaggtggacaagctggccagagagaacgccgccatgagactggagctggacgccctgagaggcaagtgcgaggccctgcagggcttcgccagaagcgtggcctag

SEQ ID NO: 105101 - DNA, 495 bp, Artificial Sequence; identical to SEQ ID NO: 105096
  Description of Artificial Sequence: Synthetic coding sequence

SEQ ID NO: 105102 - DNA, 408 bp, Artificial Sequence
  Description of Artificial Sequence: Synthetic coding sequence
atgggcctgagcgtgagagagctgaacagacacctgagaggcctgagcgccgaggaggtgaccagactgaagcagagaagaagaaccctgaagaacagaggctacgccgccagctgcagagtgaagagagtgtgccagaaggaggagctgcagaagcagaagagcgagctggagagagaggtggacaagctggccagagagaacgccgccatgagactggagctggacgccctgagaggcaagtgcgaggccctgcagggcttcgccagaagcgtggccgccgccagaggccccgccaccctggtggcccccgccagcgtgatcaccatcgtgaagagcacccccggcagcggcagcggccccgcccacggccccgaccccgcccacggccccgccagctgcagctag

SEQ ID NO: 105103 - DNA, 489 bp, Artificial Sequence
  Description of Artificial Sequence: Synthetic coding sequence
atgaccacccccaacaagggcaacaaggccctgaaggtgaagagagagcccggcgagaacggcaccagcctgaccgacgaggagctggtgaccatgagcgtgagagagctgaaccagcacctgagaggcctgagcaaggaggagatcgtgcagctgaagcagagaagaagaaccctgaagaacagaggctacgccgccagctgcagagtgaagagagtgacccagaaggaggagctggagaagcagaaggccgagctgcagcaggaggtggagaagctggccagcgagaacgccagcatgaagctggagctggacgccctgagaagcaagtacgaggccctgcagaccttcgccagaaccgtggccagaagccccgtggcccccgccagaggccccctggccgccggcctgggccccctggtgcccggcaaggtggccgccaccagcgtgatcaccatcgtgaagagcaagaccgacgccagaagctag

SEQ ID NO: 105104 - DNA, 489 bp, Artificial Sequence; identical to SEQ ID NO: 105103
  Description of Artificial Sequence: Synthetic coding sequence

SEQ ID NO: 105105 - DNA, 471 bp, Artificial Sequence
  Description of Artificial Sequence: Synthetic coding sequence
atgaccaccaaccccaagcccaacaaggccctgaaggtgaagaaggaggccggcgagaacgcccccgtgctgagcgacgacgagctggtgagcatgagcgtgagagagctgaaccagcacctgagaggcctgaccaaggaggaggtgaccagactgaagcagagaagaagaaccctgaagaacagaggctacgccgccagctgcagaatcaagagagtgacccagaaggaggagctggagagacagagagtggagctgcagcaggaggtggagaagctggccagagagaacagcagcatgagactggagctggacgccctgagaagcaagtacgaggccctgcagaccttcgccagaaccgtggccagaggccccgtggcccccagcaaggtggccaccaccagcgtgatcaccatcgtgaagagcaccgagctgagcagcaccagcgtgcccttcagcgccgccagctag

SEQ ID NO: 105106 - DNA, 471 bp, Artificial Sequence; identical to SEQ ID NO: 105105
  Description of Artificial Sequence: Synthetic coding sequence

SEQ ID NO: 105107 - DNA, 471 bp, Artificial Sequence; identical to SEQ ID NO: 105105
  Description of Artificial Sequence: Synthetic coding sequence

SEQ ID NO: 105108 - DNA, 1041 bp, Artificial Sequence
  Description of Artificial Sequence: Synthetic coding sequence
atgcccagccccctggccctgagaccctacctgagaagcgagttcagccccagcgtggacgccagaccctgcagcagccccagcgagctgcccgccaagctgctgctgggcgccaccctgcccagagcccccagactgcccagaagactggcctggtgcagcatcgactgggagcaggtgtgcctgctgcagagactgggcgccggcggcttcggcagcgtgtacaaggccacctacagaggcgtgcccgtggccatcaagcaggtgaacaagtgcaccaagaacagactggccagcagaagaagcttctgggccgagctgaacgtggccagactgagacacgacaacatcgtgagagtggtggccgccagcaccagaacccccgccggcagcaacagcctgggcaccatcatcatggagttcggcggcaacgtgaccctgcaccaggtgatctacggcgccgccggccaccccgagggcgacgccggcgagccccactgcagaaccggcggccagctgagcctgggcaagtgcctgaagtacagcctggacgtggtgaacggcctgctgttcctgcacagccagagcatcgtgcacctggacctgaagcccgccaacatcctgatcagcgagcaggacgtgtgcaagatcagcgacttcggctgcagcgagaagctggaggacctgctgtgcttccagacccccagctaccccctgggcggcacctacacccacagagcccccgagctgctgaagggcgagggcgtgacccccaaggccgacatctacagcttcgccatcaccctgtggcagatgaccaccaagcaggccccctacagcggcgagagacagcacatcctgtacgccgtggtggcctacgacctgagacccagcctgagcgccgccgtgttcgaggacagcctgcccggccagagactgggcgacgtgatccagagatgctggagacccagcgccgcccagagacccagcgccagactgctgctggtggacctgaccagcctgaaggccgagctgggctag

SEQ ID NO: 105109 - DNA, 1839 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagagacactacaacgacgaggaccccgagaaggagaagagaatcaaggagctggagctgctgctgatgagcaccgagaacgagctgaagggccagcaggtgctgcccacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaacatcctgaccagcagcgtgctgatggcccccgccagcgaggacgaggacaacgtgctgaaggccttcaccgtgcccaagaacagaagcctggccagccccctgcaggccaccaaggcccagagactgttccagttctag

SEQ ID NO: 105110 - DNA, 2181 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagagacactacaacgacgaggaccccgagaaggagaagagaatcaaggagctggagctgctgctgatgagcaccgagaacgagctgaagggccagcaggtgctgcccacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaccggcgtgcagtggcacgacttcggcagcctgcagcccctgccccccggcttcaagagattcagctgcctgagcctgcccagaagctgggactacagacaccccccccccagacccgccaacttcgagttcctggtggagaccggcttcctgcacgtgggccaggccggcctggagctgctgaccagcggcgacctgcccgccagcgccagccagagcgccagaatcaccggcgtgagccacagagccagacccgacaacatcctgaccagcagcgtgctgatggcccccgccagcgaggacgaggacaacgtgctgaaggccttcaccgtgcccaagaacagaagcctggccagccccctgcagccctgcagcagcacctgggagcccgccagctgcggcaagatggaggagcagatgaccagcagcagccaggccagaaagtacgtgaacgccttcagcgccagaaccctggtgatgtag

SEQ ID NO: 105111 - DNA, 2286 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagagacactacaacgacgaggaccccgagaaggagaagagaatcaaggagctggagctgctgctgatgagcaccgagaacgagctgaagggccagcaggtgctgcccacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcgacagcagcagctggtgcgacctgagcagcttcgagttcttcgaggaggccgacttcagccccagccagcaccacaccggcaaggccctgcagctgcagcagagagagggcaacggcaccaagcccgccggcgagcccagccccagagtgaacaagagaatgctgagcgagagcagcctggacccccccaaggtgctgccccccgccagacacagcaccatccccctggtgatcctgagaaagaagagaggccaggccagccccctggccaccggcgactgcagcagcttcatcttcgccgacgtgagcagcagcacccccaagagaagccccgtgaagagcctgcccttcagccccagccagttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaacatcctgaccagcagcgtgctgatggcccccgccagcgaggacgaggacaacgtgctgaaggccttcaccgtgcccaagaacagaagcctggccagccccctgcagccctgcagcagcacctgggagcccgccagctgcggcaagatggaggagcagatgaccagcagcagccaggccagaaagtacgtgaacgccttcagcgccagaaccctggtgatgtag

SEQ ID NO: 105112 - DNA, 1923 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagagacactacaacgacgaggaccccgagaaggagaagagaatcaaggagctggagctgctgctgatgagcaccgagaacgagctgaagggccagcaggtgctgcccacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaacatcctgaccagcagcgtgctgatggcccccgccagcgaggacgaggacaacgtgctgaaggccttcaccgtgcccaagaacagaagcctggccagccccctgcagccctgcagcagcacctgggagcccgccagctgcggcaagatggaggagcagatgaccagcagcagccaggccagaaagtacgtgaacgccttcagcgccagaaccctggtgatgtag

SEQ ID NO: 105113 - DNA, 1914 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagagacactacaacgacgaggaccccgagaaggagaagagaatcaaggagctggagctgctgctgatgagcaccgagaacgagctgaagggccagcagacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaacatcctgaccagcagcgtgctgatggcccccgccagcgaggacgaggacaacgtgctgaaggccttcaccgtgcccaagaacagaagcctggccagccccctgcagccctgcagcagcacctgggagcccgccagctgcggcaagatggaggagcagatgaccagcagcagccaggccagaaagtacgtgaacgccttcagcgccagaaccctggtgatgtag

SEQ ID NO: 105114 - DNA, 240 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggagaacagaaccgacgtgcagtgccagcacagatggcagaaggtgctgaaccccgagctgatcaagggcccctggaccaaggaggaggaccagagaaactag

SEQ ID NO: 105115 - DNA, 312 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagaaactag

SEQ ID NO: 105116 - DNA, 1818 bp, Artificial Sequence
  Description of Artificial Sequence: Synthetic coding sequence
atggccagaagacccagacacagcatctacagcagcgacgaggacgacgaggacttcgagatgtgcgaccacgactacgacggcctgctgcccaagagcggcaagagacacctgggcaagaccagatggaccagagaggaggacgagaagctgaagaagctggtggagcagaacggcaccgacgactggaaggtgatcgccaactacctgcccaacagaaccgacgtgcagtgccagcacagatggcagaaggtgctgaaccccgagctgatcaagggcccctggaccaaggaggaggaccagagagtgatcgagctggtgcagaagtacggccccaagagatggagcgtgatcgccaagcacctgaagggcagaatcggcaagcagtgcagagagagatggcacaaccacctgaaccccgaggtgaagaagaccagctggaccgaggaggaggacagaatcatctaccaggcccacaagagactgggcaacagatgggccgagatcgccaagctgctgcccggcagaaccgacaacgccatcaagaaccactggaacagcaccatgagaagaaaggtggagcaggagggctacctgcaggagagcagcaaggccagccagcccgccgtggccaccagcttccagaagaacagccacctgatgggcttcgcccaggccccccccaccgcccagctgcccgccaccggccagcccaccgtgaacaacgactacagctactaccacatcagcgaggcccagaacgtgagcagccacgtgccctaccccgtggccctgcacgtgaacatcgtgaacgtgccccagcccgccgccgccgccatccagacccagaaccacacctgcagctaccccggctggcacagcaccaccatcgccgaccacaccagaccccacggcgacagcgcccccgtgagctgcctgggcgagcaccacagcacccccagcctgcccgccgaccccggcagcctgcccgaggagagcgccagccccgccagatgcatgatcgtgcaccagggcaccatcctggacaacgtgaagaacctgctggagttcgccgagaccctgcagttcatcgacagcttcctgaacaccagcagcaaccacgagaacagcgacctggagatgcccagcctgaccagcacccccctgatcggccacaagctgaccgtgaccacccccttccacagagaccagaccgtgaagacccagaaggagaacaccgtgttcagaacccccgccatcaagagaagcatcctggagagcagccccagaacccccacccccttcaagcacgccctggccgcccaggagatcaagtacggccccctgaagatgctgccccagacccccagccacctggtggaggacctgcaggacgtgatcaagcaggagagcgacgagagcggcatcgtggccgagttccaggagaacggcccccccctgctgaagaagatcaagcaggaggtggagagccccaccgacaagagcggcaacttcttctgcagccaccactgggagggcgacagcctgaacacccagctgttcacccagaccagccccgtggccgacgcccccaacatcctgaccagcagcgtgctgatggcccccgccagcgaggacgaggacaacgtgctgaaggccttcaccgtgcccaagaacagaagcctggccagccccctgcagccctgcagcagcacctgggagcccgccagctgcggcaagatggaggagcagatgaccagcagcagccaggccagaaagtacgtgaacgccttcagcgccagaaccctggtgatgtag

SEQ ID NO: 105117 - DNA, 717 bp, Artificial Sequence; identical to SEQ ID NO: 95026
  Description of Artificial Sequence: Synthetic coding sequence

SEQ ID NO: 105118 - DNA, 2031 bp, Artificial Sequence
  Description of Artificial Sequence: Synthetic coding sequence
atgagcagaagaaccagatgcgaggacctggacgagctgcactaccaggacaccgacagcgacgtgcccgagcagagagacagcaagtgcaaggtgaagtggacccacgaggagaacagaaccgaccagcagtgccagtacagatggctgagagtgctgaaccccgacctggtgaagggcccctggaccaaggaggaggaccagaaggtgatcgagctggtgaagaagtacggcaccaagcagtggaccctgatcgccaagcacctgaagggcagactgggcaagcagtgcagagagagatggcacaaccacctgaaccccgaggtgaagaagagctgctggaccgaggaggaggacagaatcatctgcgaggcccacaaggtgctgggcaacagatgggccgagatcgccaagatgctgcccggcagaaccgacaacgccgtgaagaaccactggaacagcaccatcaagagaaaggtggacaccggcggcttcctgagcgagagcaaggactgcaagccccccgtgtacctgctgctggagctggaggacaaggacggcctgcagagcgcccagcccaccgagggccagggcagcctgctgaccaactggcccagcgtgccccccaccatcaaggaggaggagaacagcgaggaggagctggccgccgccaccaccagcaaggagcaggagcccatcggcaccgacctggacgccgtgagaacccccgagcccctggaggagttccccaagagagaggaccaggagggcagcccccccgagaccagcctgccctacaagtgggtggtggaggccgccaacctgctgatccccgccgtgggcagcagcctgagcgaggccctggacctgatcgagagcgaccccgacgcctggtgcgacctgagcaagttcgacctgcccgaggagcccagcgccgaggacagcatcaacaacagcctggtgcagctgcaggccagccaccagcagcaggtgctgccccccagacagcccagcgccctggtgcccagcgtgaccgagtacagactggacggccacaccatcagcgacctgagcagaagcagcagaggcgagctgatccccatcagccccagcaccgaggtgggcggcagcggcatcggcaccccccccagcgtgctgaagagacagagaaagagaagagtggccctgagccccgtgaccgagaacagcaccagcctgagcttcctggacagctgcaacagcctgacccccaagagcacccccgtgaagaccctgcccttcagccccagccagttcctgaacttctggaacaagcaggacaccctggagctggagagccccagcctgaccagcacccccgtgtgcagccagaaggtggtggtgaccacccccctgcacagagacaagacccccctgcaccagaagcacgccgccttcgtgacccccgaccagaagtacagcatggacaacaccccccacacccccacccccttcaagaacgccctggagaagtacggccccctgaagcccctgccccagaccccccacctggaggaggacctgaaggaggtgctgagaagcgaggccggcatcgagctgatcatcgaggacgacatcagacccgagaagcagaagagaaagcccggcctgagaagaagccccatcaagaaggtgagaaagagcctggccctggacatcgtggacgaggacgtgaagctgatgatgagcaccctgcccaagagcctgagcctgcccaccaccgcccccagcaacagcagcagcctgaccctgagcggcatcaaggaggacaacagcctgctgaaccagggcttcctgcaggccaagcccgagaaggccgccgtggcccagaagcccagaagccacttcaccacccccgcccccatgagcagcgcctggaagaccgtggcctgcggcggcaccagagaccagctgttcatgcaggagaaggccagacagctgctgggcagactgaagcccagccacaccagcagaaccctgatcctgagctag

SEQ ID NO: 105119 - DNA, 1395 bp, Artificial Sequence
  Description of Artificial Sequence: Synthetic coding sequence
atgcccagctgcagcaccagcaccatgcccggcatgatctgcaagaaccccgacctggagttcgacagcctgcagccctgcttctaccccgacgaggacgacttctacttcggcggccccgacagcaccccccccggcgaggacatctggaagaagttcgagctgctgcccaccccccccctgagccccagcagaggcttcgccgagcacagcagcgagccccccagctgggtgaccgagatgctgctggagaacgagctgtggggcagccccgccgaggaggacgccttcggcctgggcggcctgggcggcctgacccccaaccccgtgatcctgcaggactgcatgtggagcggcttcagcgccagagagaagctggagagagccgtgagcgagaagctgcagcacggcagaggcccccccaccgccggcagcaccgcccagagccccggcgccggcgccgccagccccgccggcagaggccacggcggcgccgccggcgccggcagagccggcgccgccctgcccgccgagctggcccaccccgccgccgagtgcgtggaccccgccgtggtgttccccttccccgtgaacaagagagagcccgcccccgtgcccgccgcccccgccagcgcccccgccgccggccccgccgtggccagcggcgccggcatcgccgcccccgccggcgcccccggcgtggccccccccagacccggcggcagacagaccagcggcggcgaccacaaggccctgagcaccagcggcgaggacaccctgagcgacagcgacgacgaggacgacgaggaggaggacgaggaggaggagatcgacgtggtgaccgtggagaagagaagaagcagcagcaacaccaaggccgtgaccaccttcaccatcaccgtgagacccaagaacgccgccctgggccccggcagagcccagagcagcgagctgatcctgaagagatgcctgcccatccaccagcagcacaactacgccgcccccagcccctacgtggagagcgaggacgcccccccccagaagaagatcaagagcgaggccagccccagacccctgaagagcgtgatcccccccaaggccaagagcctgagccccagaaacagcgacagcgaggacagcgagagaagaagaaaccacaacatcctggagagacagagaagaaacgacctgagaagcagcttcctgaccctgagagaccacgtgcccgagctggtgaagaacgagaaggccgccaaggtggtgatcctgaagaaggccaccgagtacgtgcacagcctgcaggccgaggagcaccagctgctgctggagaaggagaagctgcaggccagacagcagcagctgctgaagaagatcgagcacgccagaacctgctag

SEQ ID NO: 105120 - DNA, 1149 bp, Artificial Sequence
  Description of Artificial Sequence: Synthetic coding sequence
atgcccagctgcagcaccagcaccatgcccggcatgatctgcaagaaccccgacctggagttcgacagcctgcagccctgcttctaccccgacgaggacgacttctacttcggcggccccgacagcaccccccccggcgaggacatctggaagaagttcgagctgctgcccaccccccccctgagccccagcagaggcttcgccgagcacagcagcgagccccccagctgggtgaccgagatgctgctggagaacgagctgtggggcagccccgccgaggaggacgccttcggcctgggcggcctgggcggcctgacccccaaccccgtgatcctgcaggactgcatgtggagcggcttcagcgccagagagaagctggagagagccgtgagcgagaagctgcagcacggcagaggcccccccaccgccggcagcaccgcccagagccccggcgtggccccccccagacccggcggcagacagaccagcggcggcgaccacaaggccctgagcaccagcggcgaggacaccctgagcgacagcgacgacgaggacgacgaggaggaggacgaggaggaggagatcgacgtggtgaccgtggagaagagaagaagcagcagcaacaccaaggccgtgaccaccttcaccatcaccgtgagacccaagaacgccgccctgggccccggcagagcccagagcagcgagctgatcctgaagagatgcctgcccatccaccagcagcacaactacgccgcccccagcccctacgtggagagcgaggacgcccccccccagaagaagatcaagagcgaggccagccccagacccctgaagagcgtgatcccccccaaggccaagagcctgagccccagaaacagcgacagcgaggacagcgagagaagaagaaaccacaacatcctggagagacagagaagaaacgacctgagaagcagcttcctgaccctgagagaccacgtgcccgagctggtgaagaacgagaaggccgccaaggtggtgatcctgaagaaggccaccgagtacgtgcacagcctgcaggccgaggagcaccagctgctgctggagaaggagaagctgcaggccagacagcagcagctgctgaagaagatcgagcacgccagaacctgctag

SEQ ID NO: 105121 - DNA, 852 bp, Artificial Sequence
  Description of Artificial Sequence: Synthetic coding sequence
atggccgtgccccccacctacgccgacctgggcaagagcgccagagacgtgttcaccaagggctacggcttcggcctgatcaagctggacctgaagaccaagagcgagaacggcctggagttcaccagcagcggcagcgccaacaccgagaccaccaaggtgaccggcagcctggagaccaagtacagatggaccgagtacggcctgaccttcaccgagaagtggaacaccgacaacaccctgggcaccgagatcaccgtggaggaccagctggccagaggcctgaagctgaccttcgacagcagcttcagccccaacaccggcaagaagaacgccaagatcaagaccggctacaagagagagcacatcaacctgggctgcgacatggacttcgacatcgccggccccagcatcagaggcgccctggtgctgggctacgagggctggctggccggctaccagatgaacttcgagaccgccaagagcagagtgacccagagcaacttcgccgtgggctacaagaccgacgagttccagctgcacaccaacgtgaacgacggcaccgagttcggcggcagcatctaccagaaggtgaacaagaagctggagaccgccgtgaacctggcctggaccgccggcaacagcaacaccagattcggcatcgccgccaagtaccagatcgaccccgacgcctgcttcagcgccaaggtgaacaacagcagcctgatcggcctgggctacacccagaccctgaagcccggcatcaagctgaccctgagcgccctgctggacggcaagaacgtgaacgccggcggccacaagctgggcctgggcctggagttccaggcctag

SEQ ID NO: 105122 - DNA, 852 bp, Artificial Sequence; identical to SEQ ID NO: 105121
  Description of Artificial Sequence: Synthetic coding sequence

SEQ ID NO: 105123 - DNA, 852 bp, Artificial Sequence; identical to SEQ ID NO: 105121
  Description of Artificial Sequence: Synthetic coding sequence

SEQ ID NO: 105124 - DNA, 849 bp, Artificial Sequence
  Description of Artificial Sequence: Synthetic coding sequence
atggccacccacggccagacctgcgccagacccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgaacgacggcaccgagttcggcggcagcatctaccagaaggtgtgcgaggacctggacaccagcgtgaacctggcctggaccagcggcaccaactgcaccagattcggcatcgccgccaagtaccagctggaccccaccgccagcatcagcgccaaggtgaacaacagcagcctgatcggcgtgggctacacccagaccctgagacccggcgtgaagctgaccctgagcgccctggtggacggcaagagcatcaacgccggctag

SEQ ID NO: 105125 - DNA, 930 bp, Artificial Sequence
  Description of Artificial Sequence: Synthetic coding sequence
atgagctggtgcaacgagctgagactgcccgccctgaagcagcacagcatcggcagaggcctggagagccacatcaccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgaacgacggcaccgagttcggcggcagcatctaccagaaggtgtgcgaggacctggacaccagcgtgaacctggcctggaccagcggcaccaactgcaccagattcggcatcgccgccaagtaccagctggaccccaccgccagcatcagcgccaaggtgaacaacagcagcctgatcggcgtgggctacacccagaccctgagacccggcgtgaagctgaccctgagcgccctggtggacggcaagagcatcaacgccggcggccacaaggtgggcctggccctggagctggaggcctag

SEQ ID NO: 105126 - DNA, 885 bp, Artificial Sequence
  Description of Artificial Sequence: Synthetic coding sequence
atggccacccacggccagacctgcgccagacccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgaacgacggcaccgagttcggcggcagcatctaccagaaggtgtgcgaggacctggacaccagcgtgaacctggcctggaccagcggcaccaactgcaccagattcggcatcgccgccaagtaccagctggaccccaccgccagcatcagcgccaaggtgaacaacagcagcctgatcggcgtgggctacacccagaccctgagacccggcgtgaagctgaccctgagcgccctggtggacggcaagagcatcaacgccggcggccacaaggtgggcctggccctggagctggaggcctag

SEQ ID NO: 105127 - DNA, 588 bp, Artificial Sequence
  Description of Artificial Sequence: Synthetic coding sequence
atggccacccacggccagacctgcgccagacccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgtag

SEQ ID NO: 105128 - DNA, 330 bp, Artificial Sequence
  Description of Artificial Sequence: Synthetic coding sequence
atgagctggtgcaacgagctgagactgcccgccctgaagcagcacagcatcggcagaggcctggagagccacatcaccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcacctag

SEQ ID NO: 105129 - DNA, 615 bp, Artificial Sequence
  Description of Artificial Sequence: Synthetic coding sequence
atggccacccacggccagacctgcgccagacccatgtgcatcccccccagctacgccgacctgggcaaggccgccagagacatcttcaacaagggcttcggcttcggcctggtgaagctggacgtgaagaccaagagctgcagcggcgtggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgaacgacggcaccgagttcggcggcagctag

SEQ ID NO: 105130 - DNA, 768 bp, Artificial Sequence
  Description of Artificial Sequence: Synthetic coding sequence
atgctggtgatccccgccacccaggaggccgaggagttcagcaccagcggcagcagcaacaccgacaccggcaaggtgaccggcaccctggagaccaagtacaagtggtgcgagtacggcctgaccttcaccgagaagtggaacaccgacaacaccctgggcaccgagatcgccatcgaggaccagatctgccagggcctgaagctgaccttcgacaccaccttcagccccaacaccggcaagaagagcggcaagatcaagagcagctacaagagagagtgcatcaacctgggctgcgacgtggacttcgacttcgccggccccgccatccacggcagcgccgtgttcggctacgagggctggctggccggctaccagatgaccttcgacagcgccaagagcaagctgaccagaaacaacttcgccgtgggctacagaaccggcgacttccagctgcacaccaacgtgaacgacggcaccgagttcggcggcagcatctaccagaaggtgtgcgaggacctggacaccagcgtgaacctggcctggaccagcggcaccaactgcaccagattcggcatcgccgccaagtaccagctggaccccaccgccagcatcagcgccaaggtgaacaacagcagcctgatcggcgtgggctacacccagaccctgagacccggcgtgaagctgaccctgagcgccctggtggacggcaagagcatcaacgccggcggccacaaggtgggcctggccctggagctggaggcctag

SEQ ID NO: 105131 - DNA, 885 bp, Artificial Sequence; identical to SEQ ID NO: 105126
  Description of Artificial Sequence: Synthetic coding sequence

SEQ ID NO: 105132 - DNA, 852 bp, Artificial Sequence
  Description of Artificial Sequence: Synthetic coding sequence
atgtgcaacacccccacctactgcgacctgggcaaggccgccaaggacgtgttcaacaagggctacggcttcggcatggtgaagatcgacctgaagaccaagagctgcagcggcgtggagttcagcaccagcggccacgcctacaccgacaccggcaaggccagcggcaacctggagaccaagtacaaggtgtgcaactacggcctgaccttcacccagaagtggaacaccgacaacaccctgggcaccgagatcagctgggagaacaagctggccgagggcctgaagctgaccctggacaccatcttcgtgcccaacaccggcaagaagagcggcaagctgaaggccagctacaagagagactgcttcagcgtgggcagcaacgtggacatcgacttcagcggccccaccatctacggctgggccgtgctggccttcgagggctggctggccggctaccagatgagcttcgacaccgccaagagcaagctgagccagaacaacttcgccctgggctacaaggccgccgacttccagctgcacacccacgtgaacgacggcaccgagttcggcggcagcatctaccagaaggtgaacgagaagatcgagaccagcatcaacctggcctggaccgccggcagcaacaacaccagattcggcatcgccgccaagtacatgctggactgcagaaccagcctgagcgccaaggtgaacaacgccagcctgatcggcctgggctacacccagaccctgagacccggcgtgaagctgaccctgagcgccctgatcgacggcaagaacttcagcgccggcggccacaaggtgggcctgggcttcgagctggaggcctag

SEQ ID NO: 105133 - DNA, 855 bp, Artificial Sequence
  Description of Artificial Sequence: Synthetic coding sequence
atgtgcaacacccccacctactgcgacctgggcaaggccgccaaggacgtgttcaacaagggctacggcttcggcatggtgaagatcgacctgaagaccaagagctgcagcggcgtggtggagttcagcaccagcggccacgcctacaccgacaccggcaaggccagcggcaacctggagaccaagtacaaggtgtgcaactacggcctgaccttcacccagaagtggaacaccgacaacaccctgggcaccgagatcagctgggagaacaagctggccgagggcctgaagctgaccctggacaccatcttcgtgcccaacaccggcaagaagagcggcaagctgaaggccagctacaagagagactgcttcagcgtgggcagcaacgtggacatcgacttcagcggccccaccatctacggctgggccgtgctggccttcgagggctggctggccggctaccagatgagcttcgacaccgccaagagcaagctgagccagaacaacttcgccctgggctacaaggccgccgacttccagctgcacacccacgtgaacgacggcaccgagttcggcggcagcatctaccagaaggtgaacgagaagatcgagaccagcatcaacctggcctggaccgccggcagcaacaacaccagattcggcatcgccgccaagtacatgctggactgcagaaccagcctgagcgccaaggtgaacaacgccagcctgatcggcctgggctacacccagaccctgagacccggcgtgaagctgaccctgagcgccctgatcgacggcaagaacttcagcgccggcggccacaaggtgggcctgggcttcgagctggaggcctag

SEQ ID NO: 105134 - DNA, 498 bp, Artificial Sequence
  Description of Artificial Sequence: Synthetic coding sequence
atgtgcaacacccccacctactgcgacctgggcaaggccgccaaggacgtgttcaacaagggctacggcttcggcatggtgaagatcgacctgaagaccaagagctgcagcggcgtggagttcagcaccagcggccacgcctacaccgacaccggcaaggccagcggcaacctggagaccaagtacaaggtgtgcaactacggcctgaccttcacccagaagtggaacaccgacaacaccctgggcaccgagatcagctgggagaacaagctggccgagggcctgaagctgaccctggacaccatcttcgtgcccaacaccggcaagaagagcggcaagctgaaggccagctacaagagagactgcttcagcgtgggcagcaacgtggacatcgacttcagcggccccaccatctacggctgggccgtgctggccttcgagggctggctggccggctaccagatgagcttcgacaccgccaagagcaagctgagctag

SEQ ID NO: 105135 - DNA, 855 bp, Artificial Sequence
  Description of Artificial Sequence: Synthetic coding sequence
atgtgcaacacccccacctactgcgacctgggcaaggccgccaaggacgtgttcaacaagggctacggcttcggcatggtgaagatcgacctgaagaccaagagctgcagcggcgtgatggagttcagcaccagcggccacgcctacaccgacaccggcaaggccagcggcaacctggagaccaagtacaaggtgtgcaactacggcctgaccttcacccagaagtggaacaccgacaacaccctgggcaccgagatcagctgggagaacaagctggccgagggcctgaagctgaccctggacaccatcttcgtgcccaacaccggcaagaagagcggcaagctgaaggccagctacaagagagactgcttcagcgtgggcagcaacgtggacatcgacttcagcggccccaccatctacggctgggccgtgctggccttcgagggctggctggccggctaccagatgagcttcgacaccgccaagagcaagctgagccagaacaacttcgccctgggctacaaggccgccgacttccagctgcacacccacgtgaacgacggcaccgagttcggcggcagcatctaccagaaggtgaacgagaagatcgagaccagcatcaacctggcctggaccgccggcagcaacaacaccagattcggcatcgccgccaagtacatgctggactgcagaaccagcctgagcgccaaggtgaacaacgccagcctgatcggcctgggctacacccagaccctgagacccggcgtgaagctgaccctgagcgccctgatcgacggcaagaacttcagcgccggcggccacaaggtgggcctgggcttcgagctggaggcctag

SEQ ID NO: 105136 - DNA, 480 bp, Artificial Sequence
  Description of Artificial Sequence: Synthetic coding sequence
atgtgcaacacccccacctactgcgacctgggcaaggccgccaaggacgtgttcaacaagggctacggcttcggcatggtgaagatcgacctgaagaccaagagctgcagcggcgtggagttcagcaccagcggccacgcctacaccgacaccggcaaggccagcggcaacctggagaccaagtacaaggtgtgcaactacggcctgaccttcacccagaagtggaacaccgacaacaccctgggcaccgagatcagctgggagaacaagctggccgagggcctgaagctgaccctggacaccatcttcgtgcccaacaccggcaagaagagcggcaagctgaaggccagctacaagagagactgcttcagcgtgggcagcaacgtggacatcgacttcagcggccccaccatctacggctgggccgtgctggccttcgagggctggctggccggctaccagatgagcttcgacacctag

SEQ ID NO: 105137 - DNA, 1062 bp, Artificial Sequence
  Description of Artificial Sequence: Synthetic coding sequence
atggtgggcgacaccctgaagctgctgagccccctgatgaccagatacttcttcctgctgttctacagcaccgacagcagcgacctgaacgagaaccagcaccccctggacttcgacgagatggccttcggcaaggtgaagagcggcatcagcttcctgatccagaccggcgtgggcatcctgggcaacagcttcctgctgtgcttctacaacctgatcctgttcaccggccacaagctgagacccaccgacctgatcctgagccagctggccctggccaacagcatggtgctgttcttcaagggcatcccccagaccatggccgccttcggcctgaagtacctgctgaacgacaccggctgcaagttcgtgttctactaccacagagtgggcaccagagtgagcctgagcaccatctgcctgctgaacggcttccaggccatcaagctgaaccccagcatctgcagatggatggagatcaagatcagaagccccagattcatcgacttctgctgcctgctgtgctgggccccccacgtgctgatgaacgccagcgtgctgctgctggtgaacggccccctgaacagcaagaacagcagcgccaagaacaactacggctactgcagctacaaggccagcaagagattcagcagcctgcacgccgtgctgtacttcagccccgacttcatgagcctgggcttcatggtgtgggccagcggcagcatggtgttcttcctgtacagacacaagcagcaggtgcagcacaaccacagcaacagactgagctgcagacccagccaggaggccagagccacccacaccatcatggtgctggtgagcagcttcttcgtgttctacagcgtgcacagcttcctgaccatctggaccaccgtggtggccaaccccggccagtggatcgtgaccaacagcgtgctggtggccagctgcttccccgccagaagccccttcgtgctgatcatgagcgacacccacatcagccagttctgcttcgcctgcagaaccagaaagaccctgttccccaacctggtggtgatgccctag

SEQ ID NO: 105138 - DNA, 594 bp, Artificial Sequence
  Description of Artificial Sequence: Synthetic coding sequence
atggccgccgtgaaggacagctgcggcaagggcgagatggccaccggcaacggcagaagactgcacctgggcatccccgaggccgtgttcgtggaggacgtggacagcttcatgaagcagcccggcaacgagaccgccgacaccgtgctgaagaagctggacgagcagtaccagaagtacaagttcatggagctgaacctggcccagaagaagagaagactgaagggccagatccccgagatcaagcagaccctggagatcctgaagtacatgcagaagaagaaggagagcaccaacagcatggagaccagattcctgctggccgacaacctgtactgcaaggccagcgtgccccccaccgacaagatgtgcctgtggctgggcgccaacgtgatgctggagtacgacatcgacgaggcccaggccctgctggagaagaacctgagcaccgccaccaagaacctggacagcctggaggaggacctggacttcctgagagaccagttcaccaccaccgaggtgaacatggccagagtgtacaactgggacgtgaagagaagaaacaaggacgacagcaccaagaacaaggcctag

SEQ ID NO: 105139 - DNA, 579 bp, Artificial Sequence
  Description of Artificial Sequence: Synthetic coding sequence
atggccccccagcccatgatccacacccagcagggcctgagaaccagcagccccagcacccccagccccgagcaccaggaggacgtggacagcttcatgaagcagcccggcaacgagaccgccgacaccgtgctgaagaagctggacgagcagtaccagaagtacaagttcatggagctgaacctggcccagaagaagagaagactgaagggccagatccccgagatcaagcagaccctggagatcctgaagtacatgcagaagaagaaggagagcaccaacagcatggagaccagattcctgctggccgacaacctgtactgcaaggccagcgtgccccccaccgacaagatgtgcctgtggctgggcgccaacgtgatgctggagtacgacatcgacgaggcccaggccctgctggagaagaacctgagcaccgccaccaagaacctggacagcctggaggaggacctggacttcctgagagaccagttcaccaccaccgaggtgaacatggccagagtgtacaactgggacgtgaagagaagaaacaaggacgacagcaccaagaacaaggcctag

SEQ ID NO: 105140 - DNA, 702 bp, Artificial Sequence
  Description of Artificial Sequence: Synthetic coding sequence
atgagaccccagcagctgcacgccaccgagatcaccagcagcggcttcagactggcctggccccccctgctgaccgccgacagcggctactacgtgctggagctggtgcccagcgcccagcccggcgccgccagaagacagcagctgcccggcaacgccaccgactggatctgggccggcctggaccccgacaccgactacgacgtggccctggtgcccgagagcaacgtgagactgctgagaccccagatcctgagagtgagaaccagacccggcgaggccggccccggcgccagcggccccgagagcggcgccggccccgcccccacccagctggccgccctgcccgcccccgaggaggccggccccgagagaatcgtgatcagccacgccagacccagaagcctgagagtgagctgggcccccgccctgggcagcgccgccgccctgggctaccacgtgcagttcggccccctgagaggcggcgaggcccagagagtggaggtgcccgccggcagaaactgcaccaccctgcagggcctggcccccggcaccgcctacctggtgaccgtgaccgccgccttcagaagcggcagagagagcgccctgagcgccaaggcctgcacccccgacggccccagacccagacccagacccgtgcccagagcccccacccccggcaccgccagcagagagccctag

SEQ ID NO: 105141 - DNA, 1338 bp, Artificial Sequence
  Description of Artificial Sequence: Synthetic coding sequence
atgctgccctggaccgccctgggcctggccctgagcctgagactggccctggccagaagcggcgccgagagaggcccccccgccagcgcccccagaggcgacctgatgttcctgctggacagcagcgccagcgtgagccactacgagttcagcagagtgagagagttcgtgggccagctggtggcccccctgcccctgggcaccggcgccctgagagccagcctggtgcacgtgggcagcagaccctacaccgagttccccttcggccagcacagcagcggcgaggccgcccaggacgccgtgagagccagcgcccagagaatgggcgacacccacaccggcctggccctggtgtacgccaaggagcagctgttcgccgaggccagcggcgccagacccggcgtgcccaaggtgctggtgtgggtgaccgacggcggcagcagcgaccccgtgggcccccccatgcaggagctgaaggacctgggcgtgaccgtgttcatcgtgagcaccggcagaggcaacttcctggagctgagcgccgccgccagcgcccccgccgagaagcacctgcacttcgtggacgtggacgacctgcacatcatcgtgcaggagctgagaggcagcatcctggacgccatgagaccccagcagctgcacgccaccgagatcaccagcagcggcttcagactggcctggccccccctgctgaccgccgacagcggctactacgtgctggagctggtgcccagcgcccagcccggcgccgccagaagacagcagctgcccggcaacgccaccgactggatctgggccggcctggaccccgacaccgactacgacgtggccctggtgcccgagagcaacgtgagactgctgagaccccagatcctgagagtgagaaccagacccggcgaggccggccccggcgccagcggccccgagagcggcgccggccccgcccccacccagctggccgccctgcccgcccccgaggaggccggccccgagagaatcgtgatcagccacgccagacccagaagcctgagagtgagctgggcccccgccctgggcagcgccgccgccctgggctaccacgtgcagttcggccccctgagaggcggcgaggcccagagagtggaggtgcccgccggcagaaactgcaccaccctgcagggcctggcccccggcaccgcctacctggtgaccgtgaccgccgccttcagaagcggcagagagagcgccctgagcgccaaggcctgcacccccgacggccccagacccagacccagacccgtgcccagagcccccacccccggcaccgccagcagagagccctag

SEQ ID NO: 105142 - DNA, 195 bp, Artificial Sequence
  Description of Artificial Sequence: Synthetic coding sequence
atgctgccctggaccgccctgggcctggccctgagcctgagactggccctggccagaagcggcgccgagagaggcgcccagggccccggcagacacagagtgcactgccagcacagacccagacagctgcccggcgccgtgagcagatgcctgagcccctgcagagaggcccccgccctgtgcggcagaggctag

SEQ ID NO: 105143 - DNA, 978 bp, Artificial Sequence
  Description of Artificial Sequence: Synthetic coding sequence
atgcccagcagcaccgccatggccgtgggcgccctgagcagcagcctgctggtgacctgctgcctgatggtggccctgtgcagccccagcatccccctggagaagctggcccaggcccccgagcagcccggccaggagaagagagagcacgccagcagagacggccccggcagagtgaacgagctgggcagacccgccagagacgagggcggcagcggcagagactggaagagcaagagcggcagaggcctggccggcagagagccctggagcaagctgaagcaggcctgggtgagccagggcggcggcgccaaggccggcgacctgcaggtgagacccagaggcgacaccccccaggccgaggccctggccgccgccgcccaggacgccatcggccccgagctggcccccacccccgagccccccgaggagtacgtgtaccccgactacagaggcaagggctgcgtggacgagagcggcttcgtgtacgccatcggcgagaagttcgcccccggccccagcgcctgcccctgcctgtgcaccgaggagggccccctgtgcgcccagcccgagtgccccagactgcaccccagatgcatccacgtggacaccagccagtgctgcccccagtgcaaggagagaaagaactactgcgagttcagaggcaagacctaccagaccctggaggagttcgtggtgagcccctgcgagagatgcagatgcgaggccaacggcgaggtgctgtgcaccgtgagcgcctgcccccagaccgagtgcgtggaccccgtgtacgagcccgaccagtgctgccccatctgcaagaacggccccaactgcttcgccgagaccgccgtgatccccgccggcagagaggtgaagaccgacgagtgcaccatctgccactgcacctacgaggagggcacctggagaatcgagagacaggccatgtgcaccagacacgagtgcagacagatgtag

SEQ ID NO: 105144 - DNA, 750 bp, Artificial Sequence
  Description of Artificial Sequence: Synthetic coding sequence
atgaccagcgagaccctgtggtggctgatcaccctgaagaagcagctgggcgacaacgaggccatcacccaggagatcgtgggctgcgcccacctggagaactacgccctgaagatgttcctgtacgccgacaacgaggacagagccggcagattccacaagaacatgatcaagagcttctacaccgccagcctgctgatcgacgtgatcaccgtgttcggcgagctgaccgacgagaacgtgaagcacagaaagtacgccagatggaaggccacctacatccacaactgcctgaagaacggcgagaccccccaggccggccccgtgggcatcgaggaggacaacgacatcgaggagaacgaggacgccggcgccgccagcctgcccacccagcccacccagcccagcagcagcagcacctacgaccccagcaacatgcccagcggcaactacaccggcatccagatcccccccggcgcccacgcccccgccaacacccccgccgaggtgccccacagcaccggcgtggccagcaacaccatccagcccaccccccagaccatccccgccatcgaccccgccctgttcaacaccatcagccagggcgacgtgagactgacccccgaggacttcgccagagcccagaagtactgcaagtacgccggcagcgccctgcagtacgaggacgtgagcaccgccgtgcagaacctgcagaaggccctgaagctgctgaccaccggcagagagtag

SEQ ID NO: 105145 - DNA, 924 bp, Artificial Sequence
  Description of Artificial Sequence: Synthetic coding sequence
atggccgccctggcccccctgccccccctgcccgcccagttcaagagcatccagcaccacctgagaaccgcccaggagcacgacaagagagaccccgtggtggcctactactgcagactgtacgccatgcagaccggcatgaagatcgacagcaagacccccgagtgcagaaagttcctgagcaagctgatggaccagctggaggccctgaagaagcagctgggcgacaacgaggccatcacccaggagatcgtgggctgcgcccacctggagaactacgccctgaagatgttcctgtacgccgacaacgaggacagagccggcagattccacaagaacatgatcaagagcttctacaccgccagcctgctgatcgacgtgatcaccgtgttcggcgagctgaccgacgagaacgtgaagcacagaaagtacgccagatggaaggccacctacatccacaactgcctgaagaacggcgagaccccccaggccggccccgtgggcatcgaggaggacaacgacatcgaggagaacgaggacgccggcgccgccagcctgcccacccagcccacccagcccagcagcagcagcacctacgaccccagcaacatgcccagcggcaactacaccggcatccagatcccccccggcgcccacgcccccgccaacacccccgccgaggtgccccacagcaccggcgtggccagcaacaccatccagcccaccccccagaccatccccgccatcgaccccgccctgttcaacaccatcagccagggcgacgtgagactgacccccgaggacttcgccagagcccagaagtactgcaagtacgccggcagcgccctgcagtacgaggacgtgagcaccgccgtgcagaacctgcagaaggccctgaagctgctgaccaccggcagagagtag

SEQ ID NO: 105146 - DNA, 663 bp, Artificial Sequence
  Description of Artificial Sequence: Synthetic coding sequence
gagatggccgccctggcccccctgccccccctgcccgcccagttcaagagcatccagcaccacctgagaaccgcccaggagcacgacaagagagaccccgtggtggcctactactgcagactgtacgccatgcagaccggcatgaagatcgacagcaagacccccgagtgcagaaagttcctgagcaagctgatggaccagctggaggccctgaagaagcagctgggcgacaacgaggccatcacccaggagatcgtgggctgcgcccacctggagaactacgccctgaagatgttcctgtacgccgacaacgaggacagagccggcagattccacaagaacatgatcaagagcttctacaccgccagcctgctgatcgacgtgatcaccgtgttcggcgagctgaccgacgagaacgtgaagcacagaaagtacgccagatggaaggccacctacatccacaactgcaaggagtggggcgacagcagcagcagaccctgctggctgaagaagatcatgatcctgaagaagatgaagatgctggagcagcccctgtgccccctgagccagctgagccaccaccacctgcagctgatgacccagcacgccatcagacagctgtactggaacaccgacagcagcggctgcaccagaagcagctag

SEQ ID NO: 105147 - DNA, 669 bp, Artificial Sequence
  Description of Artificial Sequence: Synthetic coding sequence
atgaccagcgagaccctgtggtggctgatcaccctgaagaagcagctgggcgacaacgaggccatcacccaggagatcgtgggctgcgcccacctggagaactacgccctgaagatgttcctgtacgccgacaacgaggacagagccggcagattccacaagaacatgatcaagagcttctacaccgccagcctgctgatcgacgtgatcaccgtgttcggcgagctgaccgacgagaacgtgaagcacagaaagtacgccagatggaaggccacctacatccacaactgcctgaagaacggcgagaccccccaggccggccccgtgggcatcgaggaggacaacgacatcgaggagaacgaggacgccggcgccgccagcctgcccacccagcccacccagcccagcagcagcagcacctacgaccccagcaacatgcccagcggcaactacaccggcatccagatcccccccggcgcccacgcccccgccaacacccccgccgaggtgccccacagcaccggcgacgtgagactgacccccgaggacttcgccagagcccagaagtactgcaagtacgccggcagcgccctgcagtacgaggacgtgagcaccgccgtgcagaacctgcagaaggccctgaagctgctgaccaccggcagagagtag

SEQ ID NO: 105148 - DNA, 621 bp, Artificial Sequence
  Description of Artificial Sequence: Synthetic coding sequence
atggccgccaacaagcccaagggccagaacagcctggccctgcacaaggtgatcatggtgggcagcggcggcgtgggcaagagcgccctgaccctgcagttcatgtacgacgagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgtgcgtgttcagcatcaccgagatggagagcttcgccgccaccgccgacttcagagagcagatcctgagagtgaaggaggacgagaacgtgcccttcctgctggtgggcaacaagagcgacctggaggacaagagacaggtgagcgtggaggaggccaagaacagagccgagcagtggaacgtgaactacgtggagaccagcgccaagaccagagccaacgtggacaaggtgttcttcgacctgatgagagagatcagagccagaaagatggaggacagcaaggagaagaacggcaagaagaagagaaagagcctggccaagagaatcagagagagatgctgcatcctgtag

SEQ ID NO: 105149 - DNA, 306 bp, Artificial Sequence
  Description of Artificial Sequence: Synthetic coding sequence
atggccgccaacaagcccaagggccagaacagcctggccctgcacaaggtgatcatggtgggcagcggcggcgtgggcaagagcgccctgaccctgcagttcatgtacgacgagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgtgcgtgttcagcatcaccgagatggagagcttctag

SEQ ID NO: 105150 - DNA, 621 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgtacgacgagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgctggtgttcagcatcaccgagcacgagagcttcaccgccaccgccgagttcagagagcagatcctgagagtgaaggccgaggaggacaagatccccctgctggtggtgggcaacaagagcgacctggaggagagaagacaggtgcccgtggaggaggccagaagcaaggccgaggagtggggcgtgcagtacgtggagaccagcgccaagaccagagccaacgtggacaaggtgttcttcgacctgatgagagagatcagaaccaagaagatgagcgagaacaaggacaagaacggcaagaagagcagcaagaacaagaagagcttcaaggagagatgctgcctgctgtag

SEQ ID NO: 105151 - DNA, 684 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgaacgtgagcaagagcctggcctacgacaagaagaagtacaccgccaacaagaaggtggagggcatcctggagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgctggtgttcagcatcaccgagcacgagagcttcaccgccaccgccgagttcagagagcagatcctgagagtgaaggccgaggaggacaagatccccctgctggtggtgggcaacaagagcgacctggaggagagaagacaggtgcccgtggaggaggccagaagcaaggccgaggagtggggcgtgcagtacgtggagaccagcgccaagaccagagccaacgtggacaaggtgttcttcgacctgatgagagagatcagaaccaagaagatgagcgagaacaaggacaagaacggcaagaagagcagcaagaacaagaagagcttcaaggagagatgctgcctgctgtag

SEQ ID NO: 105152 - DNA, 504 bp, Artificial Sequence
  Description of Artificial Sequence: Synthetic coding sequence
atggccgccaacaagagcaagggccagagcagcctggccctgcacaaggtgatcatggtgggcagcggcggcgtgggcaagagcgccctgaccctgcagttcatgtacgacgagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgctggtgttcagcatcaccgagcacgagagcttcaccgccaccgccgagttcagagagcagatcctgagagtgaaggccgaggaggacaagatccccctgctggtggtgggcaacaagagcgacctggaggagagaagacaggtgcccgtggaggaggccagaagcaaggccgaggagtggggcgtgcagtacgtggagaccagcgccaagaccagagccaacgtggacaagtag

SEQ ID NO: 105153 - DNA, 621 bp, Artificial Sequence; identical to SEQ ID NO: 105150
  Description of Artificial Sequence: Synthetic coding sequence

SEQ ID NO: 105154 - DNA, 687 bp, Artificial Sequence
  Description of Artificial Sequence: Synthetic coding sequence
atgaagcagagacagagcgccctgcagtgggtgatctgcgtgagccagccccagaagaccagcgagatggccgccaacaagagcaagggccagagcagcctggccctgcacaaggtgatcatggtgggcagcggcggcgtgggcaagagcgccctgaccctgcagttcatgtacgacgagttcgtggaggactacgagcccaccaaggccgacagctacagaaagaaggtggtgctggacggcgaggaggtgcagatcgacatcctggacaccgccggccaggaggactacgccgccatcagagacaactacttcagaagcggcgagggcttcctgctggtgttcagcatcaccgagcacgagagcttcaccgccaccgccgagttcagagagcagatcctgagagtgaaggccgaggaggacaagatccccctgctggtggtgggcaacaagagcgacctggaggagagaagacaggtgcccgtggaggaggccagaagcaaggccgaggagtggggcgtgcagtacgtggagaccagcgccaagaccagagccaacgtggacaaggtgttcttcgacctgatgagagagatcagaaccaagaagatgagcgagaacaaggacaagaacggcaagaagagcagcaagaacaagaagagcttcaaggagagatgctgcctgctgtag

SEQ ID NO: 105155 - DNA, 1860 bp, Artificial Sequence
  Description of Artificial Sequence: Synthetic coding sequence
atggccagcggcgcctacaacccctacatcgagatcatcgagcagcccagacagagaggcatgagattcagatacaagtgcgagggcagaagcgccggcagcatccccggcgagcacagcaccgacaacaacagaacctaccccagcatccagatcatgaactactacggcaagggcaaggtgagaatcaccctggtgaccaagaacgacccctacaagccccacccccacgacctggtgggcaaggactgcagagacggctactacgaggccgagttcggccaggagagaagacccctgttcttccagaacctgggcatcagatgcgtgaagaagaaggaggtgaaggaggccatcatcaccagaatcaaggccggcatcaaccccttcaacgtgcccgagaagcagctgaacgacatcgaggactgcgacctgaacgtggtgagactgtgcttccaggtgttcctgcccgacgagcacggcaacctgaccaccgccctgccccccgtggtgagcaaccccatctacgacaacagagcccccaacaccgccgagctgagaatctgcagagtgaacaagaactgcggcagcgtgagaggcggcgacgagatcttcctgctgtgcgacaaggtgcagaaggacgacatcgaggtgagattcgtgctgaacgactgggaggccaagggcatcttcagccaggccgacgtgcacagacaggtggccatcgtgttcaagacccccccctactgcaaggccatcaccgagcccgtgaccgtgaagatgcagctgagaagacccagcgaccaggaggtgagcgagagcatggacttcagatacctgcccgacgagaaggacacctacggcaacaaggccaagaagcagaagaccaccctgctgttccagaagctgtgccaggaccacgtggagaccggcttcagacacgtggaccaggacggcctggagctgctgaccagcggcgacccccccaccctggccagccagagcgccggcatcaccgtgaacttccccgagagacccagacccggcctgctgggcagcatcggcgagggcagatacttcaagaaggagcccaacctgttcagccacgacgccgtggtgagagagatgcccaccggcgtgagcagccaggccgagagctactaccccagccccggccccatcagcagcggcctgagccaccacgccagcatggcccccctgcccagcagcagctggagcagcgtggcccaccccacccccagaagcggcaacaccaaccccctgagcagcttcagcaccagaaccctgcccagcaacagccagggcatcccccccttcctgagaatccccgtgggcaacgacctgaacgccagcaacgcctgcatctacaacaacgccgacgacatcgtgggcatggaggccagcagcatgcccagcgccgacctgtacggcatcagcgaccccaacatgctgagcaactgcagcgtgaacatgatgaccaccagcagcgacagcatgggcgagaccgacaaccccagactgctgagcatgaacctggagaaccccagctgcaacagcgtgctggaccccagagacctgagacagctgcaccagatgagcagcagcagcatgagcgccggcgccaacagcaacaccaccgtgttcgtgagccagagcgacgccttcgagggcagcgacttcagctgcgccgacaacagcatgatcaacgagagcggccccagcaacagcaccaaccccaacagccacggcttcgtgcaggacagccagtacagcggcatcggcagcatgcagaacgagcagctgagcgacagcttcccctacgagttcttccaggtgtag

SEQ ID NO: 105156 - DNA, 1764 bp, Artificial Sequence
  Description of Artificial Sequence: Synthetic coding sequence
atggccagcggcgcctacaacccctacatcgagatcatcgagcagcccagacagagaggcatgagattcagatacaagtgcgagggcagaagcgccggcagcatccccggcgagcacagcaccgacaacaacagaacctaccccagcatccagatcatgaactactacggcaagggcaaggtgagaatcaccctggtgaccaagaacgacccctacaagccccacccccacgacctggtgggcaaggactgcagagacggctactacgaggccgagttcggccaggagagaagacccctgttcttccagaacctgggcatcagatgcgtgaagaagaaggaggtgaaggaggccatcatcaccagaatcaaggccggcatcaaccccttcaacgtgcccgagaagcagctgaacgacatcgaggactgcgacctgaacgtggtgagactgtgcttccaggtgttcctgcccgacgagcacggcaacctgaccaccgccctgccccccgtggtgagcaaccccatctacgacaacagagcccccaacaccgccgagctgagaatctgcagagtgaacaagaactgcggcagcgtgagaggcggcgacgagatcttcctgctgtgcgacaaggtgcagaaggacgacatcgaggtgagattcgtgctgaacgactgggaggccaagggcatcttcagccaggccgacgtgcacagacaggtggccatcgtgttcaagacccccccctactgcaaggccatcaccgagcccgtgaccgtgaagatgcagctgagaagacccagcgaccaggaggtgagcgagagcatggacttcagatacctgcccgacgagaaggacacctacggcaacaaggccaagaagcagaagaccaccctgctgttccagaagctgtgccaggaccacgtgaacttccccgagagacccagacccggcctgctgggcagcatcggcgagggcagatacttcaagaaggagcccaacctgttcagccacgacgccgtggtgagagagatgcccaccggcgtgagcagccaggccgagagctactaccccagccccggccccatcagcagcggcctgagccaccacgccagcatggcccccctgcccagcagcagctggagcagcgtggcccaccccacccccagaagcggcaacaccaaccccctgagcagcttcagcaccagaaccctgcccagcaacagccagggcatcccccccttcctgagaatccccgtgggcaacgacctgaacgccagcaacgcctgcatctacaacaacgccgacgacatcgtgggcatggaggccagcagcatgcccagcgccgacctgtacggcatcagcgaccccaacatgctgagcaactgcagcgtgaacatgatgaccaccagcagcgacagcatgggcgagaccgacaaccccagactgctgagcatgaacctggagaaccccagctgcaacagcgtgctggaccccagagacctgagacagctgcaccagatgagcagcagcagcatgagcgccggcgccaacagcaacaccaccgtgttcgtgagccagagcgacgccttcgagggcagcgacttcagctgcgccgacaacagcatgatcaacgagagcggccccagcaacagcaccaaccccaacagccacggcttcgtgcaggacagccagtacagcggcatcggcagcatgcagaacgagcagctgagcgacagcttcccctacgagttcttccaggtgtag

SEQ ID NO: 105157 - DNA, 1647 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggaggacatcgaggtgtacttcaccggccccggctgggaggccagaggcagcttcagccaggccgacgtgcacagacaggtggccatcgtgttcagaacccccccctacgccgaccccagcctgcaggcccccgtgagagtgagcatgcagctgagaagacccagcgacagagagctgagcgagcccatggagttccagtacctgcccgacaccgacgacagacacagaatcgaggagaagagaaagagaacctacgagaccttcaagagcatcatgaagaagagccccttcagcggccccaccgaccccagacccccccccagaagaatcgccgtgcccagcagaagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcaccagactggtgaccggcgcccagagaccccccgaccccgcccccgcccccctgggcgcccccggcctgcccaacggcctgctgagcggcgacgaggacttcagcagcatcgccgacatggacttcagcgccctgctgagccagatcagcagctag

SEQ ID NO: 105158 - DNA, 1656 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggtgcccatcgaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggaggacatcgaggtgtacttcaccggccccggctgggaggccagaggcagcttcagccaggccgacgtgcacagacaggtggccatcgtgttcagaacccccccctacgccgaccccagcctgcaggcccccgtgagagtgagcatgcagctgagaagacccagcgacagagagctgagcgagcccatggagttccagtacctgcccgacaccgacgacagacacagaatcgaggagaagagaaagagaacctacgagaccttcaagagcatcatgaagaagagccccttcagcggccccaccgaccccagacccccccccagaagaatcgccgtgcccagcagaagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgcccccgtgcccgtgctggcccccggccccccccaggccgtggccccccccgcccccaagcccacccaggccggcgagggcaccctgagcgaggccctgctgcagctgcagttcgacgacgaggacctgggcgccctgctgggcaacagcaccgaccccgccgtgttcaccgacctggccagcgtggacaacagcgagttccagcagctgctgaaccagggcatccccgtggccccccacaccaccgagcccatgctgatggagtaccccgaggccatcaccagactggtgaccggcgcccagagaccccccgaccccgcccccgcccccctgggcgcccccggcctgcccaacggcctgctgagcggcgacgaggacttcagcagcatcgccgacatggacttcagcgccctgctgagccagatcagcagctag

SEQ ID NO: 105159 - DNA, 741 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggtgcccatcgaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggaggacatcgaggtgtgcccccaggccagcacccccgccctgagcctgtacgtgatccccgagcaccaccagctgtag

SEQ ID NO: 105160 - DNA, 1134 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggtgcccatcgaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggaggacatcgaggtgtacttcaccggccccggctgggaggccagaggcagcttcagccaggccgacgtgcacagacaggtggccatcgtgttcagaacccccccctacgccgaccccagcctgcaggcccccgtgagagtgagcatgcagctgagaagacccagcgacagagagctgagcgagcccatggagttccagtacctgcccgacaccgacgacagacacagaatcgaggagaagagaaagagaacctacgagaccttcaagagcatcatgaagaagagccccttcagcggccccaccgaccccagacccccccccagaagaatcgccgtgcccagcagaagcagcgccagcgtgcccaagcccggcaaggacttcctgctgagccactggaacgacagattcagcagcgtgcagctgagaagcagcggcgacgaggacagctgggcccccctgcagacctactag

SEQ ID NO: 105161 - DNA, 714 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggtgcccatcgaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggcccacggcatccccgtgcccgccagatacagaagaagcagccccgactag

SEQ ID NO: 105162 - DNA, 1278 bp, Artificial Sequence
  Description of Artificial Sequence: Synthetic coding sequence
atggacgagctgttccccctgatcttccccgccgagcccgcccaggccagcggcccctacgtggagatcatcgagcagcccaagcagagaggcatgagattcagatacaagtgcgagggcagaagcgccggcagcatccccggcgagagaagcaccgacaccaccaagacccaccccaccatcaaggtgtggatgagcggccccctgtacttcggccagatcaacggctacaccggccccggcaccgtgagaatcagcctggtgaccaaggaccccccccacagaccccacccccacgagctggtgggcaaggactgcagagacggcttctacgaggccgagctgtgccccgacagatgcatccacagcttccagaacctgggcatccagtgcgtgaagaagagagacctggagcaggccatcagccagagaatccagaccaacaacaaccccttccaggtgcccatcgaggagcagagaggcgactacgacctgaacgccgtgagactgtgcttccaggtgaccgtgagagaccccagcggcagacccctgagactgccccccgtgctgagccaccccatcttcgacaacagagcccccaacaccgccgagctgaagatctgcagagtgaacagaaacagcggcagctgcctgggcggcgacgagatcttcctgctgtgcgacaaggtgcagaaggaggacatcgaggtgtacttcaccggccccggctgggaggccagaggcagcttcagccaggccgacgtgcacagacaggtggccatcgtgttcagaacccccccctacgccgaccccagcctgcaggcccccgtgagagtgagcatgcagctgagaagacccagcgacagagagctgagcgagcccatggagttccagtacctgcccgacaccgacgacagacacagaatcgaggagaagagaaagagaacctacgagaccttcaagagcatcatgaagaagagccccttcagcggccccaccgaccccagacccccccccagaagaatcgccgtgcccagcagaagcagcgccagcgtgcccaagcccgccccccagccctaccccttcaccagcagcctgagcaccatcaactacgacgagttccccaccatggtgttccccagcggccagatcagccaggccagcgccctggcccccgcccccccccaggtgctgccccaggcccccgcccccgcccccgcccccgccatggtgagcgccctggcccaggcccccgagcactgggtggccggcgactag

SEQ ID NO: 105163 - DNA, 1314 bp, Artificial Sequence
  Description of Artificial Sequence: Synthetic coding sequence
atgacccagttcctgccccccaacctgctggccctgttcgcccccagagaccccatcccctacctgccccccctggagaagctgccccacgagaagcaccacaaccagccctactgcggcatcgccccctacatcagagagttcgaggaccccagagacgcccccccccccaccagagccgagaccagagaggagagaatggagagaaagagaagagagaagatcgagagaagacagcaggaggtggagaccgagctgaagatgtgggacccccacaacgaccccaacgcccagggcgacgccttcaagaccctgttcgtggccagagtgaactacgacaccaccgagagcaagctgagaagagagttcgaggtgtacggccccatcaagagaatccacatggtgtacagcaagagaagcggcaagcccagaggctacgccttcatcgagtacgagcacgagagagacatgcacagcgcctacaagcacgccgacggcaagaagatcgacggcagaagagtgctggtggacgtggagagaggcagaaccgtgaagggctggagacccagaagactgggcggcggcctgggcggcaccagaagaggcggcgccgacgtgaacatcagacacagcggcagagacgacaccagcagatacgacgagagacccggccccagccccctgccccacagagacagagacagagacagagagagagagagaagagagagaagcagagagagagacaaggagagagagagaagaagaagcagaagcagagacagaagaagaagaagcagaagcagagacaaggaggagagaagaagaagcagagagagaagcaaggacaaggacagagacagaaagagaagaagcagcagaagcagagagagagccagaagagagagagagagaaaggaggagctgagaggcggcggcggcgacatggccgagcccagcgaggccggcgacgccccccccgacgacggcccccccggcgagctgggccccgacggccccgacggccccgaggagaagggcagagacagagacagagagagaagaagaagccacagaagcgagagagagagaagaagagacagagacagagacagagacagagacagagagcacaagagaggcgagagaggcagcgagagaggcagagacgaggccagaggcggcggcggcggccaggacaacggcctggagggcctgggcaacgacagcagagacatgtacatggagagcgagggcggcgacggctacctggcccccgagaacggctacctgatggaggccgcccccgagtag

SEQ ID NO: 105164 - DNA, 1731 bp, Artificial Sequence
  Description of Artificial Sequence: Synthetic coding sequence
atgctgagaagcggccccgccagcggccccagcgtgcccaccggcagagccatgcccagcagaagagtggccagaccccccgccgcccccgagctgggcgccctgggcagccccgacctgagcagcctgagcctggccgtgagcagaagcaccgagatcatcgacgagtacatcaaggagaacggcttcggcctggacggcggccagcccggccccggcgagggcctgcccagactggtgagcagaggcgccgccagcctgagcaccgtgaccctgggccccgtggccccccccgccaccccccccccctggggctgccccctgggcagactggtgagccccgcccccggccccggcccccagccccacctggtgatcaccgagcagcccaagcagagaggcatgagattcagatacgagtgcgagggcagaagcgccggcagcatcctgggcgagagcagcaccgaggccagcaagaccctgcccgccatcgagctgagagactgcggcggcctgagagaggtggaggtgaccgcctgcctggtgtggaaggactggccccacagagtgcacccccacagcctggtgggcaaggactgcaccgacggcatctgcagagtgagactgagaccccacgtgagccccagacacagcttcaacaacctgggcatccagtgcgtgagaaagaaggagatcgaggccgccatcgagagaaagatccagctgggcatcgacccctacaacgccggcagcctgaagaaccaccaggaggtggacatgaacgtggtgagaatctgcttccaggccagctacagagaccagcagggccagatgagaagaatggaccccgtgctgagcgagcccgtgtacgacaagaagagcaccaacaccagcgagctgagaatctgcagaatcaacaaggagagcggcccctgcaccggcggcgaggagctgtacctgctgtgcgacaaggtgcagaaggaggacatcagcgtggtgttcagcagagccagctgggagggcagagccgacttcagccaggccgacgtgcacagacagatcgccatcgtgttcaagacccccccctacgaggacctggagatcgtggagcccgtgaccgtgaacgtgttcctgcagagactgaccgacggcgtgtgcagcgagcccctgcccttcacctacctgcccagagaccacgacagctacggcgtggacaagaagagaaagagaggcatgcccgacgtgctgggcgagctgaacagcagcgacccccacggcatcgagagcaagagaagaaagaagaagcccgccatcctggaccacttcctgcccaaccacggcagcggccccttcctgccccccagcgccctgctgcccgaccccgacttcttcagcggcaccgtgagcctgcccggcctggagccccccggcggccccgacctgctggacgacggcttcgcctacgaccccaccgcccccaccctgttcaccatgctggacctgctgccccccgcccccccccacgccagcgccgtggtgtgcagcggcggcgccggcgccgtggtgggcgagacccccggccccgagcccctgaccctggacagctaccaggcccccggccccggcgacggcggcaccgccagcctggtgggcagcaacatgttccccaaccactacagagaggccgccttcggcggcggcctgctgagccccggccccgaggccacctag

SEQ ID NO: 105165 - DNA, 1740 bp, Artificial Sequence
  Description of Artificial Sequence: Synthetic coding sequence
atgctgagaagcggccccgccagcggccccagcgtgcccaccggcagagccatgcccagcagaagagtggccagaccccccgccgcccccgagctgggcgccctgggcagccccgacctgagcagcctgagcctggccgtgagcagaagcaccgacgagctggagatcatcgacgagtacatcaaggagaacggcttcggcctggacggcggccagcccggccccggcgagggcctgcccagactggtgagcagaggcgccgccagcctgagcaccgtgaccctgggccccgtggccccccccgccaccccccccccctggggctgccccctgggcagactggtgagccccgcccccggccccggcccccagccccacctggtgatcaccgagcagcccaagcagagaggcatgagattcagatacgagtgcgagggcagaagcgccggcagcatcctgggcgagagcagcaccgaggccagcaagaccctgcccgccatcgagctgagagactgcggcggcctgagagaggtggaggtgaccgcctgcctggtgtggaaggactggccccacagagtgcacccccacagcctggtgggcaaggactgcaccgacggcatctgcagagtgagactgagaccccacgtgagccccagacacagcttcaacaacctgggcatccagtgcgtgagaaagaaggagatcgaggccgccatcgagagaaagatccagctgggcatcgacccctacaacgccggcagcctgaagaaccaccaggaggtggacatgaacgtggtgagaatctgcttccaggccagctacagagaccagcagggccagatgagaagaatggaccccgtgctgagcgagcccgtgtacgacaagaagagcaccaacaccagcgagctgagaatctgcagaatcaacaaggagagcggcccctgcaccggcggcgaggagctgtacctgctgtgcgacaaggtgcagaaggaggacatcagcgtggtgttcagcagagccagctgggagggcagagccgacttcagccaggccgacgtgcacagacagatcgccatcgtgttcaagacccccccctacgaggacctggagatcgtggagcccgtgaccgtgaacgtgttcctgcagagactgaccgacggcgtgtgcagcgagcccctgcccttcacctacctgcccagagaccacgacagctacggcgtggacaagaagagaaagagaggcatgcccgacgtgctgggcgagctgaacagcagcgacccccacggcatcgagagcaagagaagaaagaagaagcccgccatcctggaccacttcctgcccaaccacggcagcggccccttcctgccccccagcgccctgctgcccgaccccgacttcttcagcggcaccgtgagcctgcccggcctggagccccccggcggccccgacctgctggacgacggcttcgcctacgaccccaccgcccccaccctgttcaccatgctggacctgctgccccccgcccccccccacgccagcgccgtggtgtgcagcggcggcgccggcgccgtggtgggcgagacccccggccccgagcccctgaccctggacagctaccaggcccccggccccggcgacggcggcaccgccagcctggtgggcagcaacatgttccccaaccactacagagaggccgccttcggcggcggcctgctgagccccggccccgaggccacctag

SEQ ID NO: 105166 - DNA, 2187 bp, Artificial Sequence
  Description of Artificial Sequence: Synthetic coding sequence
atggaggccgccgccggcggcagaggctgcttccagccccaccccggcctgcagaagaccctggagcagttccacctgagcagcatgagcagcctgggcggccccgccgccttcagcgccagatgggcccaggaggcctacaagaaggagagcgccaaggaggccggcgccgccgccgtgcccgcccccgtgcccgccgccaccgagcccccccccgtgctgcacctgcccgccatccagccccccccccccgtgctgcccggccccttcttcatgcccagcgacagaagcaccgagagatgcgagaccgtgctggagggcgagaccatcagctgcttcgtggtgggcggcgagaagagactgtgcctgccccagatcctgaacagcgtgctgagagacttcagcctgcagcagatcaacgccgtgtgcgacgagctgcacatctactgcagcagatgcaccgccgaccagctggagatcctgaaggtgatgggcatcctgcccttcagcgcccccagctgcggcctgatcaccaagaccgacgccgagagactgtgcaacgccctgctgtacggcggcgcctacccccccccctgcaagaaggagctggccgccagcctggccctgggcctggagctgagcgagagaagcgtgagagtgtaccacgagtgcttcggcaagtgcaagggcctgctggtgcccgagctgtacagcagccccagcgccgcctgcatccagtgcctggactgcagactgatgtaccccccccacaagttcgtggtgcacagccacaaggccctggagaacagaacctgccactggggcttcgacagcgccaactggagagcctacatcctgctgagccaggactacaccggcaaggaggagcaggccagactgggcagatgcctggacgacgtgaaggagaagttcgactacggcaacaagtacaagagaagagtgcccagagtgagcagcgagccccccgccagcatcagacccaagaccgacgacaccagcagccagagccccgcccccagcgagaaggacaagcccagcagctggctgagaaccctggccggcagcagcaacaagagcctgggctgcgtgcaccccagacagagactgagcgccttcagaccctggagccccgccgtgagcgccagcgagaaggagctgagcccccacctgcccgccctgatcagagacagcttctacagctacaagagcttcgagaccgccgtggcccccaacgtggccctggccccccccgcccagcagaaggtggtgagcagccccccctgcgccgccgccgtgagcagagcccccgagcccctggccacctgcacccagcccagaaagagaaagctgaccgtggacacccccggcgcccccgagaccctggcccccgtggccgcccccgaggaggacaaggacagcgaggccgaggtggaggtggagagcagagaggagttcaccagcagcctgagcagcctgagcagccccagcttcaccagcagcagcagcgccaaggacctgggcagccccggcgccagagccctgcccagcgccgtgcccgacgccgccgcccccgccgacgcccccagcggcctggaggccgagctggagcacctgagacaggccctggagggcggcctggacaccaaggaggccaaggagaagttcctgcacgaggtggtgaagatgagagtgaagcaggaggagaagctgagcgccgccctgcaggccaagagaagcctgcaccaggagctggagttcctgagagtggccaagaaggagaagctgagagaggccaccgaggccaagagaaacctgagaaaggagatcgagagactgagagccgagaacgagaagaagatgaaggaggccaacgagagcagactgagactgaagagagagctggagcaggccagacaggccagagtgtgcgacaagggctgcgaggccggcagactgagagccaagtacagcgcccagatcgaggacctgcaggtgaagctgcagcacgccgaggccgacagagagcagctgagagccgacctgctgagagagagagaggccagagagcacctggagaaggtggtgaaggagctgcaggagcagctgtggcccagagccagacccgaggccgccggcagcgagggcgccgccgagctggagccctag

SEQ ID NO: 105167 - DNA, 1632 bp, Artificial Sequence
  Description of Artificial Sequence: Synthetic coding sequence
atgggctgcatcaagagcaaggagaacaagagccccgccatcaagtacagacccgagaacacccccgagcccgtgagcaccagcgtgagccactacggcgccgagcccaccaccgtgagcccctgccccagcagcagcgccaagggcaccgccgtgaacttcagcagcctgagcatgacccccttcggcggcagcagcggcgtgacccccttcggcggcgccagcagcagcttcagcgtggtgcccagcagctaccccgccggcctgaccggcggcgtgaccatcttcgtggccctgtacgactacgaggccagaaccaccgaggacctgagcttcaagaagggcgagagattccagatcatcaacaacaccgagggcgactggtgggaggccagaagcatcgccaccggcaagaacggctacatccccagcaactacgtggcccccgccgacagcatccaggccgaggagtggtacttcggcaagatgggcagaaaggacgccgagagactgctgctgaaccccggcaaccagagaggcatcttcctggtgagagagagcgagaccaccaagggcgcctacagcctgagcatcagagactgggacgagatcagaggcgacaacgtgaagcactacaagatcagaaagctggacaacggcggctactacatcaccaccagagcccagttcgacaccctgcagaagctggtgaagcactacaccgagcacgccgacggcctgtgccacaagctgaccaccgtgtgccccaccgtgaagccccagacccagggcctggccaaggacgcctgggagatccccagagagagcctgagactggaggtgaagctgggccagggctgcttcggcgaggtgtggatgggcacctggaacggcaccaccaaggtggccatcaagaccctgaagcccggcaccatgatgcccgaggccttcctgcaggaggcccagatcatgaagaagctgagacacgacaagctggtgcccctgtacgccgtggtgagcgaggagcccatctacatcgtgaccgagttcatgagcaagggcagcctgctggacttcctgaaggagggcgacggcaagtacctgaagctgccccagctggtggacatggccgcccagatcgccgacggcatggcctacatcgagagaatgaactacatccacagagacctgagagccgccaacatcctggtgggcgagaacctggtgtgcaagatcgccgacttcggcctggccagactgatcgaggacaacgagtacaccgccagacagggcgccaagttccccatcaagtggaccgcccccgaggccgccctgtacggcagattcaccatcaagagcgacgtgtggagcttcggcatcctgcagaccgagctggtgaccaagggcagagtgccctaccccggcatggtgaacagagaggtgctggagcaggtggagagaggctacagaatgccctgcccccagggctgccccgagagcctgcacgagctgatgaacctgtgctggaagaaggaccccgacgagagacccaccttcgagtacatccagagcttcctggaggactacttcaccgccaccgagccccagtaccagcccggcgagaacctgtag

SEQ ID NO: 105168 - DNA, 1632 bp, Artificial Sequence; identical to SEQ ID NO: 105167
  Description of Artificial Sequence: Synthetic coding sequence

SEQ ID NO: 105169 - DNA, 1632 bp, Artificial Sequence; identical to SEQ ID NO: 105167
  Description of Artificial Sequence: Synthetic coding sequence

SEQ ID NO: 105170 - DNA, 1539 bp, Artificial Sequence
  Description of Artificial Sequence: Synthetic coding sequence
atgggctgcatcaagagcaagggcaaggacagcctgagcgacgacggcgtggacctgaagacccagcccgtgagaaacaccgagagaaccatctacgtgagagaccccaccagcaacaagcagcagagacccgtgcccgagagccagctgctgcccggccagagattccagaccaaggaccccgaggagcagggcgacatcgtggtggccctgtacccctacgacggcatccaccccgacgacctgagcttcaagaagggcgagaagatgaaggtgctggaggagcacggcgagtggtggaaggccaagagcctgctgaccaagaaggagggcttcatccccagcaactacgtggccaagctgaacaccctggagaccgaggagtggttcttcaaggacatcaccagaaaggacgccgagagacagctgctggcccccggcaacagcgccggcgccttcctgatcagagagagcgagaccctgaagggcagcttcagcctgagcgtgagagacttcgaccccgtgcacggcgacgtgatcaagcactacaagatcagaagcctggacaacggcggctactacatcagccccagaatcaccttcccctgcatcagcgacatgatcaagcactaccagaagcaggccgacggcctgtgcagaagactggagaaggcctgcatcagccccaagccccagaagccctgggacaaggacgcctgggagatccccagagagagcatcaagctggtgaagagactgggcgccggccagttcggcgaggtgtggatgggctactacaacaacagcaccaaggtggccgtgaagaccctgaagcccggcaccatgagcgtgcaggccttcctggaggaggccaacctgatgaagaccctgcagcacgacaagctggtgagactgtacgccgtggtgaccagagaggagcccatctacatcatcaccgagtacatggccaagggcagcctgctggacttcctgaagagcgacgagggcggcaaggtgctgctgcccaagctgatcgacttcagcgcccagatcgccgagggcatggcctacatcgagagaaagaactacatccacagagacctgagagccgccaacgtgctggtgagcgagagcctgatgtgcaagatcgccgacttcggcctggccagagtgatcgaggacaacgagtacaccgccagagagggcgccaagttccccatcaagtggaccgcccccgaggccatcaacttcggctgcttcaccatcaagagcgacgtgtggagcttcggcatcctgctgtacgagatcgtgacctacggcaagatcccctaccccggcagaaccaacgccgacgtgatgaccgccctgagccagggctacagaatgcccagagtggagaactgccccgacgagctgtacgacatcatgaagatgtgctggaaggagaaggccgaggagagacccaccttcgactacctgcagagcgtgctggacgacttctacaccgccaccgagggccagtaccagcagcagccctag

SEQ ID NO: 105171 - DNA, 453 bp, Artificial Sequence
  Description of Artificial Sequence: Synthetic coding sequence
atgggctgcatcaagagcaagggcaaggacagcctgagcgacgacggcgtggacctgaagacccagcccgtgagaaacaccgagagaaccatctacgtgagagaccccaccagcaacaagcagcagagacccgtgcccgagagccagctgctgcccggccagagattccagaccaaggaccccgaggagcagggcgacatcgtggtggccctgtacccctacgacggcatccaccccgacgacctgagcttcaagaagggcgagaagatgaaggtgctggaggagcacggcgagtggtggaaggccaagagcctgctgaccaagaaggagggcttcatccccagcaactacgtggccaagctgaacaccctggagaccgaggagtggttcttcaaggacatcaccagaaaggacgccgagagacagctgctggcccccggcaacagcgcctag

SEQ ID NO: 105172 - DNA, 1476 bp, Artificial Sequence
  Description of Artificial Sequence: Synthetic coding sequence
atgggctgcatcaagagcaagggcaaggacagcctgagcgacgacggcgtggacctgaagacccagcccgtgcccgagagccagctgctgcccggccagagattccagaccaaggaccccgaggagcagggcgacatcgtggtggccctgtacccctacgacggcatccaccccgacgacctgagcttcaagaagggcgagaagatgaaggtgctggaggagcacggcgagtggtggaaggccaagagcctgctgaccaagaaggagggcttcatccccagcaactacgtggccaagctgaacaccctggagaccgaggagtggttcttcaaggacatcaccagaaaggacgccgagagacagctgctggcccccggcaacagcgccggcgccttcctgatcagagagagcgagaccctgaagggcagcttcagcctgagcgtgagagacttcgaccccgtgcacggcgacgtgatcaagcactacaagatcagaagcctggacaacggcggctactacatcagccccagaatcaccttcccctgcatcagcgacatgatcaagcactaccagaagcaggccgacggcctgtgcagaagactggagaaggcctgcatcagccccaagccccagaagccctgggacaaggacgcctgggagatccccagagagagcatcaagctggtgaagagactgggcgccggccagttcggcgaggtgtggatgggctactacaacaacagcaccaaggtggccgtgaagaccctgaagcccggcaccatgagcgtgcaggccttcctggaggaggccaacctgatgaagaccctgcagcacgacaagctggtgagactgtacgccgtggtgaccagagaggagcccatctacatcatcaccgagtacatggccaagggcagcctgctggacttcctgaagagcgacgagggcggcaaggtgctgctgcccaagctgatcgacttcagcgcccagatcgccgagggcatggcctacatcgagagaaagaactacatccacagagacctgagagccgccaacgtgctggtgagcgagagcctgatgtgcaagatcgccgacttcggcctggccagagtgatcgaggacaacgagtacaccgccagagagggcgccaagttccccatcaagtggaccgcccccgaggccatcaacttcggctgcttcaccatcaagagcgacgtgtggagcttcggcatcctgctgtacgagatcgtgacctacggcaagatcccctaccccggcagaaccaacgccgacgtgatgaccgccctgagccagggctacagaatgcccagagtggagaactgccccgacgagctgtacgacatcatgaagatgtgctggaaggagaaggccgaggagagacccaccttcgactacctgcagagcgtgctggacgacttctacaccgccaccgagggccagtaccagcagcagccctag

SEQ ID NO: 105173 - DNA, 993 bp, Artificial Sequence
  Description of Artificial Sequence: Synthetic coding sequence
atggccgccgtggacagcttctacctgctgtacagagagatcgccagaagctgcaactgctacatggaggccctggccctggtgggcgcctggtacaccgccagaaagagcatcaccgtgatctgcgacttctacagcctgatcagactgcacttcatccccagactgggcagcagagccgacctgatcaagcagtacggcagatgggccgtggtgagcggcgccaccgacggcatcggcaaggcctacgccgaggagctggccagcagaggcctgaacatcatcctgatcagcagaaacgaggagaagctgcaggtggtggccaaggacatcgccgacacctacaaggtggagaccgacatcatcgtggccgacttcagcagcggcagagagatctacctgcccatcagagaggccctgaaggacaaggacgtgggcatcctggtgaacaacgtgggcgtgttctacccctacccccagtacttcacccagctgagcgaggacaagctgtgggacatcatcaacgtgaacatcgccgccgccagcctgatggtgcacgtggtgctgcccggcatggtggagagaaagaagggcgccatcgtgaccatcagcagcggcagctgctgcaagcccaccccccagctggccgccttcagcgccagcaaggcctacctggaccacttcagcagagccctgcagtacgagtacgccagcaagggcatcttcgtgcagagcctgatccccttctacgtggccaccagcatgaccgcccccagcaacttcctgcacagatgcagctggctggtgcccagccccaaggtgtacgcccaccacgccgtgagcaccctgggcatcagcaagagaaccaccggctactggagccacagcatccagttcctgttcgcccagtacatgcccgagtggctgtgggtgtggggcgccaacatcctgaacagaagcctgagaaaggaggccctgagctgcaccgcctag

SEQ ID NO: 105174 - DNA, 336 bp, Artificial Sequence
  Description of Artificial Sequence: Synthetic coding sequence
atgggcagcagcagcttcctggtgctgatggtgagcctggtgctggtgaccctggtggccgtggagggcgtgaaggagggcatcgagaaggccggcgtgtgccccgccgacaacgtgagatgcttcaagagcgaccccccccagtgccacaccgaccaggactgcctgggcgagagaaagtgctgctacctgcactgcggcttcaagtgcgtgatccccgtgaaggagctggaggagggcggcaacaaggacgaggacgtgagcagaccctaccccgagcccggctgggaggccaagtgccccggcagcagcagcaccagatgcccccagaagtag

SEQ ID NO: 105175 - DNA, 675 bp, Artificial Sequence
  Description of Artificial Sequence: Synthetic coding sequence
atgagaacccagagcctgctgctgctgggcgccctgctggccgtgggcagccagctgcccgccgtgttcggcagaaagaagggcgagaagagcggcggctgcccccccgacgacggcccctgcctgctgagcgtgcccgaccagtgcgtggaggacagccagtgccccctgaccagaaagtgctgctacagagcctgcttcagacagtgcgtgcccagagtgagcgtgaagctgggcagctgccccgaggaccagctgagatgcctgagccccatgaaccacctgtgccacaaggacagcgactgcagcggcaagaagagatgctgccacagcgcctgcggcagagactgcagagaccccgccagaggcaccgcccccggctgccccggccaggccaacagcgacctgggcagcgtggccctgcacctgagctggggccccaccgagagagtgcacgacggcagacccggcgccctgcccgccggccagcactacctgtaccagagatggttccagcccagcgacaaccactggcccgccgacaccagcctgcagcccatccacccctggttcctgctgctgggcgtgaaggtgcacagcctgagcagcgaggagggcctgtgcatcacccccgtgctgtgcaccaccgccatcagagccagccaccccagctag

SEQ ID NO: 105176 - DNA, 372 bp, Artificial Sequence
  Description of Artificial Sequence: Synthetic coding sequence
atgagaacccagagcctgctgctgctgggcgccctgctggccgtgggcagccagctgcccgccgtgttcggcagaaagaagggcgagaagagcggcggctgcccccccgacgacggcccctgcctgctgagcgtgcccgaccagtgcgtggaggacagccagtgccccctgaccagaaagtgctgctacagagcctgcttcagacagtgcgtgcccagagtgagcgtgaagctgggcagctgccccgaggaccagctgagatgcctgagccccatgaaccacctgtgccacaaggacagcgactgcagcggcaagaagagatgctgccacagcgcctgcggcagagactgcagagaccccgccagaggctag

SEQ ID NO: 105177 - DNA, 1647 bp, Artificial Sequence
  Description of Artificial Sequence: Synthetic coding sequence
atgcccgccctgagacccctgctgcccctgctgctgctgctgagactgaccagcggcgccggcctgctgcccggcctgggcagccaccccggcgtgtgccccaaccagctgagccccaacctgtgggtggacgcccagagcacctgcgagagagagtgcagcagagaccaggactgcgccgccgccgagaagtgctgcatcaacgtgtgcggcctgcacagctgcgtggccgccagattccccggcagccccgccgcccccaccaccgccgccagctgcgagggcttcgtgtgcccccagcagggcagcgactgcgacatctgggacggccagcccgtgtgcagatgcagagacagatgcgagaaggagcccagcttcacctgcgccagcgacggcctgacctactacaacagatgctacatggacgccgaggcctgcctgagaggcctgcacctgcacatcgtgccctgcaagcacgtgctgagctggccccccagcagccccggcccccccgagaccaccgccagacccacccccggcgccgcccccgtgccccccgccctgtacagcagccccagcccccaggccgtgcaggtgggcggcaccgccagcctgcactgcgacgtgagcggcagacccccccccgccgtgacctgggagaagcagagccaccagagagagaacctgatcatgagacccgaccagatgtacggcaacgtggtggtgaccagcatcggccagctggtgctgtacaacgccagacccgaggacgccggcctgtacacctgcaccgccagaaacgccgccggcctgctgagagccgacttccccctgagcgtggtgcagagagagcccgccagagacgccgcccccagcatccccgcccccgccgagtgcctgcccgacgtgcaggcctgcaccggccccaccagcccccacctggtgctgtggcactacgacccccagagaggcggctgcatgaccttccccgccagaggctgcgacggcgccgccagaggcttcgagacctacgaggcctgccagcaggcctgcgccagaggccccggcgacgcctgcgtgctgcccgccgtgcagggcccctgcagaggctgggagcccagatgggcctacagccccctgctgcagcagtgccaccccttcgtgtacggcggctgcgagggcaacggcaacaacttccacagcagagagagctgcgaggacgcctgccccgtgcccagaacccccccctgcagagcctgcagactgagaagcaagctggccctgagcctgtgcagaagcgacttcgccatcgtgggcagactgaccgaggtgctggaggagcccgaggccgccggcggcatcgccagagtggccctggaggacgtgctgaaggacgacaagatgggcctgaagttcctgggcaccaagtacctggaggtgaccctgagcggcatggactgggcctgcccctgccccaacatgaccgccggcgacggccccctggtgatcatgggcgaggtgagagacggcgtggccgtgctggacgccggcagctacgtgagagccgccagcgagaagagagtgaagaagatcctggagctgctggagaagcaggcctgcgagctgctgaacagattccaggactag

SEQ ID NO: 105178 - DNA, 1731 bp, Artificial Sequence
  Description of Artificial Sequence: Synthetic coding sequence
atgtgggcccccagatgcagaagattctggagcagatgggagcaggtggccgccctgctgctgctgctgctgctgctgggcgtgccccccagaagcctggccctgccccccatcagatacagccacgccggcatctgccccaacgacatgaaccccaacctgtgggtggacgcccagagcacctgcagaagagagtgcgagaccgaccaggagtgcgagacctacgagaagtgctgccccaacgtgtgcggcaccaagagctgcgtggccgccagatacatggacgtgaagggcaagaagggccccgtgggcatgcccaaggaggccacctgcgaccacttcatgtgcctgcagcagggcagcgagtgcgacatctgggacggccagcccgtgtgcaagtgcaaggacagatgcgagaaggagcccagcttcacctgcgccagcgacggcctgacctactacaacagatgctacatggacgccgaggcctgcagcaagggcatcaccctggccgtggtgacctgcagataccacttcacctggcccaacaccagcccccccccccccgagaccaccatgcaccccaccaccgccagccccgagacccccgagctggacatggccgcccccgccctgctgaacaaccccgtgcaccagagcgtgaccatgggcgagaccgtgagcttcctgtgcgacgtggtgggcagacccagacccgagatcacctgggagaagcagctggaggacagagagaacgtggtgatgagacccaaccacgtgagaggcaacgtggtggtgaccaacatcgcccagctggtgatctacaacgcccagctgcaggacgccggcatctacacctgcaccgccagaaacgtggccggcgtgctgagagccgacttccccctgagcgtggtgagaggccaccaggccgccgccaccagcgagagcagccccaacggcaccgccttccccgccgccgagtgcctgaagccccccgacagcgaggactgcggcgaggagcagaccagatggcacttcgacgcccaggccaacaactgcctgaccttcaccttcggccactgccacagaaacctgaaccacttcgagacctacgaggcctgcatgctggcctgcatgagcggccccctggccgcctgcagcctgcccgccctgcagggcccctgcaaggcctacgcccccagatgggcctacaacagccagaccggccagtgccagagcttcgtgtacggcggctgcgagggcaacggcaacaacttcgagagcagagaggcctgcgaggagagctgccccttccccagaggcaaccagagatgcagagcctgcaagcccagacagaagctggtgaccagcttctgcagaagcgacttcgtgatcctgggcagagtgagcgagctgaccgaggagcccgacagcggcagagccctggtgaccgtggacgaggtgctgaaggacgagaagatgggcctgaagttcctgggccaggagcccctggaggtgaccctgctgcacgtggactgggcctgcccctgccccaacgtgaccgtgagcgagatgcccctgatcatcatgggcgaggtggacggcggcatggccatgctgagacccgacagcttcgtgggcgccagcagcgccagaagagtgagaaagctgagagaggtgatgcacaagaagacctgcgacgtgctgaaggagttcctgggcctgcactag

SEQ ID NO: 105179 - DNA, 849 bp, Artificial Sequence
  Description of Artificial Sequence: Synthetic coding sequence
atggacgtgaagggcaagaagggccccgtgggcatgcccaaggaggccacctgcgaccacttcatgtgcctgcagcagggcagcgagtgcgacatctgggacggccagcccgtgtgcaagtgcaaggacagatgcgagaaggagcccagcttcacctgcgcccaggccaacaactgcctgaccttcaccttcggccactgccacagaaacctgaaccacttcgagacctacgaggcctgcatgctggcctgcatgagcggccccctggccgcctgcagcctgcccgccctgcagggcccctgcaaggcctacgcccccagatgggcctacaacagccagaccggccagtgccagagcttcgtgtacggcggctgcgagggcaacggcaacaacttcgagagcagagaggcctgcgaggagagctgccccttccccagaggcaaccagagatgcagagcctgcaagcccagacagaagctggtgaccagcttctgcagaagcgacttcgtgatcctgggcagagtgagcgagctgaccgaggagcccgacagcggcagagccctggtgaccgtggacgaggtgctgaaggacgagaagatgggcctgaagttcctgggccaggagcccctggaggtgaccctgctgcacgtggactgggcctgcccctgccccaacgtgaccgtgagcgagatgcccctgatcatcatgggcgaggtggacggcggcatggccatgctgagacccgacagcttcgtgggcgccagcagcgccagaagagtgagaaagctgagagaggtgatgcacaagaagacctgcgacgtgctgaaggagttcctgggcctgcactag

SEQ ID NO: 105180 - DNA, 1509 bp, Artificial Sequence
  Description of Artificial Sequence: Synthetic coding sequence
atgcccctggtgaagagaaacatcgagcccagacacctgtgcagaggcgccctgcccgagggcatcaccagcgagctggagtgcgtgaccaacagcaccctggccgccatcatcagacagctgagcagcctgagcaagcacgccgaggacatcttcggcgagctgttcaacgaggccaacaacttctacatcagagccaacagcctgcaggacagaatcgacagactggccgtgaaggtgacccagctggacagcaccgtggaggaggtgagcctgcaggacatcaacatgaagaaggccttcaagagcagcaccgtgcaggaccagcaggtggtgagcaagaacagcatccccaaccccgtggccgacatctacaaccagagcgacaagcccccccccctgaacatcctgaccccctacagagacgacaagaaggacggcctgaagttctacaccgaccccagctacttcttcgacctgtggaaggagaagatgctgcaggacaccgaggacaagagaaaggagaagagaagacagaaggagcagaagagaatcgacggcaccaccagagaggtgaagaaggtgagaaaggccagaaacagaagacaggagtggaacatgatggcctacgacaaggagctgagacccgacaacagactgagccagagcgtgtaccacggcgccagcagcgagggcagcctgagccccgacaccagaagccacgccagcgacgtgaccgactacagctaccccgccacccccaaccacagcctgcacccccagcccgtgacccccagctacgccgccggcgacgtgcccccccacggccccgccagccaggccgccgagcacgagtacagaccccccagcgccagcgccagacacatggccctgaacagaccccagcagccccccccccccccccccccccaggcccccgagggcagccaggccagcgcccccatggcccccgccgactacggcatgctgcccgcccagatcatcgagtactacaaccccagcggcccccccccccccccccccccccccgtgatccccagcgcccagaccgccttcgtgagccccctgcagatgcccatgcagccccccttccccgccagcgccagcagcacccacgccgcccccccccacccccccagcaccggcctgctggtgaccgccccccccccccccggcccccccccccccccccccggcccccccggccccggcagcagcctgagcagcagccccatgcacggcccccccgtggccgaggccaagagacaggagcccgcccagccccccatcagcgacgccagaagcgacctgctggccgccatcagaatgggcatccagctgaagaaggtgcaggagcagagagagcaggaggccaagagagagcccgtgggcaacgacgtggccaccatcctgagcagaagaatcgccgtggagtacagcgacagcgacgacgacagcgagttcgacgagaacgactggagcgactag

SEQ ID NO: 105181 - DNA, 1500 bp, Artificial Sequence
  Description of Artificial Sequence: Synthetic coding sequence
atgcccctggtgaagagaaacatcgagcccagacacctgtgcagaggcgccctgcccgagggcatcaccagcgagctggagtgcgtgaccaacagcaccctggccgccatcatcagacagctgagcagcctgagcaagcacgccgaggacatcttcggcgagctgttcaacgaggccaacaacttctacatcagagccaacagcctgcaggacagaatcgacagactggccgtgaaggtgacccagctggacagcaccgtggaggaggtgagcctgcaggacatcaacatgaagaaggccttcaagagcagcaccgtgcaggaccagcaggtggtgagcaagaacagcatccccaaccccgtggccgacatctacaaccagagcgacaagcccccccccctgaacatcctgaccccctacagagacgacaagaaggacggcctgaagttctacaccgaccccagctacttcttcgacctgtggaaggagaagatgctgcaggacaccgaggacaagagaaaggagaagagaagacagaagagagagaagcacaagctgaaccccaacagaaaccagcaggtgaacgtgagaaaggtgagaaccagaaaggaggagtgggagagaagaaagatgggcatcgagttcatgagcgacgccaagaagctggagcaggccggcagcgccaaggaggacagagtgcccagcggcagccacgccagcgacgtgaccgactacagctaccccgccacccccaaccacagcctgcacccccagcccgtgacccccagctacgccgccggcgacgtgcccccccacggccccgccagccaggccgccgagcacgagtacagaccccccagcgccagcgccagacacatggccctgaacagaccccagcagccccccccccccccccccccccaggcccccgagggcagccaggccagcgcccccatggcccccgccgactacggcatgctgcccgcccagatcatcgagtactacaaccccagcggcccccccccccccccccccccccccgtgatccccagcgcccagaccgccttcgtgagccccctgcagatgcccatgcagccccccttccccgccagcgccagcagcacccacgccgcccccccccacccccccagcaccggcctgctggtgaccgccccccccccccccggcccccccccccccccccccggcccccccggccccggcagcagcctgagcagcagccccatgcacggcccccccgtggccgaggccaagagacaggagcccgcccagccccccatcagcgacgccagaagcgacctgctggccgccatcagaatgggcatccagctgaagaaggtgcaggagcagagagagcaggaggccaagagagagcccgtgggcaacgacgtggccaccatcctgagcagaagaatcgccgtggagtacagcgacagcgacgacgacagcgagttcgacgagaacgactggagcgactag

SEQ ID NO: 105182 - DNA, 786 bp, Artificial Sequence
  Description of Artificial Sequence: Synthetic coding sequence
atggagggcggcctgggcagagccgtgtgcctgctgaccggcgccagcagaggcttcggcagaaccctggcccccctgctggccagcctgctgagccccggcagcgtgctggtgctgagcgccagaaacgacgaggccctgagacagctggaggccgagctgggcgccgagagaagcggcctgagagtggtgagagtgcccgccgacctgggcgccgaggccggcctgcagcagctgctgggcgccctgagagagctgcccagacccaagggcctgcagagactgctgctgatcaacaacgccggcagcctgggcgacgtgagcaagggcttcgtggacctgagcgacagcacccaggtgaacaactactgggccctgaacctgaccagcatgctgtgcctgaccagcagcgtgctgaaggccttccccgacagccccggcctgaacagaaccgtggtgaacatcagcagcctgtgcgccctgcagcccttcaagggctgggccctgtactgcgccggcaaggccgccagagacatgctgttccaggtgctggccctggaggagcccaacgtgagagtgctgaactacgcccccggccccctggacaccgacatgcagcagctggccagagagaccagcgtggaccccgacatgagaaagggcctgcaggagctgaaggccaagggcaagctggtggactgcaaggtgagcgcccagaagctgctgagcctgctggagaaggacgagttcaagagcggcgcccacgtggacttctacgacaagtag

SEQ ID NO: 105183 - DNA, 2430 bp, Artificial Sequence
  Description of Artificial Sequence: Synthetic coding sequence
atggaggacgagcagcccgacagcctggagggctgggtgcccgtgagagagggcctgttcgccgagcccgagagacacagactgagattcctggtggcctggaacggcgccgagggcaagttcgccgtgacctgccacgacagaaccgcccagcagagaagactgagagagggcgccagactgggccccgagcccgagcccaagcccgaggccgccgtgagccccagcagctgggccggcctgctgagcgccgccggcctgagaggcgcccacagacagctggccgccctgtggccccccctggagagatgcttccccagactgccccccgagctggacgtgggcggcggcggcgcctggggcctgggcctgggcctgtgggccctgctgtggcccaccagagccggccccggcgaggccgccctgcaggagctgtgcggccagctggagagatacctgggcgccgccgccgacggctgcggcggcgccaccgtgagagacgccctgttccccgccgagggcggcgccgccgactgcgagagccccagagagttcagagagagagccctgagagccagatgggtggaggccgacgccagactgagacaggtgatccagggccacggcaaggccaacaccatggtggccctgatgaacgtgtaccaggaggaggacgaggcctaccaggagctggtgaccgtggccaccatgttcttccagtacctgctgcagcccttcagagccatgagagaggtggccaccctgtgcaagctggacatcctgaagagcctggacgaggacgacctgggccccagaagagtggtggccctggagaaggaggccgaggagtggaccagaagagccgaggaggccgtggtgagcatccaggacatcaccgtgaactacttcaaggagaccgtgaaggccctggccggcatgcagaaggagatggagcaggacgccaagagattcggccaggccgcctgggccaccgccatccccagactggagaagctgcagctgatgctggccagagagaccctgcagctgatgagagccaaggagctgtgcctgaaccacaagagagccgagatccagggcaagatggaggacctgcccgagcaggagaagaacaccaacgtggtggacgagctggagatccagttctacgagatccagctggagctgtacgaggtgaagttcgagatcctgaagaacgaggagatcctgctgaccacccagctggacagcctgaagagactgatcaaggagaagcaggacgaggtggtgtactacgacccctgcgagaaccccgaggagctgaaggtgatcgactgcgtggtgggcctgcaggacgacaagaacctggaggtgaaggagctgagaagacagtgccagcagctggagagcaagagaggcagaatctgcgccaagagagccagcctgagaagcagaaaggaccagtgcaaggagaaccacagattcagactgcagcaggccgaggagagcatcagatacagcagacagcaccacagcatccagatgaagagagacaagatcaaggaggaggagcagaagaagaaggagtggatcaaccaggagagacagaagaccctgcagagactgagaagcttcaaggacaagagactggcccagagcgtgagaaacaccagcggcagcgagcccgtggcccccaacctgcccagcgacctgagccagcagatgtgcctgcccgccagccacgccgtgagcgtgatccaccccagcagcagaaagaccagaggcgtgcccctgagcgaggccggcaacgtgaagagccccaagtgccagaactgccacggcaacatccccgtgcaggtgttcgtgcccgtgggcgaccagacccacagcaagagcagcgaggagctgagcctgccccccccccccccccccccccccccccccccccccccccccccccccccccccccccccctgagagccctgagcagcagcagccaggccgccacccaccagaacctgggcttcagagcccccgtgaaggacgaccagcccagacccctggtgtgcgagagccccgccgagagacccagagacagcctggagagcttcagctgccccggcagcatggacgaggtgctggccagcctgagacacggcagagcccccctgagaaaggtggaggtgcccgccgtgagacccccccacgccagcatcaacgagcacatcctggccgccatcagacagggcgtgaagctgaagaaggtgcaccccgacctgggccccaaccccagcagcaagcccaccagcaacagaagaaccagcgacctggagagaagcatcaaggccgccctgcagagaatcaagagagtgagcgccgacagcgaggaggacagcgacgagcaggaccccggccagtgggacggctag

SEQ ID NO: 105184 - DNA, 1452 bp, Artificial Sequence
  Description of Artificial Sequence: Synthetic coding sequence
atgcccgtgcccccccccccccccccccccctgccccccccccccccccccctgggcgccccccccccccccccccccagcgccccccccgtgagcaccgacaccagcagcctgagaagagccgaccccaagggcagaagcgccctgctggccgacatccagcagggcaccagactgagaaaggtgacccagatcaacgacagaagcgccccccagatcgagagcagcaagggcaccaacaaggagggcggcggcagcgccaacaccagaggcgccagcaccccccccaccctgggcgacctgttcgccggcggcttccccgtgctgagacccgccggccagagagacgtggccggcggcaagaccggccagggccccggcagcagagcccccagccccagactgcccaacaagaccatcagcggccccctgatcccccccgccagccccagactgggcaacaccagcgaggcccacggcgccgccagaaccgccccccccagacccaacgtgcccgccccccccccccccacccccccccccccccccccccccctgcccccccccctgcccagcagcagccccatcaagacccccctggtgagcccccccggccccctgaccaagggcaacctgcccgtggtggccccccccgtgccctgcgccccccccccccccccccccccccccccccccacccccccccccctgccccccgccagcgtgctgagcgacaaggccgtgaagccccagctggcccccctgcacctgccccccatccccccccccctgcccctgctgcccccctgcggctaccccggcctgaaggccgagcccgccagccccgcccaggacgcccaggagccccccgccccccccccccccctgcccccctacgccagctgcagccccagagccagcctgcccgccccccccctgcccggcgtgaacagcagcagcgagacccccccccccctgccccccaagagccccagcttccaggcccccccccagaaggccggcgcccaggccctgcccgccccccccgccccccccggcagccagcccttcctgcagaagaagagacacggcagacccggcgccggcggcggcaagctgaaccccccccccgccccccccgccagaagccccaccaccgagctgagcagcaagagccagcaggccaccgcctggacccccacccagcagcccggcggccagctgagaaacggcagcctgcacatcatcgacgacttcgagagcaagttcaccttccacagcgtggaggacttccccccccccgacgagtacaagccctgccagaagatctaccccagcaagatccccagaagcagaacccccggcccctggctgcaggccgaggccgtgggccagagcagcgacgacatcaagggcagaaacagccagctgagcctgaagaccctgagatag

SEQ ID NO: 105185 - DNA, 1452 bp, Artificial Sequence
  Description of Artificial Sequence: Synthetic coding sequence
atgcccgtgcccccccccccccccccccccctgccccccccccccccccccctgggcgccccccccccccccccccccagcgccccccccgtgagcaccgacaccagcagcctgagaagagccgaccccaagggcagaagcgccctgctggccgacatccagcagggcaccagactgagaaaggtgacccagatcaacgacagaagcgccccccagatcgagagcagcaagggcaccaacaaggagggcggcggcagcgccaacaccagaggcgccagcaccccccccaccctgggcgacctgttcgccggcggcttccccgtgctgagacccgccggccagagagacgtggccggcggcaagaccggccagggccccggcagcagagcccccagccccagactgcccaacaagaccatcagcggccccctgatcccccccgccagccccagactgggcaacaccagcgaggcccacggcgccgccagaaccgccccccccagacccaacgtgcccgccccccccccccccacccccccccccccccccccccccctgcccccccccctgcccagcagcagccccatcaagacccccctggtgagcccccccggccccctgaccaagggcaacctgcccgtggtggccccccccgtgccctgcgccccccccccccccccccccccccccccccccacccccccccccctgccccccgccagcgtgctgagcgacaaggccgtgaagccccagctggcccccctgcacctgccccccatccccccccccctgcccctgctgcccccctgcggctaccccggcctgaaggccgagcccgccagccccgcccaggacgcccaggagccccccgccccccccccccccctgcccccctacgccagctgcagccccagagccagcctgcccgccccccccctgcccggcgtgaacagcagcagcgagacccccccccccctgccccccaagagccccagcttccaggcccccccccagaaggccggcgcccaggccctgcccgccccccccgccccccccggcagccagcccttcctgcagaagaagagacacggcagacccggcgccggcggcggcaagctgaaccccccccccgccccccccgccagaagccccaccaccgagctgagcagcaagagccagcaggccaccgcctggacccccacccagcagcccggcggccagctgagaaacggcagcctgcacatcatcgacgacttcgagagcaagttcaccttccacagcgtggaggacttccccccccccgacgagtacaagccctgccagaagatctaccccagcaagatccccagaagcagaacccccggcccctggctgcaggccgaggccgtgggccagagcagcgacgacatcaagggcagaaacagccaggtgacccaggccagctgcctgtag

SEQ ID NO: 105186 - DNA, 1452 bp, Artificial Sequence; identical to SEQ ID NO: 105185
  Description of Artificial Sequence: Synthetic coding sequence

SEQ ID NO: 105187 - DNA, 930 bp, Artificial Sequence
  Description of Artificial Sequence: Synthetic coding sequence
atggccgtgaaccagagccacaccgagaacagaagaggcgccctgatccccaacggcgagagcctgctgaagagaagccccaacgtggagctgagcttcccccagagaagcgagggcagcaacgtgttcagcggcagaaagaccggcaccctgttcctgaccagctacagagtgatcttcatcaccagctgcagcatcagcgaccccatgctgagcttcatgatgcccttcgacctgatgaccaacctgaccgtggagcagcccgtgttcgccgccaacttcatcaagggcaccatccaggccgccccctacggcggctgggagggccaggccaccttcaagctggtgttcagaaacggcgacgccatcgagttcgcccagctgatggtgaaggccgccagcgccgccgccagaggcttccccctgagaaccctgaacgactggttcagcagcatgggcatctacgtgatcaccggcgagggcaacatgtgcaccccccagatgccctgcagcgtgatcgtgtacggcgccccccccgccggctacggcgcccccccccccggctacggcgccccccccgccggctacggcgcccagcccgtgggcaacgagggcccccccgtgggctacagagccagccccgtgagatacggcgccccccccctgggctacggcgccccccccgccggctacggcgccccccccctgggctacggcgccccccccctgggctacggcaccccccccctgggctacggcgccccccccctgggctacggcgccccccccgccggcaacgagggcccccccgccggctacagagccagccccgccggcagcggcgccagaccccaggagagcaccgccgcccaggcccccgagaacgaggccagcctgcccagcgccagcagcagccaggtgcacagctag

SEQ ID NO: 105188 - DNA, 930 bp, Artificial Sequence; identical to SEQ ID NO: 105187
  Description of Artificial Sequence: Synthetic coding sequence

SEQ ID NO: 105189 - DNA, 930 bp, Artificial Sequence; identical to SEQ ID NO: 105187
  Description of Artificial Sequence: Synthetic coding sequence

SEQ ID NO: 105190 - DNA, 708 bp, Artificial Sequence
  Description of Artificial Sequence: Synthetic coding sequence
atgcccttcgacctgatgaccaacctgaccgtggagcagcccgtgttcgccgccaacttcatcaagggcaccatccaggccgccccctacggcggctgggagggccaggccaccttcaagctggtgttcagaaacggcgacgccatcgagttcgcccagctgatggtgaaggccgccagcgccgccgccagaggcttccccctgagaaccctgaacgactggttcagcagcatgggcatctacgtgatcaccggcgagggcaacatgtgcaccccccagatgccctgcagcgtgatcgtgtacggcgccccccccgccggctacggcgcccccccccccggctacggcgccccccccgccggctacggcgcccagcccgtgggcaacgagggcccccccgtgggctacagagccagccccgtgagatacggcgccccccccctgggctacggcgccccccccgccggctacggcgccccccccctgggctacggcgccccccccctgggctacggcaccccccccctgggctacggcgccccccccctgggctacggcgccccccccgccggcaacgagggcccccccgccggctacagagccagccccgccggcagcggcgccagaccccaggagagcaccgccgcccaggcccccgagaacgaggccagcctgcccagcgccagcagcagccaggtgcacagctag

SEQ ID NO: 105191 - DNA, 1401 bp, Artificial Sequence
  Description of Artificial Sequence: Synthetic coding sequence
atgccctacgagatcaagaaggtgttcgccagcctgccccaggtggagagaggcgtgagcaagatcatcggcggcgaccccaagggcaacaacttcctgtacaccaacggcaagtgcgtgatcctgagaaacatcgacgaccacagcagattcgtgaactgcgtgagattcagccccgacggcaacagattcgccaccgccagcgccgacggccagatctacatctacgacggcaagaccggcgagaaggtgtgcgccctgggcggcagcaaggcccacgacggcggcatctacgccatcagctggagccccgacagcacccacctgctgagcgccagcggcgacaagaccagcaagatctgggacgtgagcgtgaacagcgtggtgagcaccttccccatgggcagcaccgtgctggaccagcagctgggctgcctgtggcagaaggaccacctgctgagcgtgagcctgagcggctacatcaactacctggacagaaacaaccccagcaagcccctgcacgtgatcaagggccacagcaagagcatccagtgcctgaccgtgcacaagaacggcggcaagagctacatctacagcggcagccacgacggccacatcaactactgggacagcgagaccggcgagaacgacagcttcgccggcaagggccacaccaaccaggtgagcagaatgaccgtggacgagagcggccagctgatcagctgcagcatggacgacaccgtgagatacaccagcctgatgctgagagactacagcggccagggcgtggtgaagctggacgtgcagcccaagtgcgtggccgtgggccccggcggctacgccgtggtggtgtgcatcggccagatcgtgctgctgaaggaccagagaaagtgcttcagcatcgacaaccccggctacgagcccgaggtggtggccgtgcaccccggcggcgacaccgtggccatcggcggcgtggacggcaacgtgagactgtacagcatcctgggcaccaccctgaaggacgagggcaagctgctggaggccaagggccccgtgaccgacgtggcctacagccacgacggcgccttcctggccgtgtgcgacgccagcaaggtggtgaccgtgttcagcgtggccgacggctacagcgagaacaacgtgttctacggccaccacgccaagatcgtgtgcctggcctggagccccgacaacgagcacttcgccagcggcggcatggacatgatggtgtacgtgtggaccctgagcgaccccgagaccagagtgaagatccaggacgcccacagactgcaccacgtgagcagcctggcctggctggacgagcacaccctggtgaccaccagccacgacgccagcgtgaaggagtggaccatcacctactag

SEQ ID NO: 105192 - DNA, 1821 bp, Artificial Sequence
  Description of Artificial Sequence: Synthetic coding sequence
atgccctacgagatcaagaaggtgttcgccagcctgccccaggtggagagaggcgtgagcaagatcatcggcggcgaccccaagggcaacaacttcctgtacaccaacggcaagtgcgtgatcctgagaaacatcgacaaccccgccctggccgacatctacaccgagcacgcccaccaggtggtggtggccaagtacgcccccagcggcttctacatcgccagcggcgacgtgagcggcaagctgagaatctgggacaccacccagaaggagcacctgctgaagtacgagtaccagcccttcgccggcaagatcaaggacatcgcctggaccgaggacagcaagagaatcgccgtggtgggcgagggcagagagaagttcggcgccgtgttcctgtgggacagcggcagcagcgtgggcgagatcaccggccacaacaaggtgatcaacagcgtggacatcaagcagagcagaccctacagactggccaccggcagcgacgacaactgcgccgccttcttcgagggcccccccttcaagttcaagttcaccatcggcgaccacagcagattcgtgaactgcgtgagattcagccccgacggcaacagattcgccaccgccagcgccgacggccagatctacatctacgacggcaagaccggcgagaaggtgtgcgccctgggcggcagcaaggcccacgacggcggcatctacgccatcagctggagccccgacagcacccacctgctgagcgccagcggcgacaagaccagcaagatctgggacgtgagcgtgaacagcgtggtgagcaccttccccatgggcagcaccgtgctggaccagcagctgggctgcctgtggcagaaggaccacctgctgagcgtgagcctgagcggctacatcaactacctggacagaaacaaccccagcaagcccctgcacgtgatcaagggccacagcaagagcatccagtgcctgaccgtgcacaagaacggcggcaagagctacatctacagcggcagccacgacggccacatcaactactgggacagcgagaccggcgagaacgacagcttcgccggcaagggccacaccaaccaggtgagcagaatgaccgtggacgagagcggccagctgatcagctgcagcatggacgacaccgtgagatacaccagcctgatgctgagagactacagcggccagggcgtggtgaagctggacgtgcagcccaagtgcgtggccgtgggccccggcggctacgccgtggtggtgtgcatcggccagatcgtgctgctgaaggaccagagaaagtgcttcagcatcgacaaccccggctacgagcccgaggtggtggccgtgcaccccggcggcgacaccgtggccatcggcggcgtggacggcaacgtgagactgtacagcatcctgggcaccaccctgaaggacgagggcaagctgctggaggccaagggccccgtgaccgacgtggcctacagccacgacggcgccttcctggccgtgtgcgacgccagcaaggtggtgaccgtgttcagcgtggccgacggctacagcgagaacaacgtgttctacggccaccacgccaagatcgtgtgcctggcctggagccccgacaacgagcacttcgccagcggcggcatggacatgatggtgtacgtgtggaccctgagcgaccccgagaccagagtgaagatccaggacgcccacagactgcaccacgtgagcagcctggcctggctggacgagcacaccctggtgaccaccagccacgacgccagcgtgaaggagtggaccatcacctactag

SEQ ID NO: 105193 - DNA, 1326 bp, Artificial Sequence
  Description of Artificial Sequence: Synthetic coding sequence
atgctgacctgggtgtggtacctgatcatgaccagcgtgctgcaggccagcgtgagcagcgtggaccacagcagattcgtgaactgcgtgagattcagccccgacggcaacagattcgccaccgccagcgccgacggccagatctacatctacgacggcaagaccggcgagaaggtgtgcgccctgggcggcagcaaggcccacgacggcggcatctacgccatcagctggagccccgacagcacccacctgctgagcgccagcggcgacaagaccagcaagatctgggacgtgagcgtgaacagcgtggtgagcaccttccccatgggcagcaccgtgctggaccagcagctgggctgcctgtggcagaaggaccacctgctgagcgtgagcctgagcggctacatcaactacctggacagaaacaaccccagcaagcccctgcacgtgatcaagggccacagcaagagcatccagtgcctgaccgtgcacaagaacggcggcaagagctacatctacagcggcagccacgacggccacatcaactactgggacagcgagaccggcgagaacgacagcttcgccggcaagggccacaccaaccaggtgagcagaatgaccgtggacgagagcggccagctgatcagctgcagcatggacgacaccgtgagatacaccagcctgatgctgagagactacagcggccagggcgtggtgaagctggacgtgcagcccaagtgcgtggccgtgggccccggcggctacgccgtggtggtgtgcatcggccagatcgtgctgctgaaggaccagagaaagtgcttcagcatcgacaaccccggctacgagcccgaggtggtggccgtgcaccccggcggcgacaccgtggccatcggcggcgtggacggcaacgtgagactgtacagcatcctgggcaccaccctgaaggacgagggcaagctgctggaggccaagggccccgtgaccgacgtggcctacagccacgacggcgccttcctggccgtgtgcgacgccagcaaggtggtgaccgtgttcagcgtggccgacggctacagcgagaacaacgtgttctacggccaccacgccaagatcgtgtgcctggcctggagccccgacaacgagcacttcgccagcggcggcatggacatgatggtgtacgtgtggaccctgagcgaccccgagaccagagtgaagatccaggacgcccacagactgcaccacgtgagcagcctggcctggctggacgagcacaccctggtgaccaccagccacgacgccagcgtgaaggagtggaccatcacctactag

SEQ ID NO: 105194 - DNA, 531 bp, Artificial Sequence
  Description of Artificial Sequence: Synthetic coding sequence
cccgccgagaccgagaaggtgttcgccagcctgccccaggtggagagaggcgtgagcaagatcatcggcggcgaccccaagggcaacaacttcctgtacaccaacggcaagtgcgtgatcctgagaaacatcgacgaccacagcagattcgtgaactgcgtgagattcagccccgacggcaacagattcgccaccgccagcgccgacggccagtgcctgcccgcccccgtgaccgcccagagcagaagactgcccaacgccagccccgacatgcagaacctggacatcgccctgcccaccagcgccgacagcagcagcgagcccaagccccagagcatggagaagctgcccccctggagcgcccacttcccctgggcccccagattctggaccagcagctgggccgcctacggcagaagaaccacctgcagcgtgagcccctgccccggcaccagcaccatctggaccgagaccacccccgccagcccctgcaccagcagcagagtgaccgtgaacagaagcagcgtgtag

SEQ ID NO: 105195 - DNA, 1821 bp, Artificial Sequence; identical to SEQ ID NO: 105192
  Description of Artificial Sequence: Synthetic coding sequence

SEQ ID NO: 105196 - DNA, 1401 bp, Artificial Sequence; identical to SEQ ID NO: 105191
  Description of Artificial Sequence: Synthetic coding sequence

SEQ ID NO: 105197 - DNA, 3675 bp, Artificial Sequence
  Description of Artificial Sequence: Synthetic coding sequence
atgctgccctacaccgtgaacttcaaggtgagcgccagaaccctgaccggcgccctgaacgcccacaacaaggccgccgtggactggggctggcagggcctgatcgcctacggctgccacagcctggtggtggtgatcgacagcatcaccgcccagaccctgcaggtgctggagaagcacaaggccgacgtggtgaaggtgaagtgggccagagagaactaccaccacaacatcggcagcccctactgcctgagactggccagcgccgacgtgaacggcaagatcatcgtgtgggacgtggccgccggcgtggcccagtgcgagatccaggagcacgccaagcccatccaggacgtgcagtggctgtggaaccaggacgccagcagagacctgctgctggccatccacccccccaactacatcgtgctgtggaacgccgacaccggcaccaagctgtggaagaagagctacgccgacaacatcctgagcttcagcttcgaccccttcgaccccagccacctgaccctgctgaccagcgagggcatcgtgttcatcagcgacttcagccccagcaagccccccagcggccccggcaagaaggtgtacatcagcagcccccacagcagccccgcccacaacaagctggccaccgccaccggcgccaagaaggccctgaacaaggtgaagatcctgatcacccaggagaagcccagcgccgagttcatcaccctgaacgactgcctgcagctggcctacctgcccagcaagagaaaccacatgctgctgctgtaccccagagagatcctgatcctggacctggaggtgaaccagaccgtgggcgtgatcgccatcgagagaaccggcgtgcccttcctgcaggtgatcccctgcttccagagagacggcctgttctgcctgcacgagaacggctgcatcaccctgagagtgagaagaagctacaacaacatcttcaccaccagcaacgaggagcccgaccccgaccccgtgcaggagctgacctacgacctgagaagccagtgcgacgccatcagagtgaccaagaccgtgagacccttcagcatggtgtgctgccccgtgaacgagaacgccgccgccctggtggtgagcgacggcagagtgatgatctgggagctgaagagcgccgtgtgcaacagaaacagcagaaacagcagcagcggcgtgagccccctgtacagccccgtgagcttctgcggcatccccgtgggcgtgctgcagaacaagctgcccgacctgagcctggacaacatgatcggccagagcgccatcgccggcgaggagcaccccagaggcagcatcctgagagaggtgcacctgaagttcctgctgaccggcctgctgagcggcctgcccgccccccagttcgccatcagaatgtgcccccccctgaccaccaagaacatcaagatgtaccagcccctgctggccgtgggcaccagcaacggcagcgtgctggtgtaccacctgaccagcggcctgctgcacaaggagctgagcatccacagctgcgaggtgaagggcatcgagtggaccagcctgaccagcttcctgagcttcgccaccagcacccccaacaacatgggcctggtgagaaacgagctgcagctggtggacctgcccaccggcagaagcatcgccttcagaggcgagagaggcaacgacgagagcgccatcgagatgatcaaggtgagccacctgaagcagtacctggccgtggtgttcagagacaagcccctggagctgtgggacgtgagaacctgcaccctgctgagagagatgagcaagaacttccccaccatcaccgccctggagtggagccccagccacaacctgaagagcctgagaaagaagcagctggccaccagagaggccatggccagacagaccgtggtgagcgacaccgagctgagcatcgtggagagcagcgtgatcagcctgctgcaggaggccgagagcaagagcgagctgagccagaacatcagcgccagagagcacttcgtgttcaccgacatcgacggccaggtgtaccacctgaccgtggagggcaacagcgtgaaggacagcgccagaatcccccccgacggcagcatgggcagcatcacctgcatcgcctggaagggcgacaccctggtgctgggcgacatggacggcaacctgaacttctgggacctgaagggcagagtgagcagaggcatccccacccacagaagctgggtgagaaagatcagattcgcccccggcaagggcaaccagaagctgatcgccatgtacaacgacggcgccgaggtgtgggacaccaaggaggtgcagatggtgagcagcctgagaagcggcagaaacgtgaccttcagaatcctggacgtggactggtgcaccagcgacaaggtgatcctggccagcgacgacggctgcatcagagtgctggagatgagcatgaagagcgcctgcttcagaatggacgagcaggagctgaccgagcccgtgtggtgcccctacctgctggtgcccagagccagcctggccctgaaggccttcctgctgcaccagccctggaacggccagtacagcctggacatcagccacgtggactaccccgagaacgaggagatcaagaacctgctgcaggagcagctgaacagcctgagcaacgacatcaagaagctgctgctggaccccgagttcaccctgctgcagagatgcctgctggtgagcagactgtacggcgacgagagcgagctgcacttctggaccgtggccgcccactacctgcacagcctgagccaggagaagagcgccagcaccaccgcccccaaggaggccgcccccagagacaagctgagcaaccccctggacatctgctacgacgtgctgtgcgagaacgcctacttccagaagttccagctggagagagtgaacctgcaggaggtgaagagaagcacctacgaccacaccagaaagtgcaccgaccagctgctgctgctgggccagaccgacagagccgtgcagctgctgctggagaccagcgccgacaaccagcactactactgcgacagcctgaaggcctgcctggtgaccaccgtgaccagcagcggccccagccagagcaccatcaagctggtggccaccaacatgatcgccaacggcaagctggccgagggcgtgcagctgctgtgcctgatcgacaaggccgccgacgcctgcagatacctgcagacctacggcgagtggaacagagccgcctggctggccaaggtgagactgaaccccgaggagtgcgccgacgtgctgagaagatgggtggaccacctgtgcagcccccaggtgaaccagaagagcaaggccctgctggtgctgctgagcctgggctgcttcttcagcgtggccgagaccctgcacagcatgagatacttcgacagagccgccctgttcgtggaggcctgcctgaagtacggcgccttcgaggtgaccgaggacaccgagaagctgatcaccgccatctacgccgactacgccagaagcctgaagaacctgggcttcaagcagggcgccgtgctgttcgccagcaaggccggcgccgccggcaaggacctgctgaacgagctggagagccccaaggaggagcccatcgaggagtag

SEQ ID NO: 105198 - DNA, 1371 bp, Artificial Sequence; identical to SEQ ID NO: 76677
  Description of Artificial Sequence: Synthetic coding sequence

SEQ ID NO: 105199 - DNA, 1458 bp, Artificial Sequence; identical to SEQ ID NO: 92234
  Description of Artificial Sequence: Synthetic coding sequence

SEQ ID NO: 105200 - DNA, 1893 bp, Artificial Sequence
  Description of Artificial Sequence: Synthetic coding sequence
atggaggccgtggtgctgccctggcagatcttcggcgtgagagagctgcccgtggagagaggcgtgaccatgaagggccccagactgttcagagcccccggccacgtgcccaccggcctgaagtgccaccccgaccaggagcacatgatctaccccctgggctgcaccgtgctgatccaggccatcaacaccaaggagcagaacttcctgcagggccacggcaacaacgtgagctgcctggccatcagcagaagcggcgagtacatcgccagcggccaggtgaccttcatgggcttcaaggccgacatcatcctgtgggactacaagaacagagagctgctggccagactgagcctgcacaagggcaagatcgaggccctggccttcagccccaacgacctgtacctggtgagcctgggcggccccgacgacggcagcgtggtggtgtggagcatcgccaagagagacgccatctgcggcagccccgccgccggcctgaacgtgggcaacgccaccaacgtgatcttcagcagatgcagagacgagatgttcatgaccgccggcaacggcaccatcagagtgtgggagctggacctgcccaacagaaagatctggcccaccgagtgccagaccggccagctgaagagaatcgtgatgagcatcggcgtggacgacgacgacagcttcttctacctgggcaccaccaccggcgacatcctgaagatgaaccccagaaccaagctgctgaccgacgtgggccccgccaaggacaagttcagcctgggcgtgagcgccatcagatgcctgaagatgggcggcctgctggtgggcagcggcgccggcctgctggtgttctgcaagagccccggctacaagcccatcaagaagatccagctgcagggcggcatcaccagcatcaccctgagaggcgagggccaccagttcctggtgggcaccgaggagagccacatctacagagtgagcttcaccgacttcaaggagaccctgatcgccacctgccacttcgacgccgtggaggacatcgtgttccccttcggcaccgccgagctgttcgccacctgcgccaagaaggacatcagagtgtggcacaccagcagcaacagagagctgctgagaatcaccgtgcccaacatgacctgccacggcatcgacttcatgagagacggcaagagcatcatcagcgcctggaacgacggcaagatcagagccttcgcccccgagaccggcagactgatgtacgtgatcaacaacgcccacagaatcggcgtgaccgccatcgccaccaccagcgactgcaagagagtgatcagcggcggcggcgagggcgaggtgagagtgtggcagatcggctgccagacccagaagctggaggaggccctgaaggagcacaagagcagcgtgagctgcatcagagtgaagagaaacaacgaggagtgcgtgaccgccagcaccgacggcacctgcatcatctgggacctggtgagactgagaagaaaccagatgatcctggccaacaccctgttccagtgcgtgtgctaccaccccgaggagttccagatcatcaccagcggcaccgacagaaagatcgcctactgggaggtgttcgacggcaccgtgatcagagagctggagggcagcctgagcggcagcatcaacggcatggacatcacccaggagggcgtgcacttcgtgaccggcggcaacgaccacctggtgaaggtgtgggactacaacgagggcgaggtgacccacgtgggcgtgggccacagcggcaacatcaccagaatcagaatcagccccggcaaccagtacatcgtgagcgtgagcgccgacggcgccatcctgagatggaagtacccctacaccagctag

SEQ ID NO: 105201 - DNA, 1863 bp, Artificial Sequence
  Description of Artificial Sequence: Synthetic coding sequence
atggacaacaagatcagccccgaggcccaggtggccgagctggagctggacgccgtgatcggcttcaacggccacgtgcccaccggcctgaagtgccaccccgaccaggagcacatgatctaccccctgggctgcaccgtgctgatccaggccatcaacaccaaggagcagaacttcctgcagggccacggcaacaacgtgagctgcctggccatcagcagaagcggcgagtacatcgccagcggccaggtgaccttcatgggcttcaaggccgacatcatcctgtgggactacaagaacagagagctgctggccagactgagcctgcacaagggcaagatcgaggccctggccttcagccccaacgacctgtacctggtgagcctgggcggccccgacgacggcagcgtggtggtgtggagcatcgccaagagagacgccatctgcggcagccccgccgccggcctgaacgtgggcaacgccaccaacgtgatcttcagcagatgcagagacgagatgttcatgaccgccggcaacggcaccatcagagtgtgggagctggacctgcccaacagaaagatctggcccaccgagtgccagaccggccagctgaagagaatcgtgatgagcatcggcgtggacgacgacgacagcttcttctacctgggcaccaccaccggcgacatcctgaagatgaaccccagaaccaagctgctgaccgacgtgggccccgccaaggacaagttcagcctgggcgtgagcgccatcagatgcctgaagatgggcggcctgctggtgggcagcggcgccggcctgctggtgttctgcaagagccccggctacaagcccatcaagaagatccagctgcagggcggcatcaccagcatcaccctgagaggcgagggccaccagttcctggtgggcaccgaggagagccacatctacagagtgagcttcaccgacttcaaggagaccctgatcgccacctgccacttcgacgccgtggaggacatcgtgttccccttcggcaccgccgagctgttcgccacctgcgccaagaaggacatcagagtgtggcacaccagcagcaacagagagctgctgagaatcaccgtgcccaacatgacctgccacggcatcgacttcatgagagacggcaagagcatcatcagcgcctggaacgacggcaagatcagagccttcgcccccgagaccggcagactgatgtacgtgatcaacaacgcccacagaatcggcgtgaccgccatcgccaccaccagcgactgcaagagagtgatcagcggcggcggcgagggcgaggtgagagtgtggcagatcggctgccagacccagaagctggaggaggccctgaaggagcacaagagcagcgtgagctgcatcagagtgaagagaaacaacgaggagtgcgtgaccgccagcaccgacggcacctgcatcatctgggacctggtgagactgagaagaaaccagatgatcctggccaacaccctgttccagtgcgtgtgctaccaccccgaggagttccagatcatcaccagcggcaccgacagaaagatcgcctactgggaggtgttcgacggcaccgtgatcagagagctggagggcagcctgagcggcagcatcaacggcatggacatcacccaggagggcgtgcacttcgtgaccggcggcaacgaccacctggtgaaggtgtgggactacaacgagggcgaggtgacccacgtgggcgtgggccacagcggcaacatcaccagaatcagaatcagccccggcaaccagtacatcgtgagcgtgagcgccgacggcgccatcctgagatggaagtacccctacaccagctag

SEQ ID NO: 105202 - DNA, 1659 bp, Artificial Sequence
  Description of Artificial Sequence: Synthetic coding sequence
atggacaacaagatcagccccgaggcccaggtggccgagctggagctggacgccgtgatcggcttcaacgacatcatcctgtgggactacaagaacagagagctgctggccagactgagcctgcacaagggcaagatcgaggccctggccttcagccccaacgacctgtacctggtgagcctgggcggccccgacgacggcagcgtggtggtgtggagcatcgccaagagagacgccatctgcggcagccccgccgccggcctgaacgtgggcaacgccaccaacgtgatcttcagcagatgcagagacgagatgttcatgaccgccggcaacggcaccatcagagtgtgggagctggacctgcccaacagaaagatctggcccaccgagtgccagaccggccagctgaagagaatcgtgatgagcatcggcgtggacgacgacgacagcttcttctacctgggcaccaccaccggcgacatcctgaagatgaaccccagaaccaagctgctgaccgacgtgggccccgccaaggacaagttcagcctgggcgtgagcgccatcagatgcctgaagatgggcggcctgctggtgggcagcggcgccggcctgctggtgttctgcaagagccccggctacaagcccatcaagaagatccagctgcagggcggcatcaccagcatcaccctgagaggcgagggccaccagttcctggtgggcaccgaggagagccacatctacagagtgagcttcaccgacttcaaggagaccctgatcgccacctgccacttcgacgccgtggaggacatcgtgttccccttcggcaccgccgagctgttcgccacctgcgccaagaaggacatcagagtgtggcacaccagcagcaacagagagctgctgagaatcaccgtgcccaacatgacctgccacggcatcgacttcatgagagacggcaagagcatcatcagcgcctggaacgacggcaagatcagagccttcgcccccgagaccggcagactgatgtacgtgatcaacaacgcccacagaatcggcgtgaccgccatcgccaccaccagcgactgcaagagagtgatcagcggcggcggcgagggcgaggtgagagtgtggcagatcggctgccagacccagaagctggaggaggccctgaaggagcacaagagcagcgtgagctgcatcagagtgaagagaaacaacgaggagtgcgtgaccgccagcaccgacggcacctgcatcatctgggacctggtgagactgagaagaaaccagatgatcctggccaacaccctgttccagtgcgtgtgctaccaccccgaggagttccagatcatcaccagcggcaccgacagaaagatcgcctactgggaggtgttcgacggcaccgtgatcagagagctggagggcagcctgagcggcagcatcaacggcatggacatcacccaggagggcgtgcacttcgtgaccggcggcaacgaccacctggtgaaggtgtgggactacaacgagggcgaggtgacccacgtgggcgtgggccacagcggcaacatcaccagaatcagaatcagccccggcaaccagtacatcgtgagcgtgagcgccgacggcgccatcctgagatggaagtacccctacaccagctag

SEQ ID NO: 105203 - DNA, 3969 bp, Artificial Sequence
  Description of Artificial Sequence: Synthetic coding sequence
atggcctggatgacctacatcagcaactggttcgagcaggacgactggtacgagggcctgcagagagccaacatgagccaggtgagacaggtgggcctgctggccgccggctgccagccctggaacaaggacgtgtgcgccgccagcggcgacagattcgcctactgcgccaccctggccatctacatctaccagctggaccacagatacaacgagttcaagctgcacgccatcatgagcgagcacaagaagaccatcaccgccatcagctggtgcccccacaaccccgacctgttcgccagcggcagcaccgacaacctggtgatcatctggaacgtggccgagcagaaggtgatcgccaagctggacagcaccaagggcatccccgccagcctgagctggtgctggaacgccgaggacgtggtggccttcgtgagccacagaggccccctgttcatctggaccatcagcggccccgacagcggcgtgatcgtgcacaaggacgcccacagcttcctgagcgacatctgcatgttcagatggcacacccaccagaagggcaaggtggtgttcggccacatcgacggcagcctgagcatcttccaccccggcaacaagaaccagaagcacgtgctgagacccgagagcctggagggcaccgacgaggaggaccccgtgaccgccctggagtgggaccccctgagcaccgactacctgctggtggtgaacctgcactacggcatcagactggtggacagcgagagcctgagctgcatcaccaccttcaacctgcccagcgccgccgccagcgtgcagtgcctggcctgggtgcccagcgcccccggcatgttcatcaccggcgacagccaggtgggcgtgctgagaatctggaacgtgagcagaaccacccccatcgacaacctgaagctgaagaagaccggcttccactgcctgcacgtgctgaacagcccccccagaaagaagttcagcgtgcagagccccaccaagaaccactacaccagcagcaccagcgaggccgtgcccccccccaccctgacccagaaccaggccttcagcctgccccccggccacgccgtgtgctgcttcctggacggcggcgtgggcctgtacgacatgggcgccaagaagtgggacttcctgagagacctgggccacgtggagaccatcttcgactgcaagttcaagcccgacgaccccaacctgctggccaccgccagcttcgacggcaccatcaaggtgtgggacatcaacaccctgaccgccgtgtacaccagccccggcaacgagggcgtgatctacagcctgagctgggcccccggcggcctgaactgcatcgccggcggcaccagcagaaacggcgccttcatctggaacgtgcagaagggcaagatcatccagagattcaacgagcacggcaccaacggcatcttctgcatcgcctggagccacaaggacagcaagagaatcgccacctgcagcagcgacggcttctgcatcatcagaaccatcgacggcaaggtgctgcacaagtacaagcaccccgccgccgtgttcggctgcgactggagccagaacaacaaggacatgatcgccaccggctgcgaggacaccaacgtgagagtgtactacgtggccaccagcagcgaccagcccctgaaggtgttcagcggccacaccgccaaggtgttccacgtgaagtggagccccctgagagagggcatcctgtgcagcggcagcgacgacggcaccgtgagaatctgggactacacccaggacgcctgcatcaacatcctgaacggccacaccgcccccgtgagaggcctgatgtggaacaccgagatcccctacctgctgatcagcggcagctgggactacaccatcaaggtgtgggacaccagagagggcacctgcgtggacaccgtgtacgaccacggcgccgacgtgtacggcctgacctgccaccccagcagacccttcaccatggccagctgcagcagagacagcaccgtgagactgtggagcctgaccgccctggtgacccccgtgcagatcaacatcctggccgacagaagctgggaggagatcatcggcaacaccgactacgccatcgagcccggcaccccccccctgctgtgcggcaaggtgagcagagacatcagacaggagatcgagaagctgaccgccaacagccaggtgaagaagctgagatggttcagcgagtgcctgagcccccccggcggcagcgacaacctgtggaacctggtggccgtgatcaagggccaggacgacagcctgctgccccagaactactgcaagggcatcatgcacctgaagcacctgatcaagttcagaaccagcgaggcccaggagctgaccaccgtgaagatgagcaagttcggcggcggcatcggcgtgcccgccaaggaggagagactgaaggaggccgccgagatccacctgagactgggccagatccagagatactgcgagctgatggtggagctgggcgagtgggacaaggccctgagcatcgcccccggcgtgagcgtgaagtactggaagaagctgatgcagagaagagccgaccagctgatccaggaggacaaggacgacgtgatcccctactgcatcgccatcggcgacgtgaagaagctggtgcacttcttcatgagcagaggccagctgaaggaggccctgctggtggcccaggccgcctgcgagggcaacatgcagcccctgcacgtgagcgtgcccaagggcgccagctacagcgacgacatctacaaggaggacttcaacgagctgctgcacaaggtgagcaaggagctggccgagtggtacttccaggacggcagagccgtgctggccgcctgctgccacctggccatcgacaacatcgagctggccatggcctacctgatcagaggcaacgagctggagctggccgtgtgcgtgggcaccgtgctgggcgagagcgccgcccccgccacccactacgccctggagctgctggccagaaagtgcatgatgatcagcgtgtgcttcccctgcgtgggctacagcgtgcccttctgctacgtgaacagaaacctggccgccgacctgctgctgatgatccccgacaacgagctgcacctgatcaagctgtgcgccttctaccccggctgcaccgaggagatcaacgacctgcacgacaagtgcaagctgcccaccgtggaggagtgcatgcagctggccgagaccgccagagccgacgacaacatcttcgagaccgtgaagtactacctgctgagccaggagcccgagaaggccctgcccatcggcatcagcttcgtgaaggagtacatcagcagcagcgactggaccctggacaccatctaccccgtgctggacctgctgagctacatcagaaccgagaagctgctgctgcacacctgcaccgaggccagaaacgagctgctgatcctgtgcggctacatcggcgccctgctggccatcagaagacagtaccagagcatcgtgcccgccctgtacgagtacaccagccagctgctgaagagaagagaggtgagcgtgcccctgaagatcgagtacctgagcgaggagctggacgcctggagagcctgcacccagagcaccaacagaagcctggaggacagcccctacaccccccccagcgacagccagagaatgatctacgccaccctgctgaagagactgaaggaggagagcctgaagggcatcatcggccccgactacgtgaccggcagcaacctgcccagccacagcgacatccacatcagctgcctgaccggcctgaagatccagggccccgtgttcttcctggaggacggcaagagcgccatcagcctgaacgacgccctgatgtgggccaaggtgaaccccttcagccccctgggcaccggcatcagactgaaccccttctag

SEQ ID NO: 105204 - DNA, 393 bp, Artificial Sequence
  Description of Artificial Sequence: Synthetic coding sequence
atgagccaggtgagacaggtgggcctgctggccgccggctgccagccctggaacaaggacgtgtgcgccgccagcggcgacagattcgcctactgcgccaccctggccatctacatctaccagctggaccacagatacaacgagttcaagctgcacgccatcatgagcgagcacaagaagaccatcaccgccatcagctggtgcccccacaaccccgacctgttcgccagcggcagcaccgacaacctggtgatcatctggaacgtggccgagcagaaggtgatcgccaagctggacagagccagaccccccagccccaagatcatctacatcaagatcatcaacatcatcgaggagaacatccacaacagcgagatgcagtggatcatctag

SEQ ID NO: 105205 - DNA, 3897 bp, Artificial Sequence
  Description of Artificial Sequence: Synthetic coding sequence
atgagccaggtgagacaggtgggcctgctggccgccggctgccagccctggaacaaggacgtgtgcgccgccagcggcgacagattcgcctactgcgccaccctggccatctacatctaccagctggaccacagatacaacgagttcaagctgcacgccatcatgagcgagcacaagaagaccatcaccgccatcagctggtgcccccacaaccccgacctgttcgccagcggcagcaccgacaacctggtgatcatctggaacgtggccgagcagaaggtgatcgccaagctggacagcaccaagggcatccccgccagcctgagctggtgctggaacgccgaggacgtggtggccttcgtgagccacagaggccccctgttcatctggaccatcagcggccccgacagcggcgtgatcgtgcacaaggacgcccacagcttcctgagcgacatctgcatgttcagatggcacacccaccagaagggcaaggtggtgttcggccacatcgacggcagcctgagcatcttccaccccggcaacaagaaccagaagcacgtgctgagacccgagagcctggagggcaccgacgaggaggaccccgtgaccgccctggagtgggaccccctgagcaccgactacctgctggtggtgaacctgcactacggcatcagactggtggacagcgagagcctgagctgcatcaccaccttcaacctgcccagcgccgccgccagcgtgcagtgcctggcctgggtgcccagcgcccccggcatgttcatcaccggcgacagccaggtgggcgtgctgagaatctggaacgtgagcagaaccacccccatcgacaacctgaagctgaagaagaccggcttccactgcctgcacgtgctgaacagcccccccagaaagaagttcagcgtgcagagccccaccaagaaccactacaccagcagcaccagcgaggccgtgcccccccccaccctgacccagaaccaggccttcagcctgccccccggccacgccgtgtgctgcttcctggacggcggcgtgggcctgtacgacatgggcgccaagaagtgggacttcctgagagacctgggccacgtggagaccatcttcgactgcaagttcaagcccgacgaccccaacctgctggccaccgccagcttcgacggcaccatcaaggtgtgggacatcaacaccctgaccgccgtgtacaccagccccggcaacgagggcgtgatctacagcctgagctgggcccccggcggcctgaactgcatcgccggcggcaccagcagaaacggcgccttcatctggaacgtgcagaagggcaagatcatccagagattcaacgagcacggcaccaacggcatcttctgcatcgcctggagccacaaggacagcaagagaatcgccacctgcagcagcgacggcttctgcatcatcagaaccatcgacggcaaggtgctgcacaagtacaagcaccccgccgccgtgttcggctgcgactggagccagaacaacaaggacatgatcgccaccggctgcgaggacaccaacgtgagagtgtactacgtggccaccagcagcgaccagcccctgaaggtgttcagcggccacaccgccaaggtgttccacgtgaagtggagccccctgagagagggcatcctgtgcagcggcagcgacgacggcaccgtgagaatctgggactacacccaggacgcctgcatcaacatcctgaacggccacaccgcccccgtgagaggcctgatgtggaacaccgagatcccctacctgctgatcagcggcagctgggactacaccatcaaggtgtgggacaccagagagggcacctgcgtggacaccgtgtacgaccacggcgccgacgtgtacggcctgacctgccaccccagcagacccttcaccatggccagctgcagcagagacagcaccgtgagactgtggagcctgaccgccctggtgacccccgtgcagatcaacatcctggccgacagaagctgggaggagatcatcggcaacaccgactacgccatcgagcccggcaccccccccctgctgtgcggcaaggtgagcagagacatcagacaggagatcgagaagctgaccgccaacagccaggtgaagaagctgagatggttcagcgagtgcctgagcccccccggcggcagcgacaacctgtggaacctggtggccgtgatcaagggccaggacgacagcctgctgccccagaactactgcaagggcatcatgcacctgaagcacctgatcaagttcagaaccagcgaggcccaggagctgaccaccgtgaagatgagcaagttcggcggcggcatcggcgtgcccgccaaggaggagagactgaaggaggccgccgagatccacctgagactgggccagatccagagatactgcgagctgatggtggagctgggcgagtgggacaaggccctgagcatcgcccccggcgtgagcgtgaagtactggaagaagctgatgcagagaagagccgaccagctgatccaggaggacaaggacgacgtgatcccctactgcatcgccatcggcgacgtgaagaagctggtgcacttcttcatgagcagaggccagctgaaggaggccctgctggtggcccaggccgcctgcgagggcaacatgcagcccctgcacgtgagcgtgcccaagggcgccagctacagcgacgacatctacaaggaggacttcaacgagctgctgcacaaggtgagcaaggagctggccgagtggtacttccaggacggcagagccgtgctggccgcctgctgccacctggccatcgacaacatcgagctggccatggcctacctgatcagaggcaacgagctggagctggccgtgtgcgtgggcaccgtgctgggcgagagcgccgcccccgccacccactacgccctggagctgctggccagaaagtgcatgatgatcagcgtgtgcttcccctgcgtgggctacagcgtgcccttctgctacgtgaacagaaacctggccgccgacctgctgctgatgatccccgacaacgagctgcacctgatcaagctgtgcgccttctaccccggctgcaccgaggagatcaacgacctgcacgacaagtgcaagctgcccaccgtggaggagtgcatgcagctggccgagaccgccagagccgacgacaacatcttcgagaccgtgaagtactacctgctgagccaggagcccgagaaggccctgcccatcggcatcagcttcgtgaaggagtacatcagcagcagcgactggaccctggacaccatctaccccgtgctggacctgctgagctacatcagaaccgagaagctgctgctgcacacctgcaccgaggccagaaacgagctgctgatcctgtgcggctacatcggcgccctgctggccatcagaagacagtaccagagcatcgtgcccgccctgtacgagtacaccagccagctgctgaagagaagagaggtgagcgtgcccctgaagatcgagtacctgagcgaggagctggacgcctggagagcctgcacccagagcaccaacagaagcctggaggacagcccctacaccccccccagcgacagccagagaatgatctacgccaccctgctgaagagactgaaggaggagagcctgaagggcatcatcggccccgactacgtgaccggcagcaacctgcccagccacagcgacatccacatcagctgcctgaccggcctgaagatccagggccccgtgttcttcctggaggacggcaagagcgccatcagcctgaacgacgccctgatgtgggccaaggtgaaccccttcagccccctgggcaccggcatcagactgaaccccttctag

SEQ ID NO: 105206 - DNA, 3852 bp, Artificial Sequence
  Description of Artificial Sequence: Synthetic coding sequence
atgagccaggtgagacaggtgggcctgctggccgccggctgccagccctggaacaaggacgtgtgcgccgccagcggcgacagattcgcctactgcgccaccctggccatctacatctaccagctggaccacagatacaacgagttcaagctgcacgccatcatgagcgagcacaagaagaccatcaccgccatcagctggtgcccccacaaccccgacctgttcgccagcggcagcaccgacaacctggtgatcatctggaacgtggccgagcagaaggtgatcgccaagctggacagcaccaagggcatccccgccagcctgagctggtgctggaacgccgaggacgtggtggccttcgtgagccacagaggccccctgttcatctggaccatcagcggccccgacagcggcgtgatcgtgcacaaggacgcccacagcttcctgagcgacatctgcatgttcagatggcacacccaccagaagggcaaggtggtgttcggccacatcgacggcagcctgagcatcttccaccccggcaacaagaaccagaagcacgtgctgagacccgagagcctggagggcaccgacgaggaggaccccgtgaccgccctggagtgggaccccctgagcaccgactacctgctggtggtgaacctgcactacggcatcagactggtggacagcgagagcctgagctgcatcaccaccttcaacctgcccagcgccgccgccagcgtgcagtgcctggcctgggtgcccagcgcccccggcatgttcatcaccggcgacagccaggtgggcgtgctgagaatctggaacgtgagcagaaccacccccatcgacaacctgaagctgaagaagaccggcttccactgcctgcacgtgctgaacagcccccccagaaagaagttcagcgtgcagagccccaccaagaaccactacaccagcagcaccagcgaggccgtgcccccccccaccctgacccagaaccaggccttcagcctgccccccggccacgccgtgtgctgcttcctggacggcggcgtgggcctgtacgacatgggcgccaagaagtgggacttcctgagagacctgggccacgtggagaccatcttcgactgcaagttcaagcccgacgaccccaacctgctggccaccgccagcttcgacggcaccatcaaggtgtgggacatcaacaccctgaccgccgtgtacaccagccccggcaacgagggcgtgatctacagcctgagctgggcccccggcggcctgaactgcatcgccggcggcaccagcagaaacggcgccttcatctggaacgtgcagaagggcaagatcatccagagattcaacgagcacggcaccaacggcatcttctgcatcgcctggagccacaaggacagcaagagaatcgccacctgcagcagcgacggcttctgcatcatcagaaccatcgacggcaaggtgctgcacaagtacaagcaccccgccgccgtgttcggctgcgactggagccagaacaacaaggacatgatcgccaccggctgcgaggacaccaacgtgagagtgtactacgtggccaccagcagcgaccagcccctgaaggtgttcagcggccacaccgccaaggtgttccacgtgaagtggagccccctgagagagggcatcctgtgcagcggcagcgacgacggcaccgtgagaatctgggactacacccaggacgcctgcatcaacatcctgaacggccacaccgcccccgtgagaggcctgatgtggaacaccgagatcccctacctgctgatcagcggcagctgggactacaccatcaaggtgtgggacaccagagagggcacctgcgtggacaccgtgtacgaccacggcgccgacgtgtacggcctgacctgccaccccagcagacccttcaccatggccagctgcagcagagacagcaccgtgagactgtggagcctgaccgccctggtgacccccgtgcagatcaacatcctggccgacagaagctgggaggagatcatcggcaacaccgactacgccatcgagcccggcaccccccccctgctgtgcggcaaggtgagcagagacatcagacaggagatcgagaagctgaccgccaacagccaggtgaagaagctgagatggttcagcgagtgcctgagcccccccggcggcagcgacaacctgtggaacctggtggccgtgatcaagggccaggacgacagcctgctgccccagaactactgcaagggcatcatgcacctgaagcacctgatcaagttcagaaccagcgaggcccaggagctgaccaccgtgaagatgagcaagttcggcggcggcatcggcgtgcccgccaaggaggagagactgaaggaggccgccgagatccacctgagactgggccagatccagagatactgcgagctgatggtggagctgggcgagtgggacaaggccctgagcatcgcccccggcgtgagcgtgaagtactggaagaagctgatgcagagaagagccgaccagctgatccaggaggacaaggacgacgtgatcccctactgcatcgccatcggcgacgtgaagaagctggtgcacttcttcatgagcagaggccagctgaaggaggccctgctggtggcccaggccgcctgcgagggcaacatgcagcccctgcacgtgagcgtgcccaagggcgccagctacagcgacgacatctacaaggaggacttcaacgagctgctgcacaaggtgagcaaggagctggccgagtggtacttccaggacggcagagccgtgctggccgcctgctgccacctggccatcgacaacatcgagctggccatggcctacctgatcagaggcaacgagctggagctggccgtgtgcgtgggcaccgtgctgggcgagagcgccgcccccgccacccactacgccctggagctgctggccagaaagtgcatgatgatcagcgtgtggaacctggccgccgacctgctgctgatgatccccgacaacgagctgcacctgatcaagctgtgcgccttctaccccggctgcaccgaggagatcaacgacctgcacgacaagtgcaagctgcccaccgtggaggagtgcatgcagctggccgagaccgccagagccgacgacaacatcttcgagaccgtgaagtactacctgctgagccaggagcccgagaaggccctgcccatcggcatcagcttcgtgaaggagtacatcagcagcagcgactggaccctggacaccatctaccccgtgctggacctgctgagctacatcagaaccgagaagctgctgctgcacacctgcaccgaggccagaaacgagctgctgatcctgtgcggctacatcggcgccctgctggccatcagaagacagtaccagagcatcgtgcccgccctgtacgagtacaccagccagctgctgaagagaagagaggtgagcgtgcccctgaagatcgagtacctgagcgaggagctggacgcctggagagcctgcacccagagcaccaacagaagcctggaggacagcccctacaccccccccagcgacagccagagaatgatctacgccaccctgctgaagagactgaaggaggagagcctgaagggcatcatcggccccgactacgtgaccggcagcaacctgcccagccacagcgacatccacatcagctgcctgaccggcctgaagatccagggccccgtgttcttcctggaggacggcaagagcgccatcagcctgaacgacgccctgatgtgggccaaggtgaaccccttcagccccctgggcaccggcatcagactgaaccccttctag

SEQ ID NO: 105207 - DNA, 3549 bp, Artificial Sequence
  Description of Artificial Sequence: Synthetic coding sequence
atgatcaccgtgagcaaccaggagggcgacaccatcagacagacccaggtgagaagcgagcccagcaacatgcagttcttcctgatgaagatggacgacagaaccagcgccgccgagagcatgatcagcgtggtgctgggcaagaagaccctgttcttcctgaacctgaacgagcccgacaaccccgccgacctggagttccagcaggacttcggcaacatcgtgtgctacaactggtacggcgacggcagaatcatgatcggcttcagctgcggccacttcgtggtgatcagcacccacaccggcgagctgggccaggagatcttccaggccagaaaccacaaggacaacctgaccagcatcgccgtgagccagaccctgaacaaggtggccacctgcggcgacaactgcatcaagatccaggacctggtggacctgaaggacatgtacgtgatcctgaacctggacgaggagaacaagggcctgggcaccctgagctggaccgacgacggccagctgctggccctgagcacccagagaggcagcctgcacgtgttcctgaccaagctgcccatcctgggcgacgcctgcagcaccagaatcgcctacctgaccagcctgctggaggtgaccgtggccaaccccgtggagggcgagctgcccatcaccgtgagcgtggacgtggagcccaacttcgtggccgtgggcctgtaccacctggccgtgggcatgaacaacagagcctggttctacgtgctgggcgagaacgccgtgaagaagctgaaggacatggagtacctgggcaccgtggccagcatctgcctgcacagcgactacgccgccgccctgttcgagggcaaggtgcagctgcacctgatcgagagcgagatcctggacgcccaggaggagagagagaccagactgttccccgccgtggacgacaagtgcagaatcctgtgccacgccctgaccagcgacttcctgatctacggcaccgacaccggcgtggtgcagtacttctacatcgaggactggcagttcgtgaacgactacagacaccccgtgagcgtgaagaagatcttccccgaccccaacggcaccagactggtgttcatcgacgagaagagcgacggcttcgtgtactgccccgtgaacgacgccacctacgagatccccgacttcagccccaccatcaagggcgtgctgtgggagaactggcccatggacaagggcgtgttcatcgcctacgacgacgacaaggtgtacacctacgtgttccacaaggacaccatccagggcgccaaggtgatcctggccggcagcaccaaggtgcccttcgcccacaagcccctgctgctgtacaacggcgagctgacctgccagacccagagcggcaaggtgaacaacatctacctgagcacccacggcttcctgagcaacctgaaggacaccggccccgacgagctgagacccatgctggcccagaacctgatgctgaagagattcagcgacgcctgggagatgtgcagaatcctgaacgacgaggccgcctggaacgagctggccagagcctgcctgcaccacatggaggtggagttcgccatcagagtgtacagaagaatcggcaacgtgggcatcgtgatgagcctggagcagatcaagggcatcgaggactacaacctgctggccggccacctggccatgttcaccaacgactacaacctggcccaggacctgtacctggccagcagctgccccatcgccgccctggagatgagaagagacctgcagcactgggacagcgccctgcagctggccaagcacctggcccccgaccagatccccttcatcagcaaggagtacgccatccagctggagttcgccggcgactacgtgaacgccctggcccactacgagaagggcatcaccggcgacaacaaggagcacgacgaggcctgcctggccggcgtggcccagatgagcatcagaatgggcgacatcagaagaggcgtgaaccaggccctgaagcaccccagcagagtgctgaagagagactgcggcgccatcctggagaacatgaagcagttcagcgaggccgcccagctgtacgagaagggcctgtactacgacaaggccgccagcgtgtacatcagaagcaagaactgggccaaggtgggcgacctgctgccccacgtgagcagccccaagatccacctgcagtacgccaaggccaaggaggccgacggcagatacaaggaggccgtggtggcctacgagaacgccaagcagtggcagagcgtgatcagaatctacctggaccacctgaacaaccccgagaaggccgtgaacatcgtgagagagacccagagcctggacggcgccaagatggtggccagattcttcctgcagctgggcgactacggcagcgccatccagttcctggtgatgagcaagtgcaacaacgaggccttcaccctggcccagcagcacaacaagatggagatctacgccgacatcatcggcagcgaggacaccaccaacgaggactaccagagcatcgccctgtacttcgagggcgagaagagatacctgcaggccggcaagttcttcctgctgtgcggccagtacagcagagccctgaagcacttcctgaagtgccccagcagcgaggacaacgtggccatcgagatggccatcgagaccgtgggccaggccaaggacgagctgctgaccaaccagctgatcgaccacctgctgggcgagaacgacggcatgcccaaggacgccaagtacctgttcagactgtacatggccctgaagcagtacagagaggccgcccagaccgccatcatcatcgccagagaggagcagagcgccggcaactacagaaacgcccacgacgtgctgttcagcatgtacgccgagctgaagagccagaagatcaagatccccagcgagatggccaccaacctgatgatcctgcacagctacatcctggtgaagatccacgtgaagaacggcgaccacatgaagggcgccagaatgctgatcagagtggccaacaacatcagcaagttccccagccacatcgtgcccatcctgaccagcaccgtgatcgagtgccacagagccggcctgaagaacagcgccttcagcttcgccgccatgctgatgagacccgagtacagaagcaagatcgacgccaagtacaagaagaagatcgagggcatggtgagaagacccgacatcagcgagatcgaggaggccaccaccccctgccccttctgcaagttcctgctgcccgagtgcgagctgctgtgccccggctgcaagaacagcatcccctactgcatcgccaccggcagacacatgctgaaggacgactggaccgtgtgcccccactgcgacttccccgccctgtacagcgagctgaagatcatgctgaacaccgagagcacctgccccatgtgcagcgagagactgaacgccgcccagctgaagaagatcagcgactgcacccagtacctgagaaccgaggaggagctgtag

SEQ ID NO: 105208 - DNA, 4029 bp, Artificial Sequence
  Description of Artificial Sequence: Synthetic coding sequence
atgaagagaatcttcagcctgctggagaagacctggctgggcgcccccatccagttcgcctggcagaagaccagcggcaactacctggccgtgaccggcgccgactacatcgtgaagatcttcgacagacacggccagaagagaagcgagatcaacctgcccggcaactgcgtggccatggactgggacaaggacggcgacgtgctggccgtgatcgccgagaagagcagctgcatctacctgtgggacgccaacaccaacaagaccagccagctggacaacggcatgagagaccagatgagcttcctgctgtggagcaaggtgggcagcttcctggccgtgggcaccgtgaagggcaacctgctgatctacaaccaccagaccagcagaaagatccccgtgctgggcaagcacaccaagagaatcacctgcggctgctggaacgccgagaacctgctggccctgggcggcgaggacaagatgatcaccgtgagcaaccaggagggcgacaccatcagacagacccaggtgagaagcgagcccagcaacatgcagttcttcctgatgaagatggacgacagaaccagcgccgccgagagcatgatcagcgtggtgctgggcaagaagaccctgttcttcctgaacctgaacgagcccgacaaccccgccgacctggagttccagcaggacttcggcaacatcgtgtgctacaactggtacggcgacggcagaatcatgatcggcttcagctgcggccacttcgtggtgatcagcacccacaccggcgagctgggccaggagatcttccaggccagaaaccacaaggacaacctgaccagcatcgccgtgagccagaccctgaacaaggtggccacctgcggcgacaactgcatcaagatccaggacctggtggacctgaaggacatgtacgtgatcctgaacctggacgaggagaacaagggcctgggcaccctgagctggaccgacgacggccagctgctggccctgagcacccagagaggcagcctgcacgtgttcctgaccaagctgcccatcctgggcgacgcctgcagcaccagaatcgcctacctgaccagcctgctggaggtgaccgtggccaaccccgtggagggcgagctgcccatcaccgtgagcgtggacgtggagcccaacttcgtggccgtgggcctgtaccacctggccgtgggcatgaacaacagagcctggttctacgtgctgggcgagaacgccgtgaagaagctgaaggacatggagtacctgggcaccgtggccagcatctgcctgcacagcgactacgccgccgccctgttcgagggcaaggtgcagctgcacctgatcgagagcgagatcctggacgcccaggaggagagagagaccagactgttccccgccgtggacgacaagtgcagaatcctgtgccacgccctgaccagcgacttcctgatctacggcaccgacaccggcgtggtgcagtacttctacatcgaggactggcagttcgtgaacgactacagacaccccgtgagcgtgaagaagatcttccccgaccccaacggcaccagactggtgttcatcgacgagaagagcgacggcttcgtgtactgccccgtgaacgacgccacctacgagatccccgacttcagccccaccatcaagggcgtgctgtgggagaactggcccatggacaagggcgtgttcatcgcctacgacgacgacaaggtgtacacctacgtgttccacaaggacaccatccagggcgccaaggtgatcctggccggcagcaccaaggtgcccttcgcccacaagcccctgctgctgtacaacggcgagctgacctgccagacccagagcggcaaggtgaacaacatctacctgagcacccacggcttcctgagcaacctgaaggacaccggccccgacgagctgagacccatgctggcccagaacctgatgctgaagagattcagcgacgcctgggagatgtgcagaatcctgaacgacgaggccgcctggaacgagctggccagagcctgcctgcaccacatggaggtggagttcgccatcagagtgtacagaagaatcggcaacgtgggcatcgtgatgagcctggagcagatcaagggcatcgaggactacaacctgctggccggccacctggccatgttcaccaacgactacaacctggcccaggacctgtacctggccagcagctgccccatcgccgccctggagatgagaagagacctgcagcactgggacagcgccctgcagctggccaagcacctggcccccgaccagatccccttcatcagcaaggagtacgccatccagctggagttcgccggcgactacgtgaacgccctggcccactacgagaagggcatcaccggcgacaacaaggagcacgacgaggcctgcctggccggcgtggcccagatgagcatcagaatgggcgacatcagaagaggcgtgaaccaggccctgaagcaccccagcagagtgctgaagagagactgcggcgccatcctggagaacatgaagcagttcagcgaggccgcccagctgtacgagaagggcctgtactacgacaaggccgccagcgtgtacatcagaagcaagaactgggccaaggtgggcgacctgctgccccacgtgagcagccccaagatccacctgcagtacgccaaggccaaggaggccgacggcagatacaaggaggccgtggtggcctacgagaacgccaagcagtggcagagcgtgatcagaatctacctggaccacctgaacaaccccgagaaggccgtgaacatcgtgagagagacccagagcctggacggcgccaagatggtggccagattcttcctgcagctgggcgactacggcagcgccatccagttcctggtgatgagcaagtgcaacaacgaggccttcaccctggcccagcagcacaacaagatggagatctacgccgacatcatcggcagcgaggacaccaccaacgaggactaccagagcatcgccctgtacttcgagggcgagaagagatacctgcaggccggcaagttcttcctgctgtgcggccagtacagcagagccctgaagcacttcctgaagtgccccagcagcgaggacaacgtggccatcgagatggccatcgagaccgtgggccaggccaaggacgagctgctgaccaaccagctgatcgaccacctgctgggcgagaacgacggcatgcccaaggacgccaagtacctgttcagactgtacatggccctgaagcagtacagagaggccgcccagaccgccatcatcatcgccagagaggagcagagcgccggcaactacagaaacgcccacgacgtgctgttcagcatgtacgccgagctgaagagccagaagatcaagatccccagcgagatggccaccaacctgatgatcctgcacagctacatcctggtgaagatccacgtgaagaacggcgaccacatgaagggcgccagaatgctgatcagagtggccaacaacatcagcaagttccccagccacatcgtgcccatcctgaccagcaccgtgatcgagtgccacagagccggcctgaagaacagcgccttcagcttcgccgccatgctgatgagacccgagtacagaagcaagatcgacgccaagtacaagaagaagatcgagggcatggtgagaagacccgacatcagcgagatcgaggaggccaccaccccctgccccttctgcaagttcctgctgcccgagtgcgagctgctgtgccccggctgcaagaacagcatcccctactgcatcgccaccggcagacacatgctgaaggacgactggaccgtgtgcccccactgcgacttccccgccctgtacagcgagctgaagatcatgctgaacaccgagagcacctgccccatgtgcagcgagagactgaacgccgcccagctgaagaagatcagcgactgcacccagtacctgagaaccgaggaggagctgtag

SEQ ID NO: 105209 - DNA, 1443 bp, Artificial Sequence
  Description of Artificial Sequence: Synthetic coding sequence
aagagaatcttcagcctgctggagaagacctggctgggcgcccccatccagttcgcctggcagaagaccagcggcaactacctggccgtgaccggcgccgactacatcgtgaagatcttcgacagacacggccagaagagaagcgagatcaacctgcccggcaactgcgtggccatggactgggacaaggacggcgacgtgctggccgtgatcgccgagaagagcagctgcatctacctgtgggacgccaacaccaacaagaccagccagctggacaacggcatgagagaccagatgagcttcctgctgtggagcaaggtgggcagcttcctggccgtgggcaccgtgaagggcaacctgctgatctacaaccaccagaccagcagaaagatccccgtgctgggcaagcacaccaagagaatcacctgcggctgctggaacgccgagaacctgctggccctgggcggcgaggacaagatgatcaccgtgagcaaccaggagggcgacaccatcagacagacccaggtgagaagcgagcccagcaacatgcagttcttcctgatgaagatggacgacagaaccagcgccgccgagagcatgatcagcgtggtgctgggcaagaagaccctgttcttcctgaacctgaacgagcccgacaaccccgccgacctggagttccagcaggacttcggcaacatcgtgtgctacaactggtacggcgacggcagaatcatgatcggcttcagctgcggccacttcgtggtgatcagcacccacaccggcgagctgggccaggagatcttccaggccagaaaccacaaggacaacctgaccagcatcgccgtgagccagaccctgaacaaggtggccacctgcggcgacaactgcatcaagatccaggacctggtggacctgaaggacatgtacgtgatcctgaacctggacgaggagaacaagggcctgggcaccctgagctggaccgacgacggccagctgctggccctgagcacccagagaggcagcctgcacgtgttcctgaccaagctgcccatcctgggcgacgcctgcagcaccagaatcgcctacctgaccagcctgctggaggtgaccgtggccaaccccgtggagggcgagctgcccatcaccgtgagcgtggacgtggagcccaacttcgtggccgtgggcctgtaccacctggccgtgggcatgaacaacagagcctggttctacgtgctgggcgagaacgccgtgaagaagctgaaggacatggagtacctgggcaccgtggccagcatctgcctgcacagcgactacgccgccgccctgttcgagggcaaggtgcagctgcacctgaaggccaagagctggatgctgaagaagaacgtgagactgggcttcagccagcagtggatgatcagcgccgtgagctacgccatgccctag

SEQ ID NO: 105210 - DNA, 1446 bp, Artificial Sequence
  Description of Artificial Sequence: Synthetic coding sequence
atgaagagaatcttcagcctgctggagaagacctggctgggcgcccccatccagttcgcctggcagaagaccagcggcaactacctggccgtgaccggcgccgactacatcgtgaagatcttcgacagacacggccagaagagaagcgagatcaacctgcccggcaactgcgtggccatggactgggacaaggacggcgacgtgctggccgtgatcgccgagaagagcagctgcatctacctgtgggacgccaacaccaacaagaccagccagctggacaacggcatgagagaccagatgagcttcctgctgtggagcaaggtgggcagcttcctggccgtgggcaccgtgaagggcaacctgctgatctacaaccaccagaccagcagaaagatccccgtgctgggcaagcacaccaagagaatcacctgcggctgctggaacgccgagaacctgctggccctgggcggcgaggacaagatgatcaccgtgagcaaccaggagggcgacaccatcagacagacccaggtgagaagcgagcccagcaacatgcagttcttcctgatgaagatggacgacagaaccagcgccgccgagagcatgatcagcgtggtgctgggcaagaagaccctgttcttcctgaacctgaacgagcccgacaaccccgccgacctggagttccagcaggacttcggcaacatcgtgtgctacaactggtacggcgacggcagaatcatgatcggcttcagctgcggccacttcgtggtgatcagcacccacaccggcgagctgggccaggagatcttccaggccagaaaccacaaggacaacctgaccagcatcgccgtgagccagaccctgaacaaggtggccacctgcggcgacaactgcatcaagatccaggacctggtggacctgaaggacatgtacgtgatcctgaacctggacgaggagaacaagggcctgggcaccctgagctggaccgacgacggccagctgctggccctgagcacccagagaggcagcctgcacgtgttcctgaccaagctgcccatcctgggcgacgcctgcagcaccagaatcgcctacctgaccagcctgctggaggtgaccgtggccaaccccgtggagggcgagctgcccatcaccgtgagcgtggacgtggagcccaacttcgtggccgtgggcctgtaccacctggccgtgggcatgaacaacagagcctggttctacgtgctgggcgagaacgccgtgaagaagctgaaggacatggagtacctgggcaccgtggccagcatctgcctgcacagcgactacgccgccgccctgttcgagggcaaggtgcagctgcacctgaaggccaagagctggatgctgaagaagaacgtgagactgggcttcagccagcagtggatgatcagcgccgtgagctacgccatgccctag

SEQ ID NO: 105211 - DNA, 2832 bp, Artificial Sequence
  Description of Artificial Sequence: Synthetic coding sequence
atgggcctgaccaagcagtacctgagatacgtggccagcgccgtgttcggcgtgatcggcagccagaagggcaacatcgtgttcgtgaccctgagaggcgagaagggcagatacgtggccgtgcccgcctgcgagcacgtgttcatctgggacctgagaaagggcgagaagatcctgatcctgcagggcctgaagcaggaggtgacctgcctgtgccccagccccgacggcctgcacctggccgtgggctacgaggacggcagcatcagaatcttcagcctgctgagcggcgagggcaacgtgaccttcaacggccacaaggccgccatcaccaccctgaagtacgaccagctgggcggcagactggccagcggcagcaaggacaccgacatcatcgtgtgggacgtgatcaacgagagcggcctgtacagactgaagggccacaaggacgccatcacccaggccctgttcctgagagagaagaacctgctggtgaccagcggcaaggacaccatggtgaagtggtgggacctggacacccagcactgcttcaagaccatggtgggccacagaaccgaggtgtggggcctggtgctgctgagcgaggagaagagactgatcaccggcgccagcgacagcgagctgagagtgtgggacatcgcctacctgcaggagatcgaggaccccgaggagcccgaccccaagaagatcaagggcagcagccccggcatccaggacaccctggaggccgaggacggcgccttcgagaccgacgaggcccccgaggacagaatcctgagctgcagaaaggccggcagcatcatgagagagggcagagacagagtggtgaacctggccgtggacaagaccggcagaatcctggcctgccacggcaccgacagcgtgctggagctgttctgcatcctgagcaagaaggagatccagaagaagatggacaagaagatgaagaaggccagaaagaaggccaagctgcacagcagcaagggcgaggaggaggaccccgaggtgaacgtggagatgagcctgcaggacgagatccagagagtgaccaacatcaagaccagcgccaagatcaagagcttcgacctgatccacagcccccacggcgagctgaaggccgtgttcctgctgcagaacaacctggtggagctgtacagcctgaaccccagcctgcccaccccccagcccgtgagaaccagcagaatcaccatcggcggccacagaagcgacgtgagaaccctgagcttcagcagcgacaacatcgccgtgctgagcgccgccgccgacagcatcaagatctggaacagaagcaccctgcagtgcatcagaaccatgacctgcgagtacgccctgtgcagcttcttcgtgcccggcgacagacaggtggtgatcggcaccaagaccggcaagctgcagctgtacgacctggccagcggcaacctgctggagaccatcgacgcccacgacggcgccctgtggagcatgagcctgagccccgaccagagaggcttcgtgaccggcggcgccgacaagagcgtgaagttctgggacttcgagctggtgaaggacgagaacagcacccagaagagactgagcgtgaagcagaccagaaccctgcagctggacgaggacgtgctgtgcgtgagctacagccccaaccagaagctgctggccgtgagcctgctggactgcaccgtgaagatcttctacgtggacaccctgaagttcttcctgagcctgtacggccacaagctgcccgtgatctgcatggacatcagccacgacggcgccctgatcgccaccggcagcgccgacagaaacgtgaagatctggggcctggacttcggcgactgccacaagagcctgttcgcccacgacgacagcgtgatgtacctgcagttcgtgcccaagagccacctgttcttcaccgccggcaaggaccacaagatcaagcagtgggacgccgacaagttcgagcacatccagaccctggagggccaccaccaggagatctggtgcctggccgtgagccccagcggcgactacgtggtgagcagcagccacgacaagagcctgagactgtgggagagaaccagagagcccctgatcctggaggaggagagagagatggagagagaggccgagtacgaggagagcgtggccaaggaggaccagcccgccgtgcccggcgagacccagggcgacagctacttcaccggcaagaagaccatcgagaccgtgaaggccgccgagagaatcatggaggccatcgagctgtacagagaggagaccgccaagatgaaggagcacaaggccatctgcaaggccgccggcaaggaggtgcccctgcccagcaaccccatcctgatggcctacggcagcatcagccccagcgcctacgtgctggagatcttcaagggcatcaagagcagcgagctggaggagagcctgctggtgctgcccttcagctacgtgcccgacatcctgaagctgttcaacgagttcatccagctgggcagcgacgtggagctgatctgcagatgcctgttcttcctgctgagaatccacttcggccagatcaccagcaaccagatgctggtgcccgtgatcgagaagctgagagagaccaccatcagcaaggtgagccaggtgagagacgtgatcggcttcaacatggccggcctggactacctgaagagagagtgcgaggccaagagcgaggtgatgttcttcgccgacgccaccagccacctggaggagaagaagagaaagagaaagaagagagagaagctgatcctgaccctgacctag

SEQ ID NO: 105212 - DNA, 123 bp, Artificial Sequence
  Description of Artificial Sequence: Synthetic coding sequence
atgggcctgaccaagcagtacctgagatacgtggccagcgccgtgttcggcgtgatcggcagccagaagggcctggccagccaggccagcagcagcttcgtgttcttcgccaccgagttctag

SEQ ID NO: 105213 - DNA, 1611 bp, Artificial Sequence
  Description of Artificial Sequence: Synthetic coding sequence
atggccaccagagcccagcccggccccctgagccaggccggcagcgccggcgtggccgccctggccaccgtgggcgtggccagcggccccggccccggcagacccggccccctgcaggacgagaccctgggcgtggccagcgtgcccagccagtggagagccgtgcagggcatcagatgggagaccaagagctgccagaccgccagcatcgccaccgccagcgccagcgcccaggccagaaaccacgtggacgcccaggtgcagaccgaggcccccgtgcccgtgagcgtgcagccccccagccagtacgacatccccagactggccgccttcctgagaagagtggaggccatggtgatcagagagctgaacaagaactggcagagccacgccttcgacggcttcgaggtgaactggaccgagcagcagcagatggtgagctgcctgtacaccctgggctacccccccgcccaggcccagggcctgcacgtgaccagcatcagctggaacagcaccggcagcgtggtggcctgcgcctacggcagactggaccacggcgactggagcaccctgaagagcttcgtgtgcgcctggaacctggacagaagagacctgagaccccagcagcccagcgccgtggtggaggtgcccagcgccgtgctgtgcctggccttccaccccacccagcccagccacgtggccggcggcctgtacagcggcgaggtgctggtgtgggacctgagcagactggaggaccccctgctgtggagaaccggcctgaccgacgacacccacaccgaccccgtgagccaggtggtgtggctgcccgagcccggccacagccacagattccaggtgctgagcgtggccaccgacggcaaggtgctgctgtggcagggcatcggcgtgggccagctgcagctgaccgagggcttcgccctggtgatgcagcagctgcccagaagcaccaagctgaagaagcaccccagaggcgagaccgaggtgggcgccaccgccgtggccttcagcagcttcgaccccagactgttcatcctgggcaccgagggcggcttccccctgaagtgcagcctggccgccggcgaggccgccctgaccagaatgcccagcagcgtgcccctgagagcccccgcccagttcaccttcagcccccacggcggccccatctacagcgtgagctgcagccccttccacagaaacctgttcctgagcgccggcaccgacggccacgtgcacctgtacagcatgctgcaggccccccccctgaccagcctgcagctgagcctgaagtacctgttcgccgtgagatggagccccgtgagacccctggtgttcgccgccgccagcggcaagggcgacgtgcagctgttcgacctgcagaagagcagccagaagcccaccgtgctgatcaagcagacccaggacgagagccccgtgtactgcctggagttcaacagccagcagacccagctgctggccgccggcgacgcccagggcaccgtgaaggtgtggcagctgagcaccgagttcaccgagcagggccccagagaggccgaggacctggactgcctggccgccgaggtggccgcctag

SEQ ID NO: 105214 - DNA, 420 bp, Artificial Sequence
  Description of Artificial Sequence: Synthetic coding sequence
gccggcgtggccgccctggccaccgtgggcgtggccagcggccccggccccggcagacccggccccctgcaggacgagaccctgggcgtggccagcgtgcccagccagtggagagccgtgcagggcatcagatgggagaccaagagctgccagaccgccagcatcgccaccgccagcgccagcgcccaggccagaaaccacgtggacgcccaggtgcagaccgaggcccccgtgcccgtgagcgtgcagccccccagccagtacgacatccccagactggccgccttcctgagaagagtggaggccatggtgatcagagagctgaacaagaactggcagagccacgccttcgacggcttcgaggtgaactggaccgagcagcagcagatggccggcccctggggcctggagcacgcctag

SEQ ID NO: 105215 - DNA, 819 bp, Artificial Sequence
  Description of Artificial Sequence: Synthetic coding sequence
ctgagccaggccggcagcgccggcgtggccgccctggccaccgtgggcgtggccagcggccccggccccggcagacccggccccctgcaggacgagaccctgggcgtggccagcgtgcccagccagtggagagccgtgcagggcatcagatgggagaccaagagctgccagaccgccagcatcgccaccgccagcgccagcgcccaggccagaaaccacgtggacgcccaggtgcagaccgaggcccccgtgcccgtgagcgtgcagccccccagccagtacgacatccccagactggccgccttcctgagaagagtggaggccatggtgatcagagagctgaacaagaactggcagagccacgccttcgacggcttcgaggtgaactggaccgagcagcagcagatggtgagctgcctgtacaccctgggctacccccccgcccaggcccagggcctgcacgtgaccagcatcagctggaacagcaccggcagcgtggtggcctgcgcctacggcagactggaccacggcgactggagcaccctgaagagcttcgtgtgcgcctggaacctggacagaagagacctgagaccccagcagcccagcgccgtggtggaggtgcccagcgccgtgctgtgcctggccttccaccccacccagcccagccacgtggccggcgagctgcccgccgtgagcgccagcagccccctgagaacccagctgcccgccctgcagagagcccagggcagcttcccctgggccctgtggcccggcgacagaaaggccggccccgaccccctgagcctggagcccagatag

SEQ ID NO: 105216 - DNA, 3513 bp, Artificial Sequence
  Description of Artificial Sequence: Synthetic coding sequence
atgttcttctacctgagcaagaagatcagcatccccaacaacgtgaagctgcagtgcgtgagctggaacaaggagcagggcttcatcgcctgcggcggcgaggacggcctgctgaaggtgctgaagctggagacccagaccgacgacgccaagctgagaggcctggccgcccccagcaacctgagcatgaaccagaccctggagggccacagcggcagcgtgcaggtggtgacctggaacgagcagtaccagaagctgaccaccagcgacgagaacggcctgatcatcgtgtggatgctgtacaagggcagctggatcgaggagatgatcaacaacagaaacaagagcgtggtgagaagcatgagctggaacgccgacggccagaagatctgcatcgtgtacgaggacggcgccgtgatcgtgggcagcgtggacggcaacagaatctggggcaaggacctgaagggcatccagctgagccacgtgacctggagcgccgacagcaaggtgctgctgttcggcatggccaacggcgagatccacatctacgacaaccagggcaacttcatgatcaagatgaagctgagctgcctggtgaacgtgaccggcgccatcagcatcgccggcatccactggtaccacggcaccgagggctacgtggagcccgactgcccctgcctggccgtgtgcttcgacaacggcagatgccagatcatgagacacgagaacgaccagaaccccgtgctgatcgacaccggcatgtacgtggtgggcatccagtggaaccacatgggcagcgtgctggccgtggccggcttccagaaggccgccatgcaggacaaggacgtgaacatcgtgcagttctacacccccttcggcgagcacctgggcaccctgaaggtgcccggcaaggagatcagcgccctgagctgggagggcggcggcctgaagatcgccctggccgtggacagcttcatctacttcgccaacatcagacccaactacaagtggggctactgcagcaacaccgtggtgtacgcctacaccagacccgacagacccgagtactgcgtggtgttctgggacaccaagaacaacgagaagtacgtgaagtacgtgaagggcctgatcagcatcaccacctgcggcgacttctgcatcctggccaccaaggccgacgagaaccacccccagttcgtgctggtgctgtgcaacagcatcggcacccccctggaccccaagtacatcgacatcgtgcccctgttcgtggccatgaccaagacccacgtgatcgccgccagcaaggaggccttctacacctggcagtacagagtggccaagaagctgaccgccctggagatcaaccagatcaccagaagcagaaaggagggcagagagagaatctaccacgtggacgacacccccagcggcagcatggacggcgtgctggactacagcaagaccatccagggcaccagagaccccatctgcgccatcaccgccagcgacaagatcctgatcgtgggcagagagagcggcaccatccagagatacagcctgcccaacgtgggcctgatccagaagtacagcctgaactgcagagcctaccagctgagcctgaactgcaacagcagcagactggccatcatcgacatcagcggcgtgctgaccttcttcgacctggacgccagagtgaccgacagcaccggccagcaggtggtgggcgagctgctgaagctggagagaagagacgtgtgggacatgaagtgggccaaggacaaccccgacctgttcgccatgatggagaagaccagaatgtacgtgttcagaaacctggaccccgaggagcccatccagaccagcggctacatctgcaacttcgaggacctggagatcaagagcgtgctgctggacgagatcctgaaggaccccgagcaccccaacaaggactacctgatcaacttcgagatcagaagcctgagagacagcagagccctgatcgagaaggtgggcatcaaggacgccagccagttcatcgaggacaacccccaccccagactgtggagactgctggccgaggccgccctgcagaagctggacctgtacaccgccgagcaggccttcgtgagatgcaaggactaccagggcatcaagttcgtgaagagactgggcaagctgctgagcgagagcatgaagcaggccgaggtggtgggctacttcggcagattcgaggaggccgagagaacctacctggagatggacagaagagacctggccatcggcctgagactgaagctgggcgactggttcagagtgctgcagctgctgaagaccggcagcggcgacgccgacgacagcctgctggagcaggccaacaacgccatcggcgactacttcgccgacagacagaagtggctgaacgccgtgcagtactacgtgcagggcagaaaccaggagagactggccgagtgctactacatgctggaggactacgagggcctggagaacctggccatcagcctgcccgagaaccacaagctgctgcccgagatcgcccagatgttcgtgagagtgggcatgtgcgagcaggccgtgaccgccttcctgaagtgcagccagcccaaggccgccgtggacacctgcgtgcacctgaaccagtggaacaaggccgtggagctggccaagaaccacagcatgaaggagatcggcagcctgctggccagatacgccagccacctgctggagaagaacaagaccctggacgccatcgagctgtacagaaaggccaactacttcttcgacgccgccaagctgatgttcaagatcgccgacgaggaggccaagaagggcagcaagcccctgagagtgaagaagctgtacgtgctgagcgccctgctgatcgagcagtaccacgagcagatgaagaacgcccagagaggcaaggtgaagggcaagagcagcgaggccaccagcgccctggccggcctgctggaggaggaggtgctgagcaccaccgacagattcaccgacaacgcctggagaggcgccgaggcctaccacttcttcatcctggcccagagacagctgtacgagggctgcgtggacaccgccctgaagaccgccctgcacctgaaggactacgaggacatcatcccccccgtggagatctacagcctgctggccctgtgcgcctgcgccagcagagccttcggcacctgcagcaaggccttcatcaagctgaagagcctggagaccctgagcagcgagcagaagcagcagtacgaggacctggccctggagatcttcaccaagcacaccagcaaggacaacagaaagcccgagctggacagcctgatggagggcggcgagggcaagctgcccacctgcgtggccaccggcagccccatcaccgagtaccagttctggatgtgcagcgtgtgcaagcacggcgtgctggcccaggagatcagccactacagcttctgccccctgtgccacagccccgtgggctag

SEQ ID NO: 105217 - DNA, 3546 bp, Artificial Sequence
  Description of Artificial Sequence: Synthetic coding sequence
atgttcttctacctgagcaagaagatcagcatccccaacaacgtgaagctgcagtgcgtgagctggaacaaggagcagggcttcatcgcctgcggcggcgaggacggcctgctgaaggtgctgaagctggagacccagaccgacgacgccaagctgagaggcctggccgcccccagcaacctgagcatgaaccagaccctggagggccacagcggcagcgtgcaggtggtgacctggaacgagcagtaccagaagctgaccaccagcgacgagaacggcctgatcatcgtgtggatgctgtacaagggcagctggatcgaggagatgatcaacaacagaaacaagagcgtggtgagaagcatgagctggaacgccgacggccagaagatctgcatcgtgtacgaggacggcgccgtgatcgtgggcagcgtggacggcaacagaatctggggcaaggacctgaagggcatccagctgagccacgtgacctggagcgccgacagcaaggtgctgctgttcggcatggccaacggcgagatccacatctacgacaaccagggcaacttcatgatcaagatgaagctgagctgcctggtgaacgtgaccggcgccatcagcatcgccggcatccactggtaccacggcaccgagggctacgtggagcccgactgcccctgcctggccgtgtgcttcgacaacggcagatgccagatcatgagacacgagaacgaccagaaccccgtgctgatcgacaccggcatgtacgtggtgggcatccagtggaaccacatgggcagcgtgctggccgtggccggcttccagaaggccgccatgcaggacaaggacgtgaacatcgtgcagttctacacccccttcggcgagcacctgggcaccctgaaggtgcccggcaaggagatcagcgccctgagctgggagggcggcggcctgaagatcgccctggccgtggacagcttcatctacttcgccaacatcagacccaactacaagtggggctactgcagcaacaccgtggtgtacgcctacaccagacccgacagacccgagtactgcgtggtgttctgggacaccaagaacaacgagaagtacgtgaagtacgtgaagggcctgatcagcatcaccacctgcggcgacttctgcatcctggccaccaaggccgacgagaaccacccccaggaggagaacgagatggagaccttcggcgccaccttcgtgctggtgctgtgcaacagcatcggcacccccctggaccccaagtacatcgacatcgtgcccctgttcgtggccatgaccaagacccacgtgatcgccgccagcaaggaggccttctacacctggcagtacagagtggccaagaagctgaccgccctggagatcaaccagatcaccagaagcagaaaggagggcagagagagaatctaccacgtggacgacacccccagcggcagcatggacggcgtgctggactacagcaagaccatccagggcaccagagaccccatctgcgccatcaccgccagcgacaagatcctgatcgtgggcagagagagcggcaccatccagagatacagcctgcccaacgtgggcctgatccagaagtacagcctgaactgcagagcctaccagctgagcctgaactgcaacagcagcagactggccatcatcgacatcagcggcgtgctgaccttcttcgacctggacgccagagtgaccgacagcaccggccagcaggtggtgggcgagctgctgaagctggagagaagagacgtgtgggacatgaagtgggccaaggacaaccccgacctgttcgccatgatggagaagaccagaatgtacgtgttcagaaacctggaccccgaggagcccatccagaccagcggctacatctgcaacttcgaggacctggagatcaagagcgtgctgctggacgagatcctgaaggaccccgagcaccccaacaaggactacctgatcaacttcgagatcagaagcctgagagacagcagagccctgatcgagaaggtgggcatcaaggacgccagccagttcatcgaggacaacccccaccccagactgtggagactgctggccgaggccgccctgcagaagctggacctgtacaccgccgagcaggccttcgtgagatgcaaggactaccagggcatcaagttcgtgaagagactgggcaagctgctgagcgagagcatgaagcaggccgaggtggtgggctacttcggcagattcgaggaggccgagagaacctacctggagatggacagaagagacctggccatcggcctgagactgaagctgggcgactggttcagagtgctgcagctgctgaagaccggcagcggcgacgccgacgacagcctgctggagcaggccaacaacgccatcggcgactacttcgccgacagacagaagtggctgaacgccgtgcagtactacgtgcagggcagaaaccaggagagactggccgagtgctactacatgctggaggactacgagggcctggagaacctggccatcagcctgcccgagaaccacaagctgctgcccgagatcgcccagatgttcgtgagagtgggcatgtgcgagcaggccgtgaccgccttcctgaagtgcagccagcccaaggccgccgtggacacctgcgtgcacctgaaccagtggaacaaggccgtggagctggccaagaaccacagcatgaaggagatcggcagcctgctggccagatacgccagccacctgctggagaagaacaagaccctggacgccatcgagctgtacagaaaggccaactacttcttcgacgccgccaagctgatgttcaagatcgccgacgaggaggccaagaagggcagcaagcccctgagagtgaagaagctgtacgtgctgagcgccctgctgatcgagcagtaccacgagcagatgaagaacgcccagagaggcaaggtgaagggcaagagcagcgaggccaccagcgccctggccggcctgctggaggaggaggtgctgagcaccaccgacagattcaccgacaacgcctggagaggcgccgaggcctaccacttcttcatcctggcccagagacagctgtacgagggctgcgtggacaccgccctgaagaccgccctgcacctgaaggactacgaggacatcatcccccccgtggagatctacagcctgctggccctgtgcgcctgcgccagcagagccttcggcacctgcagcaaggccttcatcaagctgaagagcctggagaccctgagcagcgagcagaagcagcagtacgaggacctggccctggagatcttcaccaagcacaccagcaaggacaacagaaagcccgagctggacagcctgatggagggcggcgagggcaagctgcccacctgcgtggccaccggcagccccatcaccgagtaccagttctggatgtgcagcgtgtgcaagcacggcgtgctggcccaggagatcagccactacagcttctgccccctgtgccacagccccgtgggctag

SEQ ID NO: 105218 - DNA, 1680 bp, Artificial Sequence
  Description of Artificial Sequence: Synthetic coding sequence
atgaccaagacccacgtgatcgccgccagcaaggaggccttctacacctggcagtacagagtggccaagaagctgaccgccctggagatcaaccagatcaccagaagcagaaaggagggcagagagagaatctaccacgtggacgacacccccagcggcagcatggacggcgtgctggactacagcaagaccatccagggcaccagagaccccatctgcgccatcaccgccagcgacaagatcctgatcgtgggcagagagagcggcaccatccagagatacagcctgcccaacgtgggcctgatccagaagtacagcctgaactgcagagcctaccagctgagcctgaactgcaacagcagcagactggccatcatcgacatcagcggcgtgctgaccttcttcgacctggacgccagagtgaccgacagcaccggccagcaggtggtgggcgagctgctgaagctggagagaagagacgtgtgggacatgaagtgggccaaggacaaccccgacctgttcgccatgatggagaagaccagaatgtacgtgttcagaaacctggaccccgaggagcccatccagaccagcggctacatctgcaacttcgaggacctggagatcaagagcgtgctgctggacgagatcctgaaggaccccgagcaccccaacaaggactacctgatcaacttcgagatcagaagcctgagagacagcagagccctgatcgagaaggtgggcatcaaggacgccagccagttcatcgaggacaacccccaccccagactgtggagactgctggccgaggccgccctgcagaagctggacctgtacaccgccgagcaggccttcgtgagatgcaaggactaccagggcatcaagttcgtgaagagactgggcaagctgctgagcgagagcatgaagcaggccgaggtggtgggctacttcggcagattcgaggaggccgagagaacctacctggagatggacagaagagacctggccatcggcctgagactgaagctgggcgactggttcagagtgctgcagctgctgaagaccggcagcggcgacgccgacgacagcctgctggagcaggccaacaacgccatcggcgactacttcgccgacagacagaagtggctgaacgccgtgcagtactacgtgcagggcagaaaccaggagagactggccgagtgctactacatgctggaggactacgagggcctggagaacctggccatcagcctgcccgagaaccacaagctgctgcccatcgccgacgaggaggccaagaagggcagcaagcccctgagagtgaagaagctgtacgtgctgagcgccctgctgatcgagcagtaccacgagcagatgaagaacgcccagagaggcaaggtgaagggcaagagcagcgaggccaccagcgccctggccggcctgctggaggaggaggtgctgagcaccaccgacagattcaccgacaacgcctggagaggcgccgaggcctaccacttcttcatcctggcccagagacagctgtacgagggctgcgtggacaccgccctgaagaccgtggagaagggcaactgccagcacgccctgccccaggaggcccagagcctgagcatcaacagcggctgcgccgtgtacgccaacaccgtgagcctgctgagaaagtag

SEQ ID NO: 105219 - DNA, 2856 bp, Artificial Sequence
  Description of Artificial Sequence: Synthetic coding sequence
atgtgctgcaccgagggcagcctgagaaagagagacagccagagagcccccgaggccgtgctgtgcctgcagctgtggcagagaaccgtgcccctggacaccctgaagggcctgggcacctgcttccccagcggccccgagctgagaggcgccggcatcgccgccgccatggagagagccagcgagagaagaaccgccagcgccctgttcgccggcttcagagccctgggcctgttcagcaacgacatcccccacgtggtgagattcagcgccctgaagagaagattctacgtgaccacctgcgtgggcaagagcttccacacctacgacgtgcagaagctgagcctggtggccgtgagcaacagcgtgccccaggacatctgctgcatggccgccgacggcagactggtgttcgccgcctacggcaacgtgttcagcgccttcgccagaaacaaggagatcgtgcacaccttcaagggccacaaggccgagatccacttcctgcagcccttcggcgaccacatcatcagcgtggacaccgacggcatcctgatcatctggcacatctacagcgaggaggagtacctgcagctgaccttcgacaagagcgtgttcaagatcagcgccatcctgcaccccagcacctacctgaacaagatcctgctgggcagcgagcagggcagcctgcagctgtggaacgtgaagagcaacaagctgctgtacaccttccccggctggaaggtgggcgtgaccgccctgcagcaggcccccgccgtggacgtggtggccatcggcctgatgagcggccaggtgatcatccacaacatcaagttcaacgagaccctgatgaagttcagacaggactggggccccatcaccagcatcagcttcagaaccgacggccaccccgtgatggccgccggcagcccctgcggccacatcggcctgtgggacctggaggacaagaagctgatcaaccagatgagaaacgcccacagcaccgccatcgccggcctgaccttcctgcacagagagcccctgctggtgaccaacggcgccgacaacgccctgagaatctggatcttcgacggccccaccggcgagggcagactgctgagattcagaatgggccacagcgcccccctgaccaacatcagatactacggccagaacggccagcagatcctgagcgccagccaggacggcaccctgcagagcttcagcaccgtgcacgagaagttcaacaagagcctgggccacggcctgatcaacaagaagagagtgaagagaaagggcctgcagaacaccatgagcgtgagactgccccccatcaccaagttcgccgccgaggaggccagagagagcgactgggacggcatcatcgcctgccaccagggcaagctgagctgcagcacctggaactaccagaagagcaccatcggcgcctacttcctgaagcccaaggagctgaagaaggacgacatcaccgccaccgccgtggacatcaccagctgcggcaacttcgccgtgatcggcctgagcagcggcaccgtggacgtgtacaacatgcagagcggcatccacagaggcagcttcggcaaggaccaggcccacaagggcagcgtgagaggcgtggccgtggacggcctgaaccagctgaccgtgaccaccggcagcgagggcctgctgaagttctggaacttcaagaacaagatcctgatccacagcgtgagcctgagcagcagccccaacatcatgctgctgcacagagacagcggcatcctgggcctggccctggacgacttcagcatcagcgtgctggacatcgagaccagaaagatcgtgagagagttcagcggccaccagggccagatcaacgacatggccttcagccccgacggcagatggctgatcagcgccgccatggactgcagcatcagaacctgggacctgcccagcggctgcctgatcgactgcttcctgctggacagcgcccccctgaacgtgagcatgagccccaccggcgacttcctggccaccagccacgtggaccacctgggcatctacctgtggagcaacatcagcctgtacagcgtggtgagcctgagacccctgcccgccgactacgtgcccagcatcgtgatgctgcccggcacctgccagacccaggacgtggaggtgagcgaggagaccgtggagcccagcgacgagctgatcgagtacgacagccccgagcagctgaacgagcagctggtgaccctgagcctgctgcccgagagcagatggaagaacctgctgaacctggacgtgatcaagaagaagaacaagcccaaggagccccccaaggtgcccaagagcgcccccttcttcatccccaccatccccggcctggtgcccagatacgccgcccccgagcagaacaacgacccccagcagagcaaggtggtgaacctgggcgtgctggcccagaagagcgacttctgcctgaagctggaggagggcctggtgaacaacaagtacgacaccgccctgaacctgctgaaggagagcggccccagcggcatcgagaccgagctgagaagcctgagccccgactgcggcggcagcatcgaggtgatgcagagcttcctgaagatgatcggcatgatgctggacagaaagagagacttcgagctggcccaggcctacctggccctgttcctgaagctgcacctgaagatgctgcccagcgagcccgtgctgctggaggagatcaccaacctgagcagccaggtggaggagaactggacccacctgcagagcctgttcaaccagagcatgtgcatcctgaactacctgaagagcgccctgctgtag

SEQ ID NO: 105220 - DNA, 2856 bp, Artificial Sequence; identical to SEQ ID NO: 105219
  Description of Artificial Sequence: Synthetic coding sequence

SEQ ID NO: 105221 - DNA, 1239 bp, Artificial Sequence
  Description of Artificial Sequence: Synthetic coding sequence
atggccggcagcgtgggcctggccctgtgcggccagaccctggtggtgagaggcggcagcagattcctggccaccagcatcgccagcagcgacgacgacagcctgttcatctacgactgcagcgccgccgagaagaagagccaggagaacaagggcgaggacgcccccctggaccagggcagcggcgccatcctggccagcaccttcagcaagagcggcagctacttcgccctgaccgacgacagcaagagactgatcctgttcagaaccaagccctggcagtgcctgagcgtgagaaccgtggccagaagatgcaccgccctgaccttcatcgccagcgaggagaaggtgctggtggccgacaagagcggcgacgtgtacagcttcagcgtgctggagccccacggctgcggcagactggagctgggccacctgagcatgctgctggacgtggccgtgagccccgacgacagattcatcctgaccgccgacagagacgagaagatcagagtgagctgggccgccgccccccacagcatcgagagcttctgcctgggccacaccgagttcgtgagcagaatcagcgtggtgcccacccagcccggcctgctgctgagcagcagcggcgacggcaccctgagactgtgggagtacagaagcggcagacagctgcactgctgccacctggccagcctgcaggagctggtggacccccaggccccccagaagttcgccgccagcagaatcgccttctggtgccaggagaactgcgtggccctgctgtgcgacggcacccccgtggtgtacatcttccagctggacgccagaagacagcagctggtgtacagacagcagctggccttccagcaccaggtgtgggacgtggccttcgaggagacccagggcctgtgggtgctgcaggactgccaggaggcccccctggtgctgtacagacccgtgggcgaccagtggcagagcgtgcccgagagcaccgtgctgaagaaggtgagcggcgtgctgagaggcaactgggccatgctggagggcagcgccggcgccgacgccagcttcagcagcctgtacaaggccaccttcgacaacgtgaccagctacctgaagaagaaggaggagagactgcagcagcagctggagaagaagcagagaagaagaagccccccccccggccccgacggccacgccaagaagatgagacccggcgaggccaccctgagctgctag

SEQ ID NO: 105222 - DNA, 1239 bp, Artificial Sequence; identical to SEQ ID NO: 105221
  Description of Artificial Sequence: Synthetic coding sequence

SEQ ID NO: 105223 - DNA, 2034 bp, Artificial Sequence
  Description of Artificial Sequence: Synthetic coding sequence
atggccgcccaccacagacagaacaccgccggcagaagaaaggtgcaggtgagctacgtgatcagagacgaggtggagaagtacaacagaaacggcgtgaacgccctgcagctggaccccgccctgaacagactgttcaccgccggcagagacagcatcatcagaatctggagcgtgaaccagcacaagcaggacccctacatcgccagcatggagcaccacaccgactgggtgaacgacatcgtgctgtgctgcaacggcaagaccctgatcagcgccagcagcgacaccaccgtgaaggtgtggaacgcccacaagggcttctgcatgagcaccctgagaacccacaaggactacgtgaaggccctggcctacgccaaggacaaggagctggtggccagcgccggcctggacagacagatcttcctgtgggacgtgaacaccctgaccgccctgaccgccagcaacaacaccgtgaccaccagcagcctgagcggcaacaaggacagcatctacagcctggccatgaaccagctgggcaccatcatcgtgagcggcagcaccgagaaggtgctgagagtgtgggaccccagaacctgcgccaagctgatgaagctgaagggccacaccgacaacgtgaaggccctgctgctgaacagagacggcacccagtgcctgagcggcagcagcgacggcaccatcagactgtggagcctgggccagcagagatgcatcgccacctacagagtgcacgacgagggcgtgtgggccctgcaggtgaacgacgccttcacccacgtgtacagcggcggcagagacagaaagatctactgcaccgacctgagaaaccccgacatcagagtgctgatctgcgaggagaaggcccccgtgctgaagatggagctggacagaagcgccgaccccccccccgccatctgggtggccaccaccaagagcaccgtgaacaagtggaccctgaagggcatccacaacttcagagccagcggcgactacgacaacgactgcaccaaccccatcacccccctgtgcacccagcccgaccaggtgatcaagggcggcgccagcatcatccagtgccacatcctgaacgacaagagacacatcctgaccaaggacaccaacaacaacgtggcctactgggacgtgctgaaggcctgcaaggtggaggacctgggcaaggtggacttcgaggacgagatcaagaagagattcaagatggtgtacgtgcccaactggttcagcgtggacctgaagaccggcatgctgaccatcaccctggacgagagcgactgcttcgccgcctgggtgagcgccaaggacgccggcttcagcagccccgacggcagcgaccccaagctgaacctgggcggcctgctgctgcaggccctgctggagtactggcccagaacccacgtgaaccccatggacgaggaggagaacgaggtgaaccacgtgaacggcgagcaggagaacagagtgcagaagggcaacggctacttccaggtgcccccccacacccccgtgatcttcggcgaggccggcggcagaaccctgttcagactgctgtgcagagacagcggcggcgagaccgagagcatgctgctgaacgagaccgtgccccagtgggtgatcgacatcaccgtggacaagaacatgcccaagttcaacaagatccccttctacctgcagccccacgccagcagcggcgccaagaccctgaagaaggacagactgagcgccagcgacatgctgcaggtgagaaaggtgatggagcacgtgtacgagaagatcatcaacctggacaacgagagccagaccaccagcagcagcaacaacgagaagcccggcgagcaggagaaggaggaggacatcgccgtgctggccgaggagaagatcgagctgctgtgccaggaccaggtgctggaccccaacatggacctgagaaccgtgaagcacttcatctggaagagcggcggcgacctgaccctgcactacagacagaagagcacctag

SEQ ID NO: 105224 - DNA, 1788 bp, Artificial Sequence
  Description of Artificial Sequence: Synthetic coding sequence
atggagtgccagagcgcccaggtgatcagcgccagcagcgacaccaccgtgaaggtgtggaacgcccacaagggcttctgcatgagcaccctgagaacccacaaggactacgtgaaggccctggcctacgccaaggacaaggagctggtggccagcgccggcctggacagacagatcttcctgtgggacgtgaacaccctgaccgccctgaccgccagcaacaacaccgtgaccaccagcagcctgagcggcaacaaggacagcatctacagcctggccatgaaccagctgggcaccatcatcgtgagcggcagcaccgagaaggtgctgagagtgtgggaccccagaacctgcgccaagctgatgaagctgaagggccacaccgacaacgtgaaggccctgctgctgaacagagacggcacccagtgcctgagcggcagcagcgacggcaccatcagactgtggagcctgggccagcagagatgcatcgccacctacagagtgcacgacgagggcgtgtgggccctgcaggtgaacgacgccttcacccacgtgtacagcggcggcagagacagaaagatctactgcaccgacctgagaaaccccgacatcagagtgctgatctgcgaggagaaggcccccgtgctgaagatggagctggacagaagcgccgaccccccccccgccatctgggtggccaccaccaagagcaccgtgaacaagtggaccctgaagggcatccacaacttcagagccagcggcgactacgacaacgactgcaccaaccccatcacccccctgtgcacccagcccgaccaggtgatcaagggcggcgccagcatcatccagtgccacatcctgaacgacaagagacacatcctgaccaaggacaccaacaacaacgtggcctactgggacgtgctgaaggcctgcaaggtggaggacctgggcaaggtggacttcgaggacgagatcaagaagagattcaagatggtgtacgtgcccaactggttcagcgtggacctgaagaccggcatgctgaccatcaccctggacgagagcgactgcttcgccgcctgggtgagcgccaaggacgccggcttcagcagccccgacggcagcgaccccaagctgaacctgggcggcctgctgctgcaggccctgctggagtactggcccagaacccacgtgaaccccatggacgaggaggagaacgaggtgaaccacgtgaacggcgagcaggagaacagagtgcagaagggcaacggctacttccaggtgcccccccacacccccgtgatcttcggcgaggccggcggcagaaccctgttcagactgctgtgcagagacagcggcggcgagaccgagagcatgctgctgaacgagaccgtgccccagtgggtgatcgacatcaccgtggacaagaacatgcccaagttcaacaagatccccttctacctgcagccccacgccagcagcggcgccaagaccctgaagaaggacagactgagcgccagcgacatgctgcaggtgagaaaggtgatggagcacgtgtacgagaagatcatcaacctggacaacgagagccagaccaccagcagcagcaacaacgagaagcccggcgagcaggagaaggaggaggacatcgccgtgctggccgaggagaagatcgagctgctgtgccaggaccaggtgctggaccccaacatggacctgagaaccgtgaagcacttcatctggaagagcggcggcgacctgaccctgcactacagacagaagagcacctag

SEQ ID NO: 105225 - DNA, 366 bp, Artificial Sequence
  Description of Artificial Sequence: Synthetic coding sequence
atgcccaagttcaacaagatccccttctacctgcagccccacgccagcagcggcgccaagaccctgaagaaggacagactgagcgccagcgacatgctgcaggtgagaaaggtgatggagcacgtgtacgagaagatcatcaacctggacaacgagagccagaccaccagcagcagcaacaacgagaagcccggcgagcaggagaaggaggaggacatcgccgtgctggccgaggagaagatcgagctgctgtgccaggaccaggtgagagtgctggaccccaacatggacctgagaaccgtgaagcacttcatctggaagagcggcggcgacctgaccctgcactacagacagaagagcacctag

SEQ ID NO: 105226 - DNA, 1209 bp, Artificial Sequence
  Description of Artificial Sequence: Synthetic coding sequence
atggccgcccaccacagacagaacaccgccggcagaagaaaggtgcagtgcctgagcggcagcagcgacggcaccatcagactgtggagcctgggccagcagagatgcatcgccacctacagagtgcacgacgagggcgtgtgggccctgcaggtgaacgacgccttcacccacgtgtacagcggcggcagagacagaaagatctactgcaccgacctgagaaaccccgacatcagagtgctgatctgcgaggagaaggcccccgtgctgaagatggagctggacagaagcgccgaccccccccccgccatctgggtggccaccaccaagagcaccgtgaacaagtgggcctgcaaggtggaggacctgggcaaggtggacttcgaggacgagatcaagaagagattcaagatggtgtacgtgcccaactggttcagcgtggacctgaagaccggcatgctgaccatcaccctggacgagagcgactgcttcgccgcctgggtgagcgccaaggacgccggcttcagcagccccgacggcagcgaccccaagctgaacctgggcggcctgctgctgcaggccctgctggagtactggcccagaacccacgtgaaccccatggacgaggaggagaacgaggtgaaccacgtgaacggcgagcaggagaacagagtgcagaagggcaacggctacttccaggtgcccccccacacccccgtgatcttcggcgaggccggcggcagaaccctgttcagactgctgtgcagagacagcggcggcgagaccgagagcatgctgctgaacgagaccgtgccccagtgggtgatcgacatcaccgtggacaagaacatgcccaagttcaacaagatccccttctacctgcagccccacgccagcagcggcgccaagaccctgaagaaggacagactgagcgccagcgacatgctgcaggtgagaaaggtgatggagcacgtgtacgagaagatcatcaacctggacaacgagagccagaccaccagcagcagcaacaacgagaagcccggcgagcaggagaaggaggaggacatcgccgtgctggccgaggagaagatcgagctgctgtgccaggaccaggtgctggaccccaacatggacctgagaaccgtgaagcacttcatctggaagagcggcggcgacctgaccctgcactacagacagaagagcacctag

SEQ ID NO: 105227 - DNA, 651 bp, Artificial Sequence
  Description of Artificial Sequence: Synthetic coding sequence
atggacgccctggaggactacgtgtggcccagagccaccagcgagctgatcctgctgcccgtgaccggcctggagtgcgtgggcgacagactgctggccggcgagggccccgacgtgctggtgtacagcctggacttcggcggccacctgagaatgatcaagagagtgcagaacctgctgggccactacctgatccacggcttcagagtgagacccgagcccaacggcgacctggacctggaggccatggtggccgtgttcggcagcaagggcctgagagtggtgaagatcagctggggccagggccacttctgggagctgtggagaagcggcctgtggaacatgagcgactggatctgggacgccagatggctggagggcaacatcgccctggccctgggccacaacagcgtggtgctgtacgaccccgtggtgggctgcatcctgcaggaggtgccctgcaccgacagatgcaccctgagcagcgcctgcctgatcggcgacgcctggaaggagctgaccatcgtggccggcgccgtgagcaaccagctgctggtgtggtaccccgccaccgccttcaccctgtacctgagcgccagacccacccccttctgctgcgtgctgacccccagaatgtgcaccagactgtag

SEQ ID NO: 105228 - DNA, 3456 bp, Artificial Sequence
  Description of Artificial Sequence: Synthetic coding sequence
atgggcagcgccgccagatgggagggcagcttcagcagagagttcagcagcctgctgagcagaggctgcctgagcaccagcagaatcgacatggacgccctggaggactacgtgtggcccagagccaccagcgagctgatcctgctgcccgtgaccggcctggagtgcgtgggcgacagactgctggccggcgagggccccgacgtgctggtgtacagcctggacttcggcggccacctgagaatgatcaagagagtgcagaacctgctgggccactacctgatccacggcttcagagtgagacccgagcccaacggcgacctggacctggaggccatggtggccgtgttcggcagcaagggcctgagagtggtgaagatcagctggggccagggccacttctgggagctgtggagaagcggcctgtggaacatgagcgactggatctgggacgccagatggctggagggcaacatcgccctggccctgggccacaacagcgtggtgctgtacgaccccgtggtgggctgcatcctgcaggaggtgccctgcaccgacagatgcaccctgagcagcgcctgcctgatcggcgacgcctggaaggagctgaccatcgtggccggcgccgtgagcaaccagctgctggtgtggtaccccgccaccgccctggccgacaacaagcccgtggcccccgacagaagaatcagcggccacgtgggcatcatcttcagcatgagctacctggagagcaagggcctgctggccaccgccagcgaggacagaagcgtgagaatctggaaggtgggcgacctgagagtgcccggcggcagagtgcagaacatcggccactgcttcggccacagcgccagagtgtggcaggtgaagctgctggagaactacctgatcagcgccggcgaggactgcgtgtgcctggtgtggagccacgagggcgagatcctgcaggccttcagaggccaccagggcagaggcatcagagccatcgccgcccacgagagacaggcctgggtgatcaccggcggcgacgacagcggcatcagactgtggcacctggtgggcagaggctacagaggcctgggcgtgagcgccctgtgcttcaagagcagaagcagacccggcaccctgaaggccgtgaccctggccggcagctggagactgctggccgtgaccgacaccggcgccctgtacctgtacgacgtggaggtgaagtgctgggagcagctgctggaggacaagcacttccagagctactgcctgctggaggccgcccccggccccgagggcttcggcctgtgcgccatggccaacggcgagggcagagtgaaggtggtgcccatcaacacccccaccgccgccgtggaccagaccctgttccccggcaaggtgcacagcctgagctgggccctgagaggctacgaggagctgctgctgctggccagcggccccggcggcgtggtggcctgcctggagatcagcgccgcccccagcggcaaggccatcttcgtgaaggagagatgcagatacctgctgccccccagcaagcagagatggcacacctgcagcgccttcctgccccccggcgacttcctggtgtgcggcgacagaagaggcagcgtgctgctgttccccagcagacccggcctgctgaaggaccccggcgtgggcggcaaggccagagccggcgccggcgcccccgtggtgggcagcggcagcagcggcggcggcaacgccttcaccggcctgggccccgtgagcaccctgcccagcctgcacggcaagcagggcgtgaccagcgtgacctgccacggcggctacgtgtacaccaccggcagagacggcgcctactaccagctgttcgtgagagacggccagctgcagcccgtgctgagacagaagagctgcagaggcatgaactggctggccggcctgagaatcgtgcccgacggcagcatggtgatcctgggcttccacgccaacgagttcgtggtgtggaaccccagaagccacgagaagctgcacatcgtgaactgcggcggcggccacagaagctgggccttcagcgacaccgaggccgccatggccttcgcctacctgaaggacggcgacgtgatgctgtacagagccctgggcggctgcaccagaccccacgtgatcctgagagagggcctgcacggcagagagatcacctgcgtgaagagagtgggcaccatcaccctgggccccgagtacggcgtgcccagcttcatgcagcccgacgacctggagcccggcagcgagggccccgacctgaccgacatcgtgatcacctgcagcgaggacaccaccgtgtgcgtgctggccctgcccaccaccaccggcagcgcccacgccctgaccgccgtgtgcaaccacatcagcagcgtgagagccgtggccgtgtggggcatcggcacccccggcggcccccaggacccccagcccggcctgaccgcccacgtggtgagcgccggcggcagagccgagatgcactgcttcagcatcatggtgacccccgaccccagcacccccagcagactggcctgccacgtgatgcacctgagcagccacagactggacgagtactgggacagacagagaaacagacacagaatggtgaaggtggaccccgagaccagatacatgagcctggccgtgtgcgagctggaccagcccggcctgggccccctggtggccgccgcctgcagcgacggcgccgtgagactgttcctgctgcaggacagcggcagaatcctgcagctgctggccgagaccttccaccacaagagatgcgtgctgaaggtgcacagcttcacccacgaggcccccaaccagagaagaagactgctgctgtgcagcgccgccaccgacggcagcctggccttctgggacctgaccaccatgctggaccacgacagcaccgtgctggagccccccgtggaccccggcctgccctacagactgggcacccccagcctgaccctgcaggcccacagctgcggcatcaacagcctgcacaccctgcccaccagagagggccaccacctggtggccagcggcagcgaggacggcagcctgcacgtgttcgtgctggccgtggagatgctgcagctggaggaggccgtgggcgaggccggcctggtgccccagctgagagtgctggaggagtacagcgtgccctgcgcccacgccgcccacgtgaccggcctgaagatcctgagccccagcatcatggtgagcgccagcatcgaccagagactgaccttctggagactgggccacggcgagcccaccttcatgaacagcaccgtgttccacgtgcccgacgtggccgacatggactgctggcccgtgagccccgagttcggccacagatgcgccctgggcggccagggcctggaggtgtacaactggtacgactag

SEQ ID NO: 105229 - DNA, 3213 bp, Artificial Sequence
  Description of Artificial Sequence: Synthetic coding sequence
atgatcaagagagtgcagaacctgctgggccactacctgatccacggcttcagagtgagacccgagcccaacggcgacctggacctggaggccatggtggccgtgttcggcagcaagggcctgagagtggtgaagatcagctggggccagggccacttctgggagctgtggagaagcggcctgtggaacatgagcgactggatctgggacgccagatggctggagggcaacatcgccctggccctgggccacaacagcgtggtgctgtacgaccccgtggtgggctgcatcctgcaggaggtgccctgcaccgacagatgcaccctgagcagcgcctgcctgatcggcgacgcctggaaggagctgaccatcgtggccggcgccgtgagcaaccagctgctggtgtggtaccccgccaccgccctggccgacaacaagcccgtggcccccgacagaagaatcagcggccacgtgggcatcatcttcagcatgagctacctggagagcaagggcctgctggccaccgccagcgaggacagaagcgtgagaatctggaaggtgggcgacctgagagtgcccggcggcagagtgcagaacatcggccactgcttcggccacagcgccagagtgtggcaggtgaagctgctggagaactacctgatcagcgccggcgaggactgcgtgtgcctggtgtggagccacgagggcgagatcctgcaggccttcagaggccaccagggcagaggcatcagagccatcgccgcccacgagagacaggcctgggtgatcaccggcggcgacgacagcggcatcagactgtggcacctggtgggcagaggctacagaggcctgggcgtgagcgccctgtgcttcaagagcagaagcagacccggcaccctgaaggccgtgaccctggccggcagctggagactgctggccgtgaccgacaccggcgccctgtacctgtacgacgtggaggtgaagtgctgggagcagctgctggaggacaagcacttccagagctactgcctgctggaggccgcccccggccccgagggcttcggcctgtgcgccatggccaacggcgagggcagagtgaaggtggtgcccatcaacacccccaccgccgccgtggaccagaccctgttccccggcaaggtgcacagcctgagctgggccctgagaggctacgaggagctgctgctgctggccagcggccccggcggcgtggtggcctgcctggagatcagcgccgcccccagcggcaaggccatcttcgtgaaggagagatgcagatacctgctgccccccagcaagcagagatggcacacctgcagcgccttcctgccccccggcgacttcctggtgtgcggcgacagaagaggcagcgtgctgctgttccccagcagacccggcctgctgaaggaccccggcgtgggcggcaaggccagagccggcgccggcgcccccgtggtgggcagcggcagcagcggcggcggcaacgccttcaccggcctgggccccgtgagcaccctgcccagcctgcacggcaagcagggcgtgaccagcgtgacctgccacggcggctacgtgtacaccaccggcagagacggcgcctactaccagctgttcgtgagagacggccagctgcagcccgtgctgagacagaagagctgcagaggcatgaactggctggccggcctgagaatcgtgcccgacggcagcatggtgatcctgggcttccacgccaacgagttcgtggtgtggaaccccagaagccacgagaagctgcacatcgtgaactgcggcggcggccacagaagctgggccttcagcgacaccgaggccgccatggccttcgcctacctgaaggacggcgacgtgatgctgtacagagccctgggcggctgcaccagaccccacgtgatcctgagagagggcctgcacggcagagagatcacctgcgtgaagagagtgggcaccatcaccctgggccccgagtacggcgtgcccagcttcatgcagcccgacgacctggagcccggcagcgagggccccgacctgaccgacatcgtgatcacctgcagcgaggacaccaccgtgtgcgtgctggccctgcccaccaccaccggcagcgcccacgccctgaccgccgtgtgcaaccacatcagcagcgtgagagccgtggccgtgtggggcatcggcacccccggcggcccccaggacccccagcccggcctgaccgcccacgtggtgagcgccggcggcagagccgagatgcactgcttcagcatcatggtgacccccgaccccagcacccccagcagactggcctgccacgtgatgcacctgagcagccacagactggacgagtactgggacagacagagaaacagacacagaatggtgaaggtggaccccgagaccagatacatgagcctggccgtgtgcgagctggaccagcccggcctgggccccctggtggccgccgcctgcagcgacggcgccgtgagactgttcctgctgcaggacagcggcagaatcctgcagctgctggccgagaccttccaccacaagagatgcgtgctgaaggtgcacagcttcacccacgaggcccccaaccagagaagaagactgctgctgtgcagcgccgccaccgacggcagcctggccttctgggacctgaccaccatgctggaccacgacagcaccgtgctggagccccccgtggaccccggcctgccctacagactgggcacccccagcctgaccctgcaggcccacagctgcggcatcaacagcctgcacaccctgcccaccagagagggccaccacctggtggccagcggcagcgaggacggcagcctgcacgtgttcgtgctggccgtggagatgctgcagctggaggaggccgtgggcgaggccggcctggtgccccagctgagagtgctggaggagtacagcgtgccctgcgcccacgccgcccacgtgaccggcctgaagatcctgagccccagcatcatggtgagcgccagcatcgaccagagactgaccttctggagactgggccacggcgagcccaccttcatgaacagcaccgtgttccacgtgcccgacgtggccgacatggactgctggcccgtgagccccgagttcggccacagatgcgccctgggcggccagggcctggaggtgtacaactggtacgactag

SEQ ID NO: 105230 - DNA, 4557 bp, Artificial Sequence
  Description of Artificial Sequence: Synthetic coding sequence
atggccgccgtgggcagcggcggctacgccagaaacgacgccggcgagaagctgcccagcgtgatggccggcgtgcccgccagaagaggccagagcagccccccccccgccccccccatctgcctgagaagaagaaccagactgagcaccgccagcgaggagaccgtgcagaacagagtgagcctggagaaggtgctgggcatcaccgcccagaacagcagcggcctgacctgcgaccccggcaccggccacgtggcctacctggccggctgcgtggtggtgatcctggaccccaaggagaacaagcagcagcacatcttcaacaccgccagaaagagcctgagcgccctggccttcagccccgacggcaagtacatcgtgaccggcgagaacggccacagacccgccgtgagaatctgggacgtggaggagaagaaccaggtggccgagatgctgggccacaagtacggcgtggcctgcgtggccttcagccccaacatgaagcacatcgtgagcatgggctaccagcacgacatggtgctgaacgtgtgggactggaagaaggacatcgtggtggccagcaacaaggtgagctgcagagtgatcgccctgagcttcagcgaggacagcagctacttcgtgaccgtgggcaacagacacgtgagattctggttcctggaggtgagcaccgagaccaaggtgaccagcaccgtgcccctggtgggcagaagcggcatcctgggcgagctgcacaacaacatcttctgcggcgtggcctgcggcagaggcagaatggccggcagcaccttctgcgtgagctacagcggcctgctgtgccagttcaacgagaagagagtgctggagaagtggatcaacctgaaggtgagcctgagcagctgcctgtgcgtgagccaggagctgatcttctgcggctgcaccgacggcatcgtgagaatcttccaggcccacagcctgcactacctggccaacctgcccaagccccactacctgggcgtggacgtggcccagggcctggagcccagcttcctgttccacagaaaggccgaggccgtgtaccccgacaccgtggccctgaccttcgaccccatccaccagtggctgagctgcgtgtacaaggaccacagcatctacatctgggacgtgaaggacatcaacagagtgggcaaggtgtggagcgagctgttccacagcagctacgtgtggaacgtggaggtgtaccccgagttcgaggaccagagagcctgcctgcccagcggcagcttcctgacctgcagcagcgacaacaccatcagattctggaacctggacagcagccccgacagccactggcagaagaacatcttcagcaacaccctgctgaaggtggtgtacgtggagaacgacatccagcacctgcaggacatgagccacttccccgacagaggcagcgagaacggcacccccatggacgtgaaggccggcgtgagagtgatgcaggtgagccccgacggccagcacctggccagcggcgacagaagcggcaacctgagaatccacgagctgcacttcatggacgagctggtgaaggtggaggcccacgacgccgaggtgctgtgcctggagtacagcaagcccgagaccggcctgaccctgctggccagcgccagcagagacagactgatccacgtgctgaacgtggagaagaactacaacctggagcagaccctggacgaccacagcagcagcatcaccgccatcaagttcgccggcaacagagacatccagatgatcagctgcggcgccgacaagagcatctacttcagaagcgcccagcagggcagcgacggcctgcacttcgtgagaacccaccacgtggccgagaagaccaccctgtacgacatggacatcgacatcacccagaagtacgtggccgtggcctgccaggacagaaacgtgagagtgtacaacaccgtgaacggcaagcagaagaagtgctacaagggcagccagggcgacgagggcagcctgctgaaggtgcacgtggaccccagcggcaccttcctggccaccagctgcagcgacaagagcatcagcgtgatcgacttctacagcggcgagtgcatcgccaagatgttcggccacagcgagatcatcaccagcatgaagttcacctacgactgccaccacctgatcaccgtgagcggcgacagctgcgtgttcatctggcacctgggccccgagatcaccaactgcatgaagcagcacctgctggagatcgaccacagacagcagcagcagcacaccaacgacaagaagagaagcggccaccccagacaggacacctacgtgagcacccccagcgagatccacagcctgagccccggcgagcagaccgaggacgacctggaggaggagtgcgagcccgaggagatgctgaagacccccagcaaggacagcctggaccccgaccccagatgcctgctgaccaacggcaagctgcccctgtgggccaagagactgctgggcgacgacgacgtggccgacggcctggccttccacgccaagagaagctaccagccccacggcagatgggccgagagagccggccaggagcccctgaagaccatcctggacgcccaggacctggactgctacttcacccccatgaagcccgagagcctggagaacagcatcctggacagcctggagccccagagcctggccagcctgctgagcgagagcgagagcccccaggaggccggcagaggccaccccagcttcctgccccagcagaaggagagcagcgaggccagcgagctgatcctgtacagcctggaggccgaggtgaccgtgaccggcaccgacagccagtactgcagaaaggaggtggaggccggccccggcgaccagcagggcgacagctacctgagagtgagcagcgacagccccaaggaccagagcccccccgaggacagcggcgagagcgaggccgacctggagtgcagcttcgccgccatccacagccccgcccccccccccgaccccgcccccagattcgccaccagcctgccccacttccccggctgcgccggccccaccgaggacgagctgagcctgcccgagggccccagcgtgcccagcagcagcctgccccagacccccgagcaggagaagttcctgagacaccacttcgagaccctgaccgagagcccctgcagagccctgggcgacgtggaggccagcgaggccgaggaccacttcttcaaccccagactgagcatcagcacccagttcctgagcagcctgcagaaggccagcagattcacccacaccttcccccccagagccacccagtgcctggtgaagagccccgaggtgaagctgatggacagaggcggcagccagcccagagccggcaccggctacgccagccccgacagaacccacgtgctggccgccggcaaggccgaggagaccctggaggcctggagacccccccccccctgcctgaccagcctggccagctgcgtgcccgccagcagcgtgctgcccaccgacagaaacctgcccacccccaccagcgcccccacccccggcctggcccagggcgtgcacgcccccagcacctgcagctacatggaggccaccgccagcagcagagccagaatcagcagaagcatcagcctgggcgacagcgagggccccatcgtggccaccctggcccagcccctgagaagacccagcagcgtgggcgagctggccagcctgggccaggagctgcaggccatcaccaccgccaccacccccagcctggacagcgagggccaggagcccgccctgagaagctggggcaaccacgaggccagagccaacctgagactgaccctgagcagcgcctgcgacggcctgctgcagccccccgtggacacccagcccggcgtgaccgtgcccgccgtgagcttccccgcccccagccccgtggaggagagcgccctgagactgcacggcagcgccttcagacccagcctgcccgcccccgagagccccggcctgcccgcccaccccagcaacccccagctgcccgaggccagacccggcatccccggcggcaccgccagcctgctggagcccaccagcggcgccctgggcctgctgcagggcagccccgccagatggagcgagccctgggtgcccgtggaggccctgccccccagccccctggagctgagcagagtgggcaacatcctgcacagactgcagaccaccttccaggaggccctggacctgtacagagtgctggtgagcagcggccaggtggacaccggccagcagcaggccagaaccgagctggtgagcaccttcctgtggatccacagccagctggaggccgagtgcctggtgggcaccagcgtggcccccgcccaggccctgcccagccccggcccccccagcccccccaccctgtaccccctggccagccccgacctgcaggccctgctggagcactacagcgagctgctggtgcaggccgtgagaagaaaggccagaggccactag

SEQ ID NO: 105231 - DNA, 1245 bp, Artificial Sequence
  Description of Artificial Sequence: Synthetic coding sequence
atggccgccgtgggcagcggcggctacgccagaaacgacgccggcgagaagctgcccagcgtgatggccggcgtgcccgccagaagaggccagagcagccccccccccgccccccccatctgcctgagaagaagaaccagactgagcaccgccagcgaggagaccgtgcagaacagagtgagcctggagaaggtgctgggcatcaccgcccagaacagcagcggcctgacctgcgaccccggcaccggccacgtggcctacctggccggctgcgtggtggtgatcctggaccccaaggagaacaagcagcagcacatcttcaacaccgccagaaagagcctgagcgccctggccttcagccccgacggcaagtacatcgtgaccggcgagaacggccacagacccgccgtgagaatctgggacgtggaggagaagaaccaggtggccgagatgctgggccacaagtacggcgtggcctgcgtggccttcagccccaacatgaagcacatcgtgagcatgggctaccagcacgacatggtgctgaacgtgtgggactggaagaaggacatcgtggtggccagcaacaaggtgagctgcagagtgatcgccctgagcttcagcgaggacagcagctacttcgtgaccgtgggcaacagacacgtgagattctggttcctggaggtgagcaccgagaccaaggtgaccagcaccgtgcccctggtgggcagaagcggcatcctgggcgagctgcacaacaacatcttctgcggcgtggcctgcggcagaggcagaatggccggcagcaccttctgcgtgagctacagcggcctgctgtgccagttcaacgagaagagagtgctggagaagtggatcaacctgaaggtgagcctgagcagctgcctgtgcgtgagccaggagctgatcttctgcggctgcaccgacggcatcgtgagaatcttccaggcccacagcctgcactacctggccaacctgcccaagccccactacctgggcgtggacgtggcccagggcctggagcccagcttcctgttccacagaaaggccgaggccgtgtaccccgacaccgtggccctgaccttcgaccccatccaccagtggctgagctgcgtgtacaaggaccacagcatctacatctgggacgtgaaggacatcaacagagtgggcaaggtgtggagcgagctgttccacagcagctacgtgtggaacgtggaggccctgagctag

SEQ ID NO: 105232 - DNA, 1452 bp, Artificial Sequence
  Description of Artificial Sequence: Synthetic coding sequence
atggccgccgtgggcagcggcggctacgccagaaacgacgccggcgagaagctgcccagcgtgatggccggcgtgcccgccagaagaggccagagcagccccccccccgccccccccatctgcctgagaagaagaaccagactgagcaccgccagcgaggagaccgtgcagaacagagtgagcctggagaaggtgctgggcatcaccgcccagaacagcagcggcctgacctgcgaccccggcaccggccacgtggcctacctggccggctgcgtggtggtgatcctggaccccaaggagaacaagcagcagcacatcttcaacaccgccagaaagagcctgagcgccctggccttcagccccgacggcaagtacatcgtgaccggcgagaacggccacagacccgccgtgagaatctgggacgtggaggagaagaaccaggtggccgagatgctgggccacaagtacggcgtggcctgcgtggccttcagccccaacatgaagcacatcgtgagcatgggctaccagcacgacatggtgctgaacgtgtgggactggaagaaggacatcgtggtggccagcaacaaggtgagctgcagagtgatcgccctgagcttcagcgaggacagcagctacttcgtgaccgtgggcaacagacacgtgagattctggttcctggaggtgagcaccgagaccaaggtgaccagcaccgtgcccctggtgggcagaagcggcatcctgggcgagctgcacaacaacatcttctgcggcgtggcctgcggcagaggcagaatggccggcagcaccttctgcgtgagctacagcggcctgctgtgccagttcaacgagaagagagtgctggagaagtggatcaacctgaaggtgagcctgagcagctgcctgtgcgtgagccaggagctgatcttctgcggctgcaccgacggcatcgtgagaatcttccaggcccacagcctgcactacctggccaacctgcccaagccccactacctgggcgtggacgtggcccagggcctggagcccagcttcctgttccacagaaaggccgaggccgtgtaccccgacaccgtggccctgaccttcgaccccatccaccagtggctgagctgcgtgtacaaggaccacagcatctacatctgggacgtgaaggacatcaacagagtgggcaaggtgtggagcgagctgttccacagcagctacgtgtggaacgtggaggtgtaccccgagttcgaggaccagagagcctgcctgcccagcggcagcttcctgacctgcagcagcgacaacaccatcagattctggaacctggacagcagccccgacagccactggcagaagaacatcttcagcaacctggcccccgccctgcagatgtgcggcagaggccacagcagacagcccaacacccccagccccggcgagatcgccagctag

SEQ ID NO: 105233 - DNA, 4572 bp, Artificial Sequence
  Description of Artificial Sequence: Synthetic coding sequence
atggccgccgtgggcagcggcggctacgccagaaacgacgccggcgagaagctgcccagcgtgatggccggcgtgcccgccagaagaggccagagcagccccccccccgccccccccatctgcctgagaagaagaaccagactgagcaccgccagcgaggagaccgtgcagaacagagtgagcctggagaaggtgctgggcatcaccgcccagaacagcagcggcctgacctgcgaccccggcaccggccacgtggcctacctggccggctgcgtggtggtgatcctggaccccaaggagaacaagcagcagcacatcttcaacaccgccagaaagagcctgagcgccctggccttcagccccgacggcaagtacatcgtgaccggcgagaacggccacagacccgccgtgagaatctgggacgtggaggagaagaaccaggtggccgagatgctgggccacaagtacggcgtggcctgcgtggccttcagccccaacatgaagcacatcgtgagcatgggctaccagcacgacatggtgctgaacgtgtgggactggaagaaggacatcgtggtggccagcaacaaggtgagctgcagagtgatcgccctgagcttcagcgaggacagcagctacttcgtgaccgtgggcaacagacacgtgagattctggttcctggaggtgagcaccgagaccaaggtgaccagcaccgtgcccctggtgggcagaagcggcatcctgggcgagctgcacaacaacatcttctgcggcgtggcctgcggcagaggcagaatggccggcagcaccttctgcgtgagctacagcggcctgctgtgccagttcaacgagaagagagtgctggagaagtggatcaacctgaaggtgagcctgagcagctgcctgtgcgtgagccaggagctgatcttctgcggctgcaccgacggcatcgtgagaatcttccaggcccacagcctgcactacctggccaacctgcccaagccccactacctgggcgtggacgtggcccagggcctggagcccagcttcctgttccacagaaaggccgaggccgtgtaccccgacaccgtggccctgaccttcgaccccatccaccagtggctgagctgcgtgtacaaggaccacagcatctacatctgggacgtgaaggacatcaacagagtgggcaaggtgtggagcgagctgttccacagcagctacgtgtggaacgtggaggtgtaccccgagttcgaggaccagagagcctgcctgcccagcggcagcttcctgacctgcagcagcgacaacaccatcagattctggaacctggacagcagccccgacagccactggcagaagaacatcttcagcaacaccctgctgaaggtggtgtacgtggagaacgacatccagcacctgcaggacatgagccacttccccgacagaggcagcgagaacggcacccccatggacgtgaaggccggcgtgagagtgatgcaggtgagccccgacggccagcacctggccagcggcgacagaagcggcaacctgagaatccacgagctgcacttcatggacgagctggtgaaggtggaggcccacgacgccgaggtgctgtgcctggagtacagcaagcccgagaccggcctgaccctgctggccagcgccagcagagacagactgatccacgtgctgaacgtggagaagaactacaacctggagcagaccctggacgaccacagcagcagcatcaccgccatcaagttcgccggcaacagagacatccagatgatcagctgcggcgccgacaagagcatctacttcagaagcgcccagcagggcagcgacggcctgcacttcgtgagaacccaccacgtggccgagaagaccaccctgtacgacatggacatcgacatcacccagaagtacgtggccgtggcctgccaggacagaaacgtgagagtgtacaacaccgtgaacggcaagcagaagaagtgctacaagggcagccagggcgacgagggcagcctgctgaaggtgcacgtggaccccagcggcaccttcctggccaccagctgcagcgacaagagcatcagcgtgatcgacttctacagcggcgagtgcatcgccaagatgttcggccacagcgagatcatcaccagcatgaagttcacctacgactgccaccacctgatcaccgtgagcggcgacagctgcgtgttcatctggcacctgggccccgagatcaccaactgcatgaagcagcacctgctggagatcgaccacagacagcagcagcagcacaccaacgacaagaagagaagcggccaccccagacaggacacctacgtgagcacccccagcgagatccacagcctgagccccggcgagcagaccgaggacgacctggaggaggagtgcgagcccgaggagatgctgaagacccccagcaaggacagcctggaccccgaccccagatgcctgctgaccaacggcaagctgcccctgtgggccaagagactgctgggcgacgacgacgtggccgacggcctggccttccacgccaagagaagctaccagccccacggcagatgggccgagagagccggccaggagcccctgaagaccatcctggacgcccaggacctggactgctacttcacccccatgaagcccgagagcctggagaacagcatcctggacagcctggagccccagagcctggccagcctgctgagcgagagcgagagcccccaggaggccggcagaggccaccccagcttcctgccccagcagaaggagagcagcgaggccagcgagctgatcctgtacagcctggaggccgaggtgaccgtgaccggcaccgacagccagtactgcagaaaggaggtggaggccggccccggcgaccagcagggcgacagctacctgagagtgagcagcgacagccccaaggaccagagcccccccgaggacagcggcgagagcgaggccgacctggagtgcagcttcgccgccatccacagccccgcccccccccccgaccccgcccccagattcgccaccagcctgccccacttccccggctgcgccggccccaccgaggacgagctgagcctgcccgagggccccagcgtgcccagcagcagcctgccccagacccccgagcaggagaagttcctgagacaccacttcgagaccctgaccgagagcccctgcagagagctgttccccgccgccctgggcgacgtggaggccagcgaggccgaggaccacttcttcaaccccagactgagcatcagcacccagttcctgagcagcctgcagaaggccagcagattcacccacaccttcccccccagagccacccagtgcctggtgaagagccccgaggtgaagctgatggacagaggcggcagccagcccagagccggcaccggctacgccagccccgacagaacccacgtgctggccgccggcaaggccgaggagaccctggaggcctggagacccccccccccctgcctgaccagcctggccagctgcgtgcccgccagcagcgtgctgcccaccgacagaaacctgcccacccccaccagcgcccccacccccggcctggcccagggcgtgcacgcccccagcacctgcagctacatggaggccaccgccagcagcagagccagaatcagcagaagcatcagcctgggcgacagcgagggccccatcgtggccaccctggcccagcccctgagaagacccagcagcgtgggcgagctggccagcctgggccaggagctgcaggccatcaccaccgccaccacccccagcctggacagcgagggccaggagcccgccctgagaagctggggcaaccacgaggccagagccaacctgagactgaccctgagcagcgcctgcgacggcctgctgcagccccccgtggacacccagcccggcgtgaccgtgcccgccgtgagcttccccgcccccagccccgtggaggagagcgccctgagactgcacggcagcgccttcagacccagcctgcccgcccccgagagccccggcctgcccgcccaccccagcaacccccagctgcccgaggccagacccggcatccccggcggcaccgccagcctgctggagcccaccagcggcgccctgggcctgctgcagggcagccccgccagatggagcgagccctgggtgcccgtggaggccctgccccccagccccctggagctgagcagagtgggcaacatcctgcacagactgcagaccaccttccaggaggccctggacctgtacagagtgctggtgagcagcggccaggtggacaccggccagcagcaggccagaaccgagctggtgagcaccttcctgtggatccacagccagctggaggccgagtgcctggtgggcaccagcgtggcccccgcccaggccctgcccagccccggcccccccagcccccccaccctgtaccccctggccagccccgacctgcaggccctgctggagcactacagcgagctgctggtgcaggccgtgagaagaaaggccagaggccactag

SEQ ID NO: 105234 - DNA, 1302 bp, Artificial Sequence
  Description of Artificial Sequence: Synthetic coding sequence
ggcggctacgccagaaacgacgccggcgagaagctgcccagcgtgatggccggcgtgcccgccagaagaggccagagcagccccccccccgccccccccatctgcctgagaagaagaaccagactgagcaccgccagcgaggagaccgtgcagaacagagtgagcctggagaaggtgctgggcatcaccgcccagaacagcagcggcctgacctgcgaccccggcaccggccacgtggcctacctggccggcatgtggagaatgggccccgccagcgagagctgcggcgaggacagcatcgcccccagcctgagcagaaccgtgcccggcatgtactgcgtggtggtgatcctggaccccaaggagaacaagcagcagcacatcttcaacaccgccagaaagagcctgagcgccctggccttcagccccgacggcaagtacatcgtgaccggcgagaacggccacagacccgccgtgagaatctgggacgtggaggagaagaaccaggtggccgagatgctgggccacaagtacggcgtggcctgcgtggccttcagccccaacatgaagcacatcgtgagcatgggctaccagcacgacatggtgctgaacgtgtgggactggaagaaggacatcgtggtggccagcaacaaggtgagctgcagagtgatcgccctgagcttcagcgaggacagcagctacttcgtgaccgtgggcaacagacacgtgagattctggttcctggaggtgagcaccgagaccaaggtgaccagcaccgtgcccctggtgggcagaagcggcatcctgggcgagctgcacaacaacatcttctgcggcgtggcctgcggcagaggcagaatggccggcagcaccttctgcgtgagctacagcggcctgctgtgccagttcaacgagaagagagtgctggagaagtggatcaacctgaaggtgagcctgagcagctgcctgtgcgtgagccaggagctgatcttctgcggctgcaccgacggcatcgtgagaatcttccaggcccacagcctgcactacctggccaacctgcccaagccccactacctgggcgtggacgtggcccagggcctggagcccagcttcctgttccacagaaaggccgaggccgtgtaccccgacaccgtggccctgaccttcgaccccatccaccagtggctgagctgcgtgtacaaggaccacagcatctacatctgggacgtgaaggacatcaacagagtgggcaaggtgtggagcgagctgttccacagcagctacgtgtggaacgtggagtag

SEQ ID NO: 105235 - DNA, 2097 bp, Artificial Sequence
  Description of Artificial Sequence: Synthetic coding sequence
atgagcgccgtggtggcccagaccctgcacgtgttcggcctgagaagccacgtggccaacaacatcttctacttcgacgagcagatcatcatcttccccagcggcaaccactgcgtgaagtacaacgtggaccagaagtggcagaagttcatccccggcagcgagaagagccagggcatgctggccctgagcatcagccccaacagaagatacctggccatcagcgagaccgtgcaggagaagcccgccatcaccatctacgagctgagcagcatcccctgcagaaagagaaaggtgctgaacaacttcgacttccaggtgcagaagttcatcagcatggccttcagccccgacagcaagtacctgctggcccagaccagcccccccgagagcaacctggtgtactggctgtgggagaagcagaaggtgatggccatcgtgagaatcgacacccagaacaaccccgtgtaccaggtgagcttcagcccccaggacaacacccaggtgtgcgtgaccggcaacggcatgttcaagctgctgagattcgccgagggcaccctgaagcagaccagcttccagagaggcgagccccagaactacctggcccacacctgggtggccgacgacaagatcgtggtgggcaccgacaccggcaagctgttcctgttcgagagcggcgaccagagatgggagaccagcatcatggtgaaggagcccaccaacggcagcaagagcctggacgtgatccaggagagcgagagcctgatcgagttcccccccgtgagcagccccctgcccagctacgagcagatggtggccgccagcagccacagccagatgagcatgccccaggtgttcgccatcgccgcctacagcaagggcttcgcctgcagcgccggccccggcagagtgctgctgttcgagaagatggaggagaaggacttctacagagagagcagagagatcagaatccccgtggacccccagagcaacgaccccagccagagcgacaagcaggacgtgctgtgcctgtgcttcagccccagcgaggagaccctggtggccagcaccagcaagaaccagctgtacagcatcaccatgagcctgaccgagatcagcaagggcgagcccgcccacttcgagtacctgatgtaccccctgcacagcgcccccatcaccggcctggccacctgcatcagaaagcccctgatcgccacctgcagcctggacagaagcatcagactgtggaactacgagaccaacaccctggagctgttcaaggagtaccaggaggaggcctacagcatcagcctgcaccccagcggccacttcatcgtggtgggcttcgccgacaagctgagactgatgaacctgctgatcgacgacatcagaagcttcaaggagtacagcgtgagaggctgcggcgagtgcagcttcagcaacggcggccacctgttcgccgccgtgaacggcaacgtgatccacgtgtacaccaccaccagcctggagaacatcagcagcctgaagggccacaccggcaagatcagaagcatcgtgtggaacgccgacgacagcaagctgatcagcggcggcaccgacggcgccgtgtacgagtggaacctgagcaccggcaagagagagaccgagtgcgtgctgaagagctgcagctacaactgcgtgaccgtgagccccgacgccaagatcatcttcgccgtgggcagcgaccacaccctgaaggagatcgccgacagcctgatcctgagagagatcagcgccttcgacgtgacctacaccgccatcgtgatcagccacagcggcagaatgatgttcgtgggcaccagcgtgggcaccatcagagccatgaagtaccccctgcccctgcagaaggagttcaacgagtaccaggcccacgccggccccatcaccaaggtgagcagagccctgagccccggcacccagagccacacctgcctgctgagagccctgttcatccccagcaccagccagtgcctgttcagcctgctgctgctgagctacctgttcatccaccacagcctgaaccaccacctgctgaccatgaacatcctgttcgtgtag

SEQ ID NO: 105236 - DNA, 501 bp, Artificial Sequence
  Description of Artificial Sequence: Synthetic coding sequence
atgagcgccgtggtggcccagaccctgcacgtgttcggcctgagaagccacgtggccaacaacatcttctacttcgacgagcagatcatcatcttccccagcggcaaccactgcgtgaagtacaacgtggaccagaagtggcagaagttcatccccggcagcgagaagagccagggcatgctggccctgagcatcagccccaacagaagatacctggccatcagcgagaccgtgcaggagaagcccgccatcaccatctacgagctgagcagcatcccctgcagaaagagaaaggtgctgaacaacttcgacttccaggtgcagaagttcatcagcatggccttcagccccgacagcaagtacctgctggcccagaccagcccccccgagagcaacctggtgtactggctgtgggagaagcagaaggtgatggccatcgtgagaatcgacacccagaacaaccccgtgtaccaggtgagcttcagcccccaggacaactag

SEQ ID NO: 105237 - DNA, 4473 bp, Artificial Sequence
  Description of Artificial Sequence: Synthetic coding sequence
atggccggcaacagcctggtgctgcccatcgtgctgtggggcagaaaggcccccacccactgcatcagcgccgtgctgctgaccgacgacggcgccaccatcgtgaccggctgccacgacggccagatctgcctgtgggacctgagcgtggagctgcagatcaaccccagagccctgctgttcggccacaccgccagcatcacctgcctgagcaaggcctgcgccagcagcgacaagcagtacatcgtgagcgccagcgagagcggcgagatgtgcctgtgggacgtgagcgacggcagatgcatcgagttcaccaagctggcctgcacccacaccggcatccagttctaccagttcagcgtgggcaaccagagagagggcagactgctgtgccacggccactaccccgagatcctggtggtggacgccaccagcctggaggtgctgtacagcctggtgagcaagatcagccccgactggatcagcagcatgagcatcatcagaagccacagaacccaggaggacaccgtggtggccctgagcgtgaccggcatcctgaaggtgtggatcgtgaccagcgagatcagcgacatgcaggacaccgagcccatcttcgaggaggagagcaagcccatctactgccagaactgccagagcatcagcttctgcgccttcacccagagaagcctgctggtggtgtgcagcaagtactggagagtgttcgacgccggcgactacagcctgctgtgcagcggccccagcgagaacggccagacctggaccggcggcgacttcgtgagcagcgacaaggtgatcatctggaccgagaacggccagagctacatctacaagctgcccgccagctgcctgcccgccagcgacagcttcagaagcgacgtgggcaaggccgtggagaacctgatcccccccgtgcagcacatcctgctggacagaaaggacaaggagctgctgatctgcccccccgtgaccagattcttctacggctgcagagagtacttccacaagctgctgatccagggcgacagcagcggcagactgaacatctggaacatcagcgacaccgccgacaagcagggcagcgaggagggcctggccatgaccaccagcatcagcctgcaggaggccttcgacaagctgaacccctgccccgccggcatcatcgaccagctgagcgtgatccccaacagcaacgagcccctgaaggtgaccgccagcgtgtacatccccgcccacggcagactggtgtgcggcagagaggacggcagcatcgtgatcgtgcccgccacccagaccgccatcgtgcagctgctgcagggcgagcacatgctgagaagaggctggcccccccacagaaccctgagaggccacagaaacaaggtgacctgcctgctgtacccccaccaggtgagcgccagatacgaccagagatacctgatcagcggcggcgtggacttcagcgtgatcatctgggacatcttcagcggcgagatgaagcacatcttctgcgtgcacggcggcgagatcacccagctgctggtgccccccgagaactgcagcgccagagtgcagcactgcatctgcagcgtggccagcgaccacagcgtgggcctgctgagcctgagagagaagaagtgcatcatgctggccagcagacacctgttccccatccaggtgatcaagtggagacccagcgacgactacctggtggtgggctgcagcgacggcagcgtgtacgtgtggcagatggacaccggcgccctggacagatgcgtgatgggcatcaccgccgtggagatcctgaacgcctgcgacgaggccgtgcccgccgccgtggacagcctgagccaccccgccgtgaacctgaagcaggccatgaccagaagaagcctggccgccctgaagaacatggcccaccacaagctgcagaccctggccaccaacctgctggccagcgaggccagcgacaagggcaacctgcccaagtacagccacaacagcctgatggtgcaggccatcaagaccaacctgaccgaccccgacatccacgtgctgttcttcgacgtggaggccctgatcatccagctgctgaccgaggaggccagcagacccaacaccgccctgatcagccccgagaacctgcagaaggccagcggcagcagcgacaagggcggcagcttcctgaccggcaagagagccgccgtgctgttccagcaggtgaaggagaccatcaaggagaacatcaaggagcacctgctggacgacgaggaggaggacgaggagatcatgagacagagaagagaggagagcgaccccgagtacagaagcagcaagagcaagcccctgaccctgctggagtacaacctgaccatggacaccgccaagctgttcatgagctgcctgcacgcctggggcctgaacgaggtgctggacgaggtgtgcctggacagactgggcatgctgaagccccactgcaccgtgagcttcggcctgctgagcagaggcggccacatgagcctgatgctgcccggctacaaccagcccgcctgcaagctgagccacggcaagaccgaggtgggcagaaagctgcccgccagcgagggcgtgggcaagggcacctacggcgtgagcagagccgtgaccacccagcacctgctgagcatcatcagcctggccaacaccctgatgagcatgaccaacgccaccttcatcggcgaccacatgaagaagggccccaccagaccccccagacccagcacccccgacctgagcaaggccagaggcagcccccccaccagcagcaacatcgtgcagggccagatcaagcaggtggccgcccccgtggtgagcgccagaagcgacgccgaccacagcggcagcgacccccccagcgcccccgccctgcacacctgcttcctggtgaacgagggctggagccagctggccgccatgcactgcgtgatgctgcccgacctgctgggcctggacaagttcagaccccccctgctggagatgctggccagaagatggcaggacagatgcctggaggtgagagaggccgcccaggccctgctgctggccgagctgagaagaatcgagcaggccggcagaaaggaggccatcgacgcctgggccccctacctgccccagtacatcgaccacgtgatcagccccggcgtgaccagcgaggccgcccagaccatcaccaccgcccccgacgccagcggccccgaggccaaggtgcaggaggaggagcacgacctggtggacgacgacatcaccaccggctgcctgagcagcgtgccccagatgaagaagatcagcaccagctacgaggagagaagaaagcaggccaccgccatcgtgctgctgggcgtgatcggcgccgagttcggcgccgagatcgagccccccaagctgctgaccagacccagaagcagcagccagatccccgagggcttcggcctgaccagcggcggcagcaactacagcctggccagacacacctgcaaggccctgaccttcctgctgctgcagccccccagccccaagctgcccccccacagcaccatcagaagaaccgccatcgacctgatcggcagaggcttcaccgtgtgggagccctacatggacgtgagcgccgtgctgatgggcctgctggagctgtgcgccgacgccgagaagcagctggccaacatcaccatgggcctgcccctgagccccgccgccgacagcgccagaagcgccagacacgccctgagcctgatcgccaccgccagaccccccgccttcatcaccaccatcgccaaggaggtgcacagacacaccgccctggccgccaacacccagagccagcagaacatgcacaccaccaccctggccagagccaagggcgagatcctgagagtgatcgagatcctgatcgagaagatgcccaccgacgtggtggacctgctggtggaggtgatggacatcatcatgtactgcctggagggcagcctggtgaagaagaagggcctgcaggagtgcttccccgccatctgcagattctacatggtgagctactacgagagaaaccacagaatcgccgtgggcgccagacacggcagcgtggccctgtacgacatcagaaccggcaagtgccagaccatccacggccacaagggccccatcaccgccgtggccttcgcccccgacggcagatacctggccacctacagcaacaccgacagccacatcagcttctggcagatgaacaccagcctgctgggcagcatcggcatgctgaacagcgccccccagctgagatgcatcaagacctaccaggtgccccccgtgcagcccgccagccccggcagccacaacgccctgaagctggccagactgatctggaccagcaacagaaacgtgatcctgatggcccacgacggcaaggagcacagattcatggtgtag

SEQ ID NO: 105238 - DNA, 4374 bp, Artificial Sequence
  Description of Artificial Sequence: Synthetic coding sequence
atggccggcaacagcctggtgctgcccatcgtgctgtggggcagaaaggcccccacccactgcatcagcgccgtgctgctgaccgacgacggcgccaccatcgtgaccggctgccacgacggccagatctgcctgtgggacctgagcgtggagctgcagatcaaccccagagccctgctgttcggccacaccgccagcatcacctgcctgagcaaggcctgcgccagcagcgacaagcagtacatcgtgagcgccagcgagagcggcgagatgtgcctgtgggacgtgagcgacggcagatgcatcgagttcaccaagctggcctgcacccacaccggcatccagttctaccagttcagcgtgggcaaccagagagagggcagactgctgtgccacggccactaccccgagatcctggtggtggacgccaccagcctggaggtgctgtacagcctggtgagcaagatcagccccgactggatcagcagcatgagcatcatcagaagccacagaacccaggaggacaccgtggtggccctgagcgtgaccggcatcctgaaggtgtggatcgtgaccagcgagatcagcgacatgcaggacaccgagcccatcttcgaggaggagagcaagcccatctactgccagaactgccagagcatcagcttctgcgccttcacccagagaagcctgctggtggtgtgcagcaagtactggagagtgttcgacgccggcgactacagcctgctgtgcagcggccccagcgagaacggccagacctggaccggcggcgacttcgtgagcagcgacaaggtgatcatctggaccgagaacggccagagctacatctacaagctgcccgccagctgcctgcccgccagcgacagcttcagaagcgacgtgggcaaggccgtggagaacctgatcccccccgtgcagcacatcctgctggacagaaaggacaaggagctgctgatctgcccccccgtgaccagattcttctacggctgcagagagtacttccacaagctgctgatccagggcgacagcagcggcagactgaacatctggaacatcagcgacaccgccgacaagcagggcagcgaggagggcctggccatgaccaccagcatcagcctgcaggaggccttcgacaagctgaacccctgccccgccggcatcatcgaccagctgagcgtgatccccaacagcaacgagcccctgaaggtgaccgccagcgtgtacatccccgcccacggcagactggtgtgcggcagagaggacggcagcatcgtgatcgtgcccgccacccagaccgccatcgtgcagctgctgcagggcgagcacatgctgagaagaggctggcccccccacagaaccctgagaggccacagaaacaaggtgacctgcctgctgtacccccaccaggtgagcgccagatacgaccagagatacctgatcagcggcggcgtggacttcagcgtgatcatctgggacatcttcagcggcgagatgaagcacatcttctgcgtgcacggcggcgagatcacccagctgctggtgccccccgagaactgcagcgccagagtgcagcactgcatctgcagcgtggccagcgaccacagcgtgggcctgctgagcctgagagagaagaagtgcatcatgctggccagcagacacctgttccccatccaggtgatcaagtggagacccagcgacgactacctggtggtgggctgcagcgacggcagcgtgtacgtgtggcagatggacaccggcgccctggacagatgcgtgatgggcatcaccgccgtggagatcctgaacgcctgcgacgaggccgtgcccgccgccgtggacagcctgagccaccccgccgtgaacctgaagcaggccatgaccagaagaagcctggccgccctgaagaacatggcccaccacaagctgcagaccctggccaccaacctgctggccagcgaggccagcgacaagggcaacctgcccaagtacagccacaacagcctgatggtgcaggccatcaagaccaacctgaccgaccccgacatccacgtgctgttcttcgacgtggaggccctgatcatccagctgctgaccgaggaggccagcagacccaacaccgccctgatcagccccgagaacctgcagaaggccagcggcagcagcgacaagggcggcagcttcctgaccggcaagagagccgccgtgctgttccagcaggtgaaggagaccatcaaggagaacatcaaggagcacctgctggacgacgaggaggaggacgaggagatcatgagacagagaagagaggagagcgaccccgagtacagaagcagcaagagcaagcccctgaccctgctggagtacaacctgaccatggacaccgccaagctgttcatgagctgcctgcacgcctggggcctgaacgaggtgctggacgaggtgtgcctggacagactgggcatgctgaagccccactgcaccgtgagcttcggcctgctgagcagaggcggccacatgagcctgatgctgcccggctacaaccagcccgcctgcaagctgagccacggcaagaccgaggtgggcagaaagctgcccgccagcgagggcgtgggcaagggcacctacggcgtgagcagagccgtgaccacccagcacctgctgagcatcatcagcctggccaacaccctgatgagcatgaccaacgccaccttcatcggcgaccacatgaagaagggccccaccagaccccccagacccagcacccccgacctgagcaaggccagaggcagcccccccaccagcagcaacatcgtgcagggccagatcaagcagggctggagccagctggccgccatgcactgcgtgatgctgcccgacctgctgggcctggacaagttcagaccccccctgctggagatgctggccagaagatggcaggacagatgcctggaggtgagagaggccgcccaggccctgctgctggccgagctgagaagaatcgagcaggccggcagaaaggaggccatcgacgcctgggccccctacctgccccagtacatcgaccacgtgatcagccccggcgtgaccagcgaggccgcccagaccatcaccaccgcccccgacgccagcggccccgaggccaaggtgcaggaggaggagcacgacctggtggacgacgacatcaccaccggctgcctgagcagcgtgccccagatgaagaagatcagcaccagctacgaggagagaagaaagcaggccaccgccatcgtgctgctgggcgtgatcggcgccgagttcggcgccgagatcgagccccccaagctgctgaccagacccagaagcagcagccagatccccgagggcttcggcctgaccagcggcggcagcaactacagcctggccagacacacctgcaaggccctgaccttcctgctgctgcagccccccagccccaagctgcccccccacagcaccatcagaagaaccgccatcgacctgatcggcagaggcttcaccgtgtgggagccctacatggacgtgagcgccgtgctgatgggcctgctggagctgtgcgccgacgccgagaagcagctggccaacatcaccatgggcctgcccctgagccccgccgccgacagcgccagaagcgccagacacgccctgagcctgatcgccaccgccagaccccccgccttcatcaccaccatcgccaaggaggtgcacagacacaccgccctggccgccaacacccagagccagcagaacatgcacaccaccaccctggccagagccaagggcgagatcctgagagtgatcgagatcctgatcgagaagatgcccaccgacgtggtggacctgctggtggaggtgatggacatcatcatgtactgcctggagggcagcctggtgaagaagaagggcctgcaggagtgcttccccgccatctgcagattctacatggtgagctactacgagagaaaccacagaatcgccgtgggcgccagacacggcagcgtggccctgtacgacatcagaaccggcaagtgccagaccatccacggccacaagggccccatcaccgccgtggccttcgcccccgacggcagatacctggccacctacagcaacaccgacagccacatcagcttctggcagatgaacaccagcctgctgggcagcatcggcatgctgaacagcgccccccagctgagatgcatcaagacctaccaggtgccccccgtgcagcccgccagccccggcagccacaacgccctgaagctggccagactgatctggaccagcaacagaaacgtgatcctgatggcccacgacggcaaggagcacagattcatggtgtag

SEQ ID NO: 105239 - DNA, 4374 bp, Artificial Sequence; identical to SEQ ID NO: 105238
  Description of Artificial Sequence: Synthetic coding sequence

SEQ ID NO: 105240 - DNA, 2448 bp, Artificial Sequence
  Description of Artificial Sequence: Synthetic coding sequence
atggccggcaacagcctggtgctgcccatcgtgctgtggggcagaaaggcccccacccactgcatcagcgccgtgctgctgaccgacgacggcgccaccatcgtgaccggctgccacgacggccagatctgcctgtgggacctgagcgtggagctgcagatcaaccccagagccctgctgttcggccacaccgccgtgctgttccagcaggtgaaggagaccatcaaggagaacatcaaggagcacctgctggacgacgaggaggaggacgaggagatcatgagacagagaagagaggagagcgaccccgagtacagaagcagcaagagcaagcccctgaccctgctggagtacaacctgaccatggacaccgccaagctgttcatgagctgcctgcacgcctggggcctgaacgaggtgctggacgaggtgtgcctggacagactgggcatgctgaagccccactgcaccgtgagcttcggcctgctgagcagaggcggccacatgagcctgatgctgcccggctacaaccagcccgcctgcaagctgagccacggcaagaccgaggtgggcagaaagctgcccgccagcgagggcgtgggcaagggcacctacggcgtgagcagagccgtgaccacccagcacctgctgagcatcatcagcctggccaacaccctgatgagcatgaccaacgccaccttcatcggcgaccacatgaagaagggccccaccagaccccccagacccagcacccccgacctgagcaaggccagaggcagcccccccaccagcagcaacatcgtgcagggccagatcaagcaggtggccgcccccgtggtgagcgccagaagcgacgccgaccacagcggcagcgacccccccagcgcccccgccctgcacacctgcttcctggtgaacgagggctggagccagctggccgccatgcactgcgtgatgctgcccgacctgctgggcctggacaagttcagaccccccctgctggagatgctggccagaagatggcaggacagatgcctggaggtgagagaggccgcccaggccctgctgctggccgagctgagaagaatcgagcaggccggcagaaaggaggccatcgacgcctgggccccctacctgccccagtacatcgaccacgtgatcagccccggcgtgaccagcgaggccgcccagaccatcaccaccgcccccgacgccagcggccccgaggccaaggtgcaggaggaggagcacgacctggtggacgacgacatcaccaccggctgcctgagcagcgtgccccagatgaagaagatcagcaccagctacgaggagagaagaaagcaggccaccgccatcgtgctgctgggcgtgatcggcgccgagttcggcgccgagatcgagccccccaagctgctgaccagacccagaagcagcagccagatccccgagggcttcggcctgaccagcggcggcagcaactacagcctggccagacacacctgcaaggccctgaccttcctgctgctgcagccccccagccccaagctgcccccccacagcaccatcagaagaaccgccatcgacctgatcggcagaggcttcaccgtgtgggagccctacatggacgtgagcgccgtgctgatgggcctgctggagctgtgcgccgacgccgagaagcagctggccaacatcaccatgggcctgcccctgagccccgccgccgacagcgccagaagcgccagacacgccctgagcctgatcgccaccgccagaccccccgccttcatcaccaccatcgccaaggaggtgcacagacacaccgccctggccgccaacacccagagccagcagaacatgcacaccaccaccctggccagagccaagggcgagatcctgagagtgatcgagatcctgatcgagaagatgcccaccgacgtggtggacctgctggtggaggtgatggacatcatcatgtactgcctggagggcagcctggtgaagaagaagggcctgcaggagtgcttccccgccatctgcagattctacatggtgagctactacgagagaaaccacagaatcgccgtgggcgccagacacggcagcgtggccctgtacgacatcagaaccggcaagtgccagaccatccacggccacaagggccccatcaccgccgtggccttcgcccccgacggcagatacctggccacctacagcaacaccgacagccacatcagcttctggcagatgaacaccagcctgctgggcagcatcggcatgctgaacagcgccccccagctgagatgcatcaagacctaccaggtgccccccgtgcagcccgccagccccggcagccacaacgccctgaagctggccagactgatctggaccagcaacagaaacgtgatcctgatggcccacgacggcaaggagcacagattcatggtgtag

SEQ ID NO: 105241 - DNA, 3309 bp, Artificial Sequence
  Description of Artificial Sequence: Synthetic coding sequence
atgagaaccagcctgcaggccgtggccctgtggggccagaaggcccccccccacagcatcaccgccatcatgatcaccgacgaccagagaaccatcgtgaccggcagccaggagggccagctgtgcctgtggaacctgagccacgagctgaagatcagcgccaaggagctgctgttcggccacagcgccagcgtgacctgcctggccagagccagagacttcagcaagcagccctacatcgtgagcgccgccgagaacggcgagatgtgcgtgtggaacgtgaccaacggccagtgcatggagaaggccaccctgccctacagacacaccgccatctgctactaccactgcagcttcagaatgaccggcgagggctggctgctgtgctgcggcgagtaccaggacgtgctgatcatcgacgccaagaccctggccgtggtgcacagcttcagaagcagccagttccccgactggatcaactgcatgtgcatcgtgcacagcatgagaatccaggaggacagcctgctggtggtgagcgtggccggcgagctgaaggtgtgggacctgagcagcagcatcaacagcatccaggagaagcaggacgtgtacgagaaggagagcaagttcctggagagcctgaactgccagaccatcagattctgcacctacaccgagagactgctgctggtggtgttcagcaagtgctggaaggtgtacgactactgcgacttcagcctgctgctgaccgaggtgagcagaaacggccagttcttcgccggcggcgaggtgatcgccgcccacagaatcctgatctggaccgaggacggccacagctacatctaccagctgctgaacagcggcctgagcaagagcatctaccccgccgacggcagagtgctgaaggagaccatctacccccacctgctgtgcagcaccagcgtgcaggagaacaaggagcagagcagacccttcgtgatgggctacatgaacgagagaaaggagcccttctacaaggtgctgttcagcggcgaggtgagcggcagaatcaccctgtggcacatccccgacgtgcccgtgagcaagttcgacggcagccccagagagatccccgtgaccgccacctggaccctgcaggacaacttcgacaagcacgacaccatgagccagagcatcatcgactacttcagcggcctgaaggacggcgccggcaccgccgtggtgaccagcagcgagtacatccccagcctggacaagctgatctgcggctgcgaggacggcaccatcatcatcacccaggccctgaacgccgccaaggccagactgctggagggcggcagcctggtgaaggacagccccccccacaaggtgctgaagggccaccaccagagcgtgaccagcctgctgtacccccacggcctgagcagcaagctggaccagagctggatgctgagcggcgacctggacagctgcgtgatcctgtgggacatcttcaccgaggagatcctgcacaagttcttcctggaggccggccccgtgaccagcctgctgatgagccccgagaagttcaagctgagaggcgagcagatcatctgctgcgtgtgcggcgaccacagcgtggccctgctgcacctggagggcaagagctgcctgctgcacgccagaaagcacctgttccccgtgagaatgatcaagtggcaccccgtggagaacttcctgatcgtgggctgcgccgacgacagcgtgtacatctgggagatcgagaccggcaccctggagagacacgagaccggcgagagagccagaatcatcctgaactgctgcgacgacagccagctggtgaagagcgtgctgcccatcgccagcgagaccctgaagcacaagagcatcgagcagagaagcagcagcccctaccagctgggccccctgccctgccccggcctgcaggtggagagcagctgcaaggtgaccgacgccaagttctgccccagacccttcaacgtgctgcccgtgaagaccaagtggagcaacgtgggcttccacatcctgctgttcgacctggagaacctggtggagctgctgctgcccacccccctgagcgacgtggacagcagcagcagcttctacggcggcgaggtgctgagaagagccaagagcaccgtggagaagaagaccctgaccctgagaaagagcaagaccgcctgcggccccctgagcgccgaggccctggccaagcccatcaccgagagcctggcccagggcgacaacaccatcaagttcagcgaggagaacgacggcatcaagagacagaagaagatgaagatcagcaagaagatgcagcccaagcccagcagaaaggtggacgccagcctgaccatcgacaccgccaagctgttcctgagctgcctgctgccctggggcgtggacaaggacctggactacctgtgcatcaagcacctgaacatcctgaagctgcagggccccatcagcctgggcatcagcctgaacgaggacaacttcagcctgatgctgcccggctgggacctgtgcaacagcggcatgatcaaggactacagcggcgtgaacctgttcagcagaaaggtgctggacctgagcgacaagtacaccgccaccctgcccaaccaggtgggcatccccagaggcctggagaacaactgcgacagcctgagagagagcgacaccatcgtgtacctgctgagcagactgttcctggtgaacaagctggtgaacatgcccctggagctggcctgcagagtgggcagcagcttcagaatggagagcatccacaacaagatgagaggcgccggcaacgacatcctgaacatgagcagcttctacagctgcctgagaaacggcaagaacgagagccacgtgcccgaggccgacctgagcctgctgaagctgatcagctgctggagagaccagagcgtgcaggtgaccgaggccatccaggccgtgctgctggccgaggtgcagcagcacatgaagagcctgggcaagatccccgtgaacagccagcccgtgagcatggccgagaacggcaactgcgagatgaagcagatgctgcccaagctggagtggaccgaggagctggagctgcagtgcgtgagaaacaccctgcccctgcagacccccgtgagccccgtgaagcacgacagcaacagcaacagcgccaacttccaggacgtggaggacatgcccgacagatgcgccctggaggagagcgagagccccggcgagcccagacaccacagctggatcgccaaggtgtgcccctgcaaggtgagctag

SEQ ID NO: 105242 - DNA, 3309 bp, Artificial Sequence; identical to SEQ ID NO: 105241
  Description of Artificial Sequence: Synthetic coding sequence

SEQ ID NO: 105243 - DNA, 3300 bp, Artificial Sequence
  Description of Artificial Sequence: Synthetic coding sequence
atgagaaccagcctgcaggccgtggccctgtggggccagaaggcccccccccacagcatcaccgccatcatgatcaccgacgaccagagaaccatcgtgaccggcagccaggagggccagctgtgcctgtggaacctgagccacgagctgaagatcagcgccaaggagctgctgttcggccacagcgccagcgtgacctgcctggccagagccagagacttcagcaagcagccctacatcgtgagcgccgccgagaacggcgagatgtgcgtgtggaacgtgaccaacggccagtgcatggagaaggccaccctgccctacagacacaccgccatctgctactaccactgcagcttcagaatgaccggcgagggctggctgctgtgctgcggcgagtaccaggacgtgctgatcatcgacgccaagaccctggccgtggtgcacagcttcagaagcagccagttccccgactggatcaactgcatgtgcatcgtgcacagcatgagaatccaggacagcctgctggtggtgagcgtggccggcgagctgaaggtgtgggacctgagcagcagcatcaacagcatccaggagaagcaggacgtgtacgagaaggagagcaagttcctggagagcctgaactgccagaccatcagattctgcacctacaccgagagactgctgctggtggtgttcagcaagtgctggaaggtgtacgactactgcgacttcagcctgctgctgaccgaggtgagcagaaacggccagttcttcgccggcggcgaggtgatcgccgcccacagaatcctgatctggaccgaggacggccacagctacatctaccagctgctgaacagcggcctgagcaagagcatctaccccgccgacggcagagtgctgaaggagaccatctacccccacctgctgtgcagcaccagcgtgcaggagaacaagagcagacccttcgtgatgggctacatgaacgagagaaaggagcccttctacaaggtgctgttcagcggcgaggtgagcggcagaatcaccctgtggcacatccccgacgtgcccgtgagcaagttcgacggcagccccagagagatccccgtgaccgccacctggaccctgcaggacaacttcgacaagcacgacaccatgagccagagcatcatcgactacttcagcggcctgaaggacggcgccggcaccgccgtggtgaccagcagcgagtacatccccagcctggacaagctgatctgcggctgcgaggacggcaccatcatcatcacccaggccctgaacgccgccaaggccagactgctggagggcggcagcctggtgaaggacagccccccccacaaggtgctgaagggccaccaccagagcgtgaccagcctgctgtacccccacggcctgagcagcaagctggaccagagctggatgctgagcggcgacctggacagctgcgtgatcctgtgggacatcttcaccgaggagatcctgcacaagttcttcctggaggccggccccgtgaccagcctgctgatgagccccgagaagttcaagctgagaggcgagcagatcatctgctgcgtgtgcggcgaccacagcgtggccctgctgcacctggagggcaagagctgcctgctgcacgccagaaagcacctgttccccgtgagaatgatcaagtggcaccccgtggagaacttcctgatcgtgggctgcgccgacgacagcgtgtacatctgggagatcgagaccggcaccctggagagacacgagaccggcgagagagccagaatcatcctgaactgctgcgacgacagccagctggtgaagagcgtgctgcccatcgccagcgagaccctgaagcacaagagcatcgagcagagaagcagcagcccctaccagctgggccccctgccctgccccggcctgcaggtggagagcagctgcaaggtgaccgacgccaagttctgccccagacccttcaacgtgctgcccgtgaagaccaagtggagcaacgtgggcttccacatcctgctgttcgacctggagaacctggtggagctgctgctgcccacccccctgagcgacgtggacagcagcagcagcttctacggcggcgaggtgctgagaagagccaagagcaccgtggagaagaagaccctgaccctgagaaagagcaagaccgcctgcggccccctgagcgccgaggccctggccaagcccatcaccgagagcctggcccagggcgacaacaccatcaagttcagcgaggagaacgacggcatcaagagacagaagaagatgaagatcagcaagaagatgcagcccaagcccagcagaaaggtggacgccagcctgaccatcgacaccgccaagctgttcctgagctgcctgctgccctggggcgtggacaaggacctggactacctgtgcatcaagcacctgaacatcctgaagctgcagggccccatcagcctgggcatcagcctgaacgaggacaacttcagcctgatgctgcccggctgggacctgtgcaacagcggcatgatcaaggactacagcggcgtgaacctgttcagcagaaaggtgctggacctgagcgacaagtacaccgccaccctgcccaaccaggtgggcatccccagaggcctggagaacaactgcgacagcctgagagagagcgacaccatcgtgtacctgctgagcagactgttcctggtgaacaagctggtgaacatgcccctggagctggcctgcagagtgggcagcagcttcagaatggagagcatccacaacaagatgagaggcgccggcaacgacatcctgaacatgagcagcttctacagctgcctgagaaacggcaagaacgagagccacgtgcccgaggccgacctgagcctgctgaagctgatcagctgctggagagaccagagcgtgcaggtgaccgaggccatccaggccgtgctgctggccgaggtgcagcagcacatgaagagcctgggcaagatccccgtgaacagccagcccgtgagcatggccgagaacggcaactgcgagatgaagcagatgctgcccaagctggagtggaccgaggagctggagctgcagtgcgtgagaaacaccctgcccctgcagacccccgtgagccccgtgaagcacgacagcaacagcaacagcgccaacttccaggacgtggaggacatgcccgacagatgcgccctggaggagagcgagagccccggcgagcccagacaccacagctggatcgccaaggtgtgcccctgcaaggtgagctag

SEQ ID NO: 105244 - DNA, 2328 bp, Artificial Sequence
  Description of Artificial Sequence: Synthetic coding sequence
atgagaaccagcctgcaggccgtggccctgtggggccagaaggcccccccccacagcatcaccgccatcatgatcaccgacgaccagagaaccatcgtgaccggcagccaggagggccagctgtgcctgtggaacctgagccacgagctgaagatcagcgccaaggagctgctgttcggccacagcgccagcgtgacctgcctggccagagccagagacttcagcaagcagccctacatcgtgagcgccgccgagaacggcgagatgtgcgtgtggaacgtgaccaacggccagtgcatggagaaggccaccctgccctacagacacaccgccatctgctactaccactgcagcttcagaatgaccggcgagggctggctgctgtgctgcggcgagtaccaggacgtgctgatcatcgacgccaagaccctggccgtggtgcacagcttcagaagcagccagttccccgactggatcaactgcatgtgcatcgtgcacagcatgagaatccaggaggacagcctgctggtggtgagcgtggccggcgagctgaaggtgtgggacctgagcagcagcatcaacagcatccaggagaagcaggacgtgtacgagaaggagagcaagttcctggagagcctgaactgccagaccatcagattctgcacctacaccgagagactgctgctggtggtgttcagcaagtgctggaaggtgtacgactactgcgacttcagcctgctgctgaccgaggtgagcagaaacggccagttcttcgccggcggcgaggtgatcgccgcccacagaatcctgatctggaccgaggacggccacagctacatctaccagctgctgaacagcggcctgagcaagagcatctaccccgccgacggcagagtgctgaaggagaccatctacccccacctgctgtgcagcaccagcgtgcaggagaacaaggagcagagcagacccttcgtgatgggctacatgaacgagagaaaggagcccttctacaaggtgctgttcagcggcgaggtgagcggcagaatcaccctgtggcacatccccgacgtgcccgtgagcaagttcgacggcagccccagagagatccccgtgaccgccacctggaccctgcaggacaacttcgacaagcacgacaccatgagccagagcatcatcgactacttcagcggcctgaaggacggcgccggcaccgccgtggtgaccagcagcgagtacatccccagcctggacaagctgatctgcggctgcgaggacggcaccatcatcatcacccaggccctgaacgccgccaaggccagactgctggagggcggcagcctggtgaaggacagccccccccacaaggtgctgaagggccaccaccagagcgtgaccagcctgctgtacccccacggcctgagcagcaagctggaccagagctggatgctgagcggcgacctggacagctgcgtgatcctgtgggacatcttcaccgaggagatcctgcacaagttcttcctggaggccggccccgtgaccagcctgctgatgagccccgagaagttcaagctgagaggcgagcagatcatctgctgcgtgtgcggcgaccacagcgtggccctgctgcacctggagggcaagagctgcctgctgcacgccagaaagcacctgttccccgtgagaatgatcaagtggcaccccgtggagaacttcctgatcgtgggctgcgccgacgacagcgtgtacatctgggagatcgagaccggcaccctggagagacacgagaccggcgagagagccagaatcatcctgaactgctgcgacgacagccagctggtgaagagcgtgctgcccatcgccagcgagaccctgaagcacaagagcatcgagcagagaagcagcagcccctaccagctgggccccctgccctgccccggcctgcaggtggagagcagctgcaaggtgaccgacgccaagttctgccccagacccttcaacgtgctgcccgtgaagaccaagtggagcaacgtgggcttccacatcctgctgttcgacctggagaacctggtggagctgctgctgcccacccccctgagcgacgtggacagcagcagcagcttctacggcggcgaggtgctgagaagagccaagagcaccgtggagaagaagaccctgaccctgagaaagagcaagaccgcctgcggccccctgagcgccgaggccctggccaagcccatcaccgagagcctggcccagggcgacaacaccatcaagttcagcgaggagaacgacggcatcaagagacagaagaagatgaagatcagctag

SEQ ID NO: 105245 - DNA, 1119 bp, Artificial Sequence
  Description of Artificial Sequence: Synthetic coding sequence
atggagcccgcccccagcgccggcgccgagctgcagccccccctgttcgccaacgccagcgacgcctaccccagcgcctgccccagcgccggcgccaacgccagcggcccccccggcgccagaagcgccagcagcctggccctggccatcgccatcaccgccctgtacagcgccgtgtgcgccgtgggcctgctgggcaacgtgctggtgatgttcggcatcgtgagatacaccaagatgaagaccgccaccaacatctacatcttcaacctggccctggccgacgccctggccaccagcaccctgcccttccagagcgccaagtacctgatggagacctggcccttcggcgagctgctgtgcaaggccgtgctgagcatcgactactacaacatgttcaccagcatcttcaccctgaccatgatgagcgtggacagatacatcgccgtgtgccaccccgtgaaggccctggacttcagaacccccgccaaggccaagctgatcaacatctgcatctgggtgctggccagcggcgtgggcgtgcccatcatggtgatggccgtgaccagacccagagacggcgccgtggtgtgcatgctgcagttccccagccccagctggtactgggacaccgtgaccaagatctgcgtgttcctgttcgccttcgtggtgcccatcctgatcatcaccgtgtgctacggcctgatgctgctgagactgagaagcgtgagactgctgagcggcagcaaggagaaggacagaagcctgagaagaatcaccagaatggtgctggtggtggtgggcgccttcgtggtgtgctgggcccccatccacatcttcgtgatcgtgtggaccctggtggacatcgacagaagagaccccctggtggtggccgccctgcacctgtgcatcgccctgggctacgccaacagcagcctgaaccccgtgctgtacgccttcctggacgagaacttcaagagatgcttcagacagctgtgcagaaagccctgcggcagacccgaccccagcagcttcagcagagccagagaggccaccgccagagagagagtgaccgcctgcacccccagcgacggccccggcggcggcgccgccgcctag

SEQ ID NO: 105246 - DNA, 837 bp, Artificial Sequence
  Description of Artificial Sequence: Synthetic coding sequence
atgagaaaggagacccccccccccctggtgccccccgccgccagagagtggaacctgccccccaacgcccccgcctgcatggagagacagctggaggccgccagatacagaagcgacggcgccctgctgctgggcgccagcagcctgagcggcagatgctgggccggcagcctgtggctgttcaaggacccctgcgccgcccccaacgagggcttctgcagcgccggcgtgcagaccgaggccggcgtggccgacctgacctgggtgggcgagagaggcatcctggtggccagcgacagcgcccacgccgcccaggtgacctgcgtggccgccagcccccacaaggacagcgtgttcctgagctgcagcgaggacaacagaatcctgctgtgggacaccagatgccccaagcccgccagccagatcggctgcagcgcccccggctacctgcccaccagcctggcctggcacccccagcagagcgaggtgttcgtgttcggcgacgagaacggcaccgtgagcctggtggacaccaagagcaccagctgcgtgctgagcagcgccgtgcacagccagtgcgtgaccggcctggtgttcagcccccacagcgtgcccttcctggccagcctgagcgaggactgcagcctggccgtgctggacagcagcctgagcgagctgttcagaagccaggcccacagagacttcgtgagagacgccacctggagccccctgaaccacagcctgctgaccaccgtgggctgggaccaccaggtggtgcaccacgtggtgcccaccgagcccctgcccgcccccggccccgccagcgtgaccgagtag

SEQ ID NO: 105247 - DNA, 876 bp, Artificial Sequence
  Description of Artificial Sequence: Synthetic coding sequence
tgatgcgccgcccccaacgagggcttctgcagcgccggcgtgcagaccgaggccggcgtggccgacctgacctgggtgggcgagagaggcatcctggtggccagcgacagcggcgccgtggagctgtgggagctggacgagaacgagaccctgatcgtgagcaagttctgcaagtacgagcacgacgacatcgtgagcaccgtgagcgtgctgagcagcggcacccaggccgtgagcggcagcaaggacatctgcatcaaggtgtgggacctggcccagcaggtggtgctgagcagctacagagcccacgccgcccaggtgacctgcgtggccgccagcccccacaaggacagcgtgttcctgagctgcagcgaggacaacagaatcctgctgtgggacaccagatgccccaagcccgccagccagatcggctgcagcgcccccggctacctgcccaccagcctggcctggcacccccagcagagcgaggtgttcgtgttcggcgacgagaacggcaccgtgagcctggtggacaccaagagcaccagctgcgtgctgagcagcgccgtgcacagccagtgcgtgaccggcctggtgttcagcccccacagactggacctgagccagcccagcccccccagcgacagcgtgcccttcctggccagcctgagcgaggactgcagcctggccgtgctggacagcagcctgagcgagctgttcagaagccaggcccacagagacttcgtgagagacgccacctggagccccctgaaccacagcctgctgaccaccgtgggctgggaccaccaggtggtgcaccacgtggtgcccaccgagcccctgcccgcccccggccccgccagcgtgaccgagtag

SEQ ID NO: 105248 - DNA, 942 bp, Artificial Sequence
  Description of Artificial Sequence: Synthetic coding sequence
atgaagctgaccgacagcgtgctgagaagcttcagagtggccaaggtgttcagagagaacagcgacaagatcaactgcttcgacttcagccccaacggcgagaccgtgatcagcagcagcgacgacgacagcatcgtgctgtacgactgccaggagggcaagcccaagagaaccctgtacagcaagaagtacggcgtggacctgatcagatacacccacgccgccaacaccgtggtgtacagcagcaacaagatcgacgacaccatcagatacctgagcctgcacgacaacaagtacatcagatacttccccggccacagcaagagagtggtggccctgagcatgagccccgtggacgacaccttcatcagcggcagcctggacaagaccatcagactgtgggacctgagaagccccaactgccagggcctgatgcacctgcagggcaagcccgtgtgcagcttcgaccccgagggcctgatcttcgccgccggcgtgaacagcgagatggtgaagctgtacgacctgagaagcttcgacaagggccccttcgccaccttcaagatgcagtacgacagaacctgcgagtggaccggcctgaagttcagcaacgacggcaagctgatcctgatcagcaccaacggcagcttcatcagactgatcgacgccttcaagggcgtggtgatgcacaccttcggcggctacgccaacagcaaggccgtgaccctggaggccagcttcacccccgacagccagttcatcatgatcggcagcgaggacggcaagatccacgtgtggaacggcgagagcggcatcaaggtggccgtgctggacggcaagcacaccggccccatcacctgcctgcagttcaaccccaagttcatgaccttcgccagcgcctgcagcaacatggccttctggctgcccaccatcgacgactag

SEQ ID NO: 105249 - DNA, 1359 bp, Artificial Sequence
  Description of Artificial Sequence: Synthetic coding sequence
atgatgggctgcttcgccctgcagaccgtggacaccgagctgaccgccgacagcgtggagtggtgccccctgcagggctgcagacacctgctggcctgcggcacctaccagctgagaagacccgaggacagacccgccggcccccagaacaagggcggcatggaggtgaaggagccccaggtgagactgggcagactgttcctgtacagcttcaacgacaacaacagcatccaccccctggtggaggtgcagagaaaggacaccagcgccatcctggacatgaagtggtgccacatccccgtggccggccacgccctgctgggcctggccgacgccagcggcagcatccagctgctgagactggtggagagcgagaagagccacgtgctggagcccctgagcagcctggccctggaggagcagtgcctggccctgagcctggactggagcaccggcaagaccggcagagccggcgaccagcccctgaagatcatcagcagcgacagcaccggccagctgcacctgctgatggtgaacgagaccagacccagactgcagaaggtggccagctggcaggcccaccagttcgaggcctggatcgccgccttcaactactggcaccccgagatcgtgtacagcggcggcgacgacggcctgctgagaggctgggacaccagagtgcccggcaagttcctgttcaccagcaagagacacaccatgggcgtgtgcagcatccagagcagcccccacagagagcacatcctggccaccggcagctacgacgagcacatcctgctgtgggacaccagaaacatgaagcagcccctggccgacacccccgtgcagggcggcgtgtggagaatcaagtggcaccccttccaccaccacctgctgctggccgcctgcatgcacagcggcttcaagatcctgaactgccagaaggccatggaggagagacaggaggccaccgtgctgaccagccacaccctgcccgacagcctggtgtacggcgccgactggagctggctgctgttcagaagcctgcagagagcccccagctggagcttccccagcaacctgggcaccaagaccgccgacctgaagggcgccagcgagctgcccaccccctgccacgagtgcagagaggacaacgacggcgagggccacgccagaccccagagcggcatgaagcccctgaccgagggcatgagaaagaacggcacctggctgcaggccaccgccgccaccaccagagactgcggcgtgaaccccgaggaggccgacagcgccttcagcctgctggccacctgcagcttctacgaccacgccctgcacctgtgggagtgggagggcaactag

SEQ ID NO: 105250 - DNA, 1074 bp, Artificial Sequence
  Description of Artificial Sequence: Synthetic coding sequence
atgagcgccttcgagaagccccagatcatcgcccacatccagaagggcttcaactacaccgtgttcgactgcaagtgggtgccctgcagcgccaagttcgtgaccatgggcaacttcgccagaggcaccggcgtgatccagctgtacgagatccagcacggcgacctgaagctgctgagagagatcgagaaggccaagcccatcaagtgcggcaccttcggcgccaccagcctgcagcagagatacctggccaccggcgacttcggcggcaacctgcacatctggaacctggaggcccccgagatgcccgtgtacagcgtgaagggccacaaggagatcatcaacgccatcgacggcatcggcggcctgggcatcggcgagggcgcccccgagatcgtgaccggcagcagagacggcaccgtgaaggtgtgggaccccagacagaaggacgaccccgtggccaacatggagcccgtgcagggcgagaacaagagagactgctggaccgtggccttcggcaacgcctacaaccaggaggagagagtggtgtgcgccggctacgacaacggcgacatcaagctgttcgacctgagaaacatggccctgagatgggagaccaacatcaagaacggcgtgtgcagcctggagttcgacagaaaggacatcagcatgaacaagctggtggccaccagcctggagggcaagttccacgtgttcgacatgagaacccagcaccccaccaagggcttcgccagcgtgagcgagaaggcccacaagagcaccgtgtggcaggtgagacacctgccccagaacagagagctgttcctgaccgccggcggcgccggcggcctgcacctgtggaagtacgagtaccccatccagagaagcaagaaggacagcgagggcatcgagatgggcgtggccggcagcgtgagcctgctgcagaacgtgaccctgagcacccagcccatcagcagcctggactggagccccgacaagagaggcctgtgcgtgtgcagcagcttcgaccagaccgtgagagtgctgatcgtgaccaagctgaacaagatctag

SEQ ID NO: 105251 - DNA, 867 bp, Artificial Sequence
  Description of Artificial Sequence: Synthetic coding sequence
atgagcgccttcgagaagccccagatcatcgcccacatccagaagggcttcaactacaccgtgttcgactgcaagtgggtgccctgcagcgccaagttcgtgaccatgggcaacttcgccagaggcaccggcgtgatccagctgtacgagatccagcacggcgacctgaagctgctgagagagatcgagaaggccaagcccatcaagtgcggcaccttcggcgccaccagcctgcagcagagatacctggccaccggcgacttcggcggcaacctgcacatctggaacctggaggcccccgagatgcccgtgtacagcgtgaagggccacaaggagatcatcaacgccatcgacggcatcggcggcctgggcatcggcgagggcgcccccgagatcgtgaccggcagcagagacggcaccgtgaaggtgtgggaccccagacagaaggacgaccccgtggccaacatggagcccgtgcagggcgagaacaagagagactgctggaccgtggccttcggcaacgcctacaaccaggaggagagagtggtgtgcgccggctacgacaacggcgacatcaagctgttcgacctgagaaacatggccctgagatgggagaccaacatcaagaacggcgtgtgcagcctggagttcgacagaaaggacatcagcatgaacaagctggtggccaccagcctggagggcaagttccacgtgttcgacatgagaacccagcaccccaccaagggcttcgccagcgtgagcgagaaggcccacaagagcaccgtgtggcaggtgagacacctgccccagaacagagagctgttcctgaccgccggcggcgccggcggcctgcacctgtggaagtag

SEQ ID NO: 105252 - DNA, 3816 bp, Artificial Sequence
  Description of Artificial Sequence: Synthetic coding sequence
tgaagagacttccagagcgaggtgctgctgagcgccatggagctgttccacatgaccagcggcggcgacgccgccatgttcagagacggcaaggagccccagcccagcgccgaggccgccgccgcccccagcctggccaacatcagctgcttcacccagaagctggtggagaagctgtacagcggcatgttcagcgccgaccccagacacatcctgctgttcatcctggagcacatcatggtggtgatcgagaccgccagcagccagagagacaccgtgctgagcaccctgtacagcagcctgaacaaggtgatcctgtactgcctgagcaagccccagcagagcctgagcgagtgcctgggcctgctgagcatcctgggcttcctgcaggagcactgggacgtggtgttcgccacctacaacagcaacatcagcttcctgctgtgcctgatgcactgcctgctgctgctgaacgagagaagctaccccgagggcttcggcctggagcccaagcccagaatgagcacctaccaccaggtgttcctgagccccaacgaggacgtgaaggagaagagagaggacctgcccagcctgagcgacgtgcagcacaacatccagaagaccgtgcagaccctgtggcagcagctggtggcccagagacagcagaccctggaggacgccttcaagatcgacctgagcgtgaagcccggcgagagagaggtgaagatcgaggaggtgacccccctgtgggaggagaccatgctgaaggcctggcagcactacctggccagcgagaagaagagcctggccagcagaagcaacgtggcccaccacagcaaggtgaccctgtggagcggcagcctgagcagcgccatgaagctgatgcccggcagacaggccaaggaccccgagtgcaagaccgaggacttcgtgagctgcatcgagaactacagaagaagaggccaggagctgtacgccagcctgtacaaggaccacgtgcagagaagaaagtgcggcaacatcaaggccgccaacgcctgggccagaatccaggagcagctgttcggcgagctgggcctgtggagccagggcgaggagaccaagccctgcagcccctgggagctggactggagagagggccccgccagaatgagaaagagaatcaagagactgagccccctggaggccctgagcagcggcagacacaaggagagccaggacaagaacgaccacatcagccagaccaacgccgagaaccaggacgagctgaccctgagagaggccgagggcgagcccgacgaggtgggcgtggactgcacccagctgaccttcttccccgccctgcacgagagcctgcacagcgaggacttcctggagctgtgcagagagagacaggtgatcctgcaggagctgctggacaaggagaaggtgacccagaagttcagcctggtgatcgtgcagggccacctggtgagcgagggcgtgctgctgttcggccaccagcacttctacatctgcgagaacttcaccctgagccccaccggcgacgtgtactgcaccagacactgcctgagcaacatcagcgaccccttcatcttcaacctgtgcagcaaggacagaagcaccgaccactacagctgccagtgccacagctacgccgacatgagagagctgagacaggccagattcctgctgcaggacatcgccctggagatcttcttccacaacggctacagcaagttcctggtgttctacaacaacgacagaagcaaggccttcaagagcttctgcagcttccagcccagcctgaagggcaaggccaccagcgaggacaccctgagcctgagaagataccccggcagcgacagaatcatgctgcagaagtggcagaagagagacatcagcaacttcgagtacctgatgtacctgaacaccgccgccggcagaacctgcaacgactacatgcagtaccccgtgttcccctgggtgctggccgactacaccagcgagaccctgaacctggccaaccccaagatcttcagagacctgagcaagcccatgggcgcccagaccaaggagagaaagctgaagttcatccagagattcaaggaggtggagaagaccgagggcgacatgaccgtgcagtgccactactacacccactacagcagcgccatcatcgtggccagctacctggtgagaatgccccccttcacccaggccttctgcgccctgcagggcggcagcttcgacgtggccgacagaatgttccacagcgtgaagagcacctgggagagcgccagcagagagaacatgagcgacgtgagagagctgacccccgagttcttctacctgcccgagttcctgaccaactgcaacggcgtggagttcggctgcatgcaggacggcaccgtgctgggcgacgtgcagctgcccccctgggccgacggcgaccccagaaagttcatcagcctgcacagaaaggccctggagagcgacttcgtgagcgccaacctgcaccactggatcgacctgatcttcggctacaagcagcagggccccgccgccgtggacgccgtgaacatcttccacccctacttctacggcgacagaatggacctgagcagcatcaccgaccccctgatcaagagcaccatcctgggcttcgtgagcaacttcggccaggtgcccaagcagctgttcaccaagccccaccccgccagaaccgccgccggcaagcccctgcccggcaaggacgtgagcacccccgtgagcctgcccggccacccccagcccttcttctacagcctgcagagcctgagacccagccaggtgaccgtgaaggacatgtacctgttcagcctgggcagcgagagccccaagggcgccatcggccacatcgtgagcaccgagaagaccatcctggccgtggagagaaacaaggtgctgctgccccccctgtggaacagaaccttcagctggggcttcgacgacttcagctgctgcctgggcagctacggcagcgacaaggtgctgatgaccttcgagaacctggccgcctggggcagatgcctgtgcgccgtgtgccccagccccaccaccatcgtgaccagcggcaccagcaccgtggtgtgcgtgtgggagctgagcatgaccaagggcagacccagaggcctgagactgagacaggccctgtacggccacacccaggccgtgacctgcctggccgccagcgtgaccttcagcctgctggtgagcggcagccaggactgcacctgcatcctgtgggacctggaccacctgacccacgtgaccagactgcccgcccacagagagggcatcagcgccatcaccatcagcgacgtgagcggcaccatcgtgagctgcgccggcgcccacctgagcctgtggaacgtgaacggccagcccctggccagcatcaccaccgcctggggccccgagggcgccatcacctgctgctgcctgatggagggccccgcctgggacaccagccagatcatcatcaccggcagccaggacggcatggtgagagtgtggaagaccgaggacgtgaagatgagcgtgcccggcagacccgccggcgaggagccccccgcccagccccccagccccagaggccacaagtgggagaagaacctggccctgagcagagagctggacgtgagcatcgccctgaccggcaagcccagcaagaccagccccgccgtgaccgccctggccgtgagcagaaaccacaccaagctgctggtgggcgacgagagaggcagaatcttctgctggagcgccgacggctag

SEQ ID NO: 105253 - DNA, 6804 bp, Artificial Sequence
  Description of Artificial Sequence: Synthetic coding sequence
tgaaagctggccagccaggccatcgagcccgacgtgctgagacagttcctgggcctgggcatccccagcagcctgagcgccaccaccaagatcctggacagcagccacacccacagaggcaaccccggctgcagcggcagccagaccgcccagggcctggccgagggcccctggcccgccgcccccgacgccggcctgcaccccggcgtgacccaggccccccagcccctgggcgagagccaggacagcaccaccgccctgcagaccgccctgagcctgatcagcatgaccagccccagaaacctgcagccccagagagccgccctggcccccagcttcgtggagttcgacatgagcgtggagggctacggctgcctgttcatccccaccctgagcaccgtgatgggcaccagcaccgagtacagcgtgagcggcggcatcggcaccggcgccaccagacccttccccccccccggcggcctgaccttcagctgctggttcctgatcagcagacacggcgccgccaccgagggccaccccctgagattcctgaccctggtgagacacctggccagaaccgagcagcccttcgtgtgcttcagcgtgagcctgtgccccgacgacctgagcctggtggtgagcaccgaggagaaggagttccagcccctggacgtgatggagcccgaggacgacagcgagcccagcgccggctgccagctgcaggtgagatgcggccagctgctggcctgcggccagtggcaccacctggccgtggtggtgaccaaggagatgaagagacactgcaccgtgagcacctgcctggacggccaggtgatcggcagcgccaagatgctgtacatccaggccctgcccggccccttcctgagcatggaccccagcgccttcgtggacgtgtacggctacatcgccacccccagagtgtggaagcagaagagcagcctgatctggagactgggccccacctacctgttcgaggaggccatcagcatggagaccctggaggtgatcaacaagctgggccccagatactgcggcaacttccaggccgtgcacgtgcagggcgaggacctggacagcgaggccacccccttcgtggccgaggagagagtgagcttcggcctgcacatcgccagcagcagcatcaccagcgtggccgacatcagaaacgcctacaacgaggtggacagcagactgatcgccaaggagatgaacatcagcagcagagacaacgccatgcccgtgttcctgctgagaaactgcgccggccacctgagcggcagcctgagaaccatcggcgccgtggccgtgggccagctgggcgtgagagtgttccacagcagccccgccgccagcagcctggacttcatcggcggccccgccatcctgctgggcctgatcagcctggccaccgacgaccacaccatgtacgccgccgtgaaggtgctgcacagcgtgctgaccagcaacgccatgtgcgacttcctgatgcagcacatctgcggctaccagatcatggccttcctgctgagaaagaaggccagcctgctgaaccacagaatcttccagctgatcctgagcgtggccggcaccgtggagctgggcttcagaagcagcgccatcaccaacaccggcgtgttccagcacatcctgtgcaacttcgagctgtggatgaacaccgccgacaacctggagctgagcctgttcagccacctgctggagatcctgcagagccccagagagggccccagaaacgccgaggccgcccaccaggcccagctgatccccaagctgatcttcctgttcaacgagcccagcctgatccccagcaagatcagcaccatcatcggcatcctggcctgccagctgagaggccacttcagcacccaggacctgctgagaatcggcctgttcgtggtgtacaccctgaagcccagcagcgtgaacgagagacagatctgcatggacggcgccctggaccccagcctgcccgccggcagccagaccagcggcaagaccatctggctgagaaaccagctgctggagatgctgctgagcgtgatcagcagcccccagctgcacctgagcagcgagagcaaggaggagatgttcctgaagctgggccccgactggttcctgctgctgctgcagggccacctgcacgccagcaccaccgtgctggccctgaagctgctgctgtacttcctggccagccccagcctgagaaccagattcagagacggcctgtgcgccggcagctgggtggagagaagcaccgagggcgtggacatcgtgatggacaacctgaagagccagagccccctgcccgagcagagcccctgcctgctgcccggcttcagagtgctgaacgacttcctggcccaccacgtgcacatccccgaggtgtacctgatcgtgagcaccttcttcctgcagacccccctgaccgagctgatggacggccccaaggacagcctggacgccatgctgcagtggctgctgcagagacaccaccaggaggaggtgctgcaggccggcctgtgcaccgagggcgccctgctgctgctggagatgctgaaggccaccatgagccagcccctggccggcagcgaggacggcgcctgggcccagaccttccccgccagcgtgctgcagttcctgagcctggtgcacagaacctacccccaggaccccgcctggagagcccccgagttcctgcagaccctggccatcgccgccttccccctgggcgcccagaagggcgtgggcgccgagagcaccagaaacaccagcagccccgaggccgccgccgagggcgacagcaccgtggagggcctgcaggcccccaccaaggcccaccccgccagaagaaagctgagagagttcacccagctgctgctgagagagctgctgctgggcgccagcagccccaagcagtggctgcccctggaggtgctgctggaggccagccccgaccacgccaccagccagcagaagagagacttccagagcgaggtgctgctgagcgccatggagctgttccacatgaccagcggcggcgacgccgccatgttcagagacggcaaggagccccagcccagcgccgaggccgccgccgcccccagcctggccaacatcagctgcttcacccagaagctggtggagaagctgtacagcggcatgttcagcgccgaccccagacacatcctgctgttcatcctggagcacatcatggtggtgatcgagaccgccagcagccagagagacaccgtgctgagcaccctgtacagcagcctgaacaaggtgatcctgtactgcctgagcaagccccagcagagcctgagcgagtgcctgggcctgctgagcatcctgggcttcctgcaggagcactgggacgtggtgttcgccacctacaacagcaacatcagcttcctgctgtgcctgatgcactgcctgctgctgctgaacgagagaagctaccccgagggcttcggcctggagcccaagcccagaatgagcacctaccaccaggtgttcctgagccccaacgaggacgtgaaggagaagagagaggacctgcccagcctgagcgacgtgcagcacaacatccagaagaccgtgcagaccctgtggcagcagctggtggcccagagacagcagaccctggaggacgccttcaagatcgacctgagcgtgaagcccggcgagagagaggtgaagatcgaggaggtgacccccctgtgggaggagaccatgctgaaggcctggcagcactacctggccagcgagaagaagagcctggccagcagaagcaacgtggcccaccacagcaaggtgaccctgtggagcggcagcctgagcagcgccatgaagctgatgcccggcagacaggccaaggaccccgagtgcaagaccgaggacttcgtgagctgcatcgagaactacagaagaagaggccaggagctgtacgccagcctgtacaaggaccacgtgcagagaagaaagtgcggcaacatcaaggccgccaacgcctgggccagaatccaggagcagctgttcggcgagctgggcctgtggagccagggcgaggagaccaagccctgcagcccctgggagctggactggagagagggccccgccagaatgagaaagagaatcaagagactgagccccctggaggccctgagcagcggcagacacaaggagagccaggacaagaacgaccacatcagccagaccaacgccgagaaccaggacgagctgaccctgagagaggccgagggcgagcccgacgaggtgggcgtggactgcacccagctgaccttcttccccgccctgcacgagagcctgcacagcgaggacttcctggagctgtgcagagagagacaggtgatcctgcaggagctgctggacaaggagaaggtgacccagaagttcagcctggtgatcgtgcagggccacctggtgagcgagggcgtgctgctgttcggccaccagcacttctacatctgcgagaacttcaccctgagccccaccggcgacgtgtactgcaccagacactgcctgagcaacatcagcgaccccttcatcttcaacctgtgcagcaaggacagaagcaccgaccactacagctgccagtgccacagctacgccgacatgagagagctgagacaggccagattcctgctgcaggacatcgccctggagatcttcttccacaacggctacagcaagttcctggtgttctacaacaacgacagaagcaaggccttcaagagcttctgcagcttccagcccagcctgaagggcaaggccaccagcgaggacaccctgagcctgagaagataccccggcagcgacagaatcatgctgcagaagtggcagaagagagacatcagcaacttcgagtacctgatgtacctgaacaccgccgccggcagaacctgcaacgactacatgcagtaccccgtgttcccctgggtgctggccgactacaccagcgagaccctgaacctggccaaccccaagatcttcagagacctgagcaagcccatgggcgcccagaccaaggagagaaagctgaagttcatccagagattcaaggaggtggagaagaccgagggcgacatgaccgtgcagtgccactactacacccactacagcagcgccatcatcgtggccagctacctggtgagaatgccccccttcacccaggccttctgcgccctgcagggcggcagcttcgacgtggccgacagaatgttccacagcgtgaagagcacctgggagagcgccagcagagagaacatgagcgacgtgagagagctgacccccgagttcttctacctgcccgagttcctgaccaactgcaacggcgtggagttcggctgcatgcaggacggcaccgtgctgggcgacgtgcagctgcccccctgggccgacggcgaccccagaaagttcatcagcctgcacagaaaggccctggagagcgacttcgtgagcgccaacctgcaccactggatcgacctgatcttcggctacaagcagcagggccccgccgccgtggacgccgtgaacatcttccacccctacttctacggcgacagaatggacctgagcagcatcaccgaccccctgatcaagagcaccatcctgggcttcgtgagcaacttcggccaggtgcccaagcagctgttcaccaagccccaccccgccagaaccgccgccggcaagcccctgcccggcaaggacgtgagcacccccgtgagcctgcccggccacccccagcccttcttctacagcctgcagagcctgagacccagccaggtgaccgtgaaggacatgtacctgttcagcctgggcagcgagagccccaagggcgccatcggccacatcgtgagcaccgagaagaccatcctggccgtggagagaaacaaggtgctgctgccccccctgtggaacagaaccttcagctggggcttcgacgacttcagctgctgcctgggcagctacggcagcgacaaggtgctgatgaccttcgagaacctggccgcctggggcagatgcctgtgcgccgtgtgccccagccccaccaccatcgtgaccagcggcaccagcaccgtggtgtgcgtgtgggagctgagcatgaccaagggcagacccagaggcctgagactgagacaggccctgtacggccacacccaggccgtgacctgcctggccgccagcgtgaccttcagcctgctggtgagcggcagccaggactgcacctgcatcctgtgggacctggaccacctgacccacgtgaccagactgcccgcccacagagagggcatcagcgccatcaccatcagcgacgtgagcggcaccatcgtgagctgcgccggcgcccacctgagcctgtggaacgtgaacggccagcccctggccagcatcaccaccgcctggggccccgagggcgccatcacctgctgctgcctgatggagggccccgcctgggacaccagccagatcatcatcaccggcagccaggacggcatggtgagagtgtggaagaccgaggacgtgaagatgagcgtgcccggcctgcagatgggcagaaagagagaggccgccgaggccctggcccagcagtgccaggccgagggcggcagaggcgactggggcctgagcagcgcctacagaagaaacccccagggcctgctgccccacagcagccagggcagagccagcggcaaccacagcagcgccgcccagcccagcccctggcccatgggcctgctgtag

SEQ ID NO: 105254 - DNA, 9555 bp, Artificial Sequence
  Description of Artificial Sequence: Synthetic coding sequence
atggaggccgaggacctgagcaaggccgaggacagaaacgaggaccccggcagcaagaacgagggccagctggccgccgtgcagcccgacgtgccccacggcggccagagcagcagccccaccgccctgtgggacatgctggagagaaagttcctggagtaccagcagctgacccacaagagccccatcgagagacagaagagcctgctgagcctgctgcccctgttcctgaaggcctgggagcacagcgtgggcatcatctgcttccccagcctgcagagactggccgaggacgtgagcgaccagctggcccagcagctgcagaaggccctggtgggcaagcccgccgagcaggccagactggccgccggccagctgctgtggtggaagggcgacgtggaccaggacggctacctgctgctgaagagcgtgtacgtgctgaccggcaccgacagcgagaccctgggcagagtggccgagagcggcctgcccgccctgctgctgcagtgcctgtacctgttcttcgtgttccccctggacaaggacgagctgctggagagcgacctgcaggtgcagaagatgttcgtgcagatgctgctgaacatctgcagcgacagccagggcctggagggcctgctgagcggcagcgagctgcagagcctgctgatcgccaccacctgcctgagagagcacagctgctgcttctggaaggagcccaccttctgcgtgctgagagccatcagcaaggcccagaacctgagcatcatccagtacctgcaggccaccgactgcgtgagactgagcctgcagaacctgagcagactgaccgacaccctgcccgcccccgaggtgagcgaggccgtgagcctgatcctgggcttcgtgaaggacagctaccccgtgagcagcgccctgttcctggagttcgagaacagcgagggctaccccctgctgctgaaggtgctgctgagatacgacggcctgacccagagcgaggtggacccccacctggaggagctgctgggcctggtggtgtggctgaccacctgcggcagaagcgagctgaaggtgttcgacagcatcacctacccccagctggagggcttcaagttccaccacgaggccagcggcgtgaccgtgaagaacctgcaggccttccaggtgctgcagaacgtgttccacaaggccagcgacagcgtgctgtgcatccaggtgctgagcgtgatcagaaccatgtgggcctggaacgccagaaacttcttcctgctggagtggaccctgcagcccatcagccagttcgtggagatcatgcccctgaagcccgcccccgtgcaggagcacttcttccagctgctggaggccctggtgttcgagctgcactacgtgccccacgagatcctgagaaaggtgcagcacctgatcaaggagagccccggccccagctgcaccctgatggccctgcagagcatcctgagcatcgccggcggcgaccccctgttcaccgacatcttcagagacagcggcctgctgggcctgctgctggcccagctgagaaagcaggccaagatcatgagaaagagcggcaacaaggtgagcacccccggcgtgcaggaccccgagagagagctgacctgcgtgatgctgagaatcgtggtgaccctgctgaagggcagcgtgagaaacgccgtggtgctgaaggaccacggcatggtgcccttcatcaagatcttcctggacgacgagtgctacagagaggccagcctgagcatcctggagcagctgagcgccatcaacgccgaggagtacatgagcatcatcgtgggcgccctgtgcagcagcacccagggcgagctgcagctgaagctggacctgctgaagagcctgctgagaatcctggtgacccccaagggcagagccgccttcagagtgagcagcggcttcaacggcctgctgagcctgctgagcgacctggagggcagcctgcaggagccccccctgcaggcctggggcgccgtgagccccagacagaccctggagctggtgctgtacaccctgtgcgccgtgagcgccgccctgcactgggaccccgtgaacggctacttcttcagaagaaacggcctgttcgagaagctggccgaggacctgtgcctgctgggctgcttcggcgccctggaggaggagggcaacctgctgagaagctgggtggacaccaaggccagacccttcgccgacctgctgggcaccgccttcagcagcagcggcagcctgccccccagaatccagagctgcctgcagatcctgggcttcctggacagcatggccagcggcaccctgcacctgagaggcgacctgaaggagagcctgagaaccaagcagggccccgtggtggacgtgcagaagggcgagaccggcagcgacccccagagaaacttcaagcagtggcccgacctggaggagagaatggacgagggcgacgccgccatcatgcaccccggcgtggtgtgcatcatggtgagactgctgcccagactgtaccacgaggaccacccccagctgagcgaggagatccagtgcagcctggccagccacatccagagcctggtgaagagcgagaagaacagacaggtgatgtgcgaggccggcctgctgggcaccctgatggccagctgccacagagccctggtgaccagcggcagccccctgcacagcagactgatcagaatcttcgagaagctggccagccaggccatcgagcccgacgtgctgagacagttcctgggcctgggcatccccagcagcctgagcgccaccaccaagatcctggacagcagccacacccacagaggcaaccccggctgcagcggcagccagaccgcccagggcctggccgagggcccctggcccgccgcccccgacgccggcctgcaccccggcgtgacccaggccccccagcccctgggcgagagccaggacagcaccaccgccctgcagaccgccctgagcctgatcagcatgaccagccccagaaacctgcagccccagagagccgccctggcccccagcttcgtggagttcgacatgagcgtggagggctacggctgcctgttcatccccaccctgagcaccgtgatgggcaccagcaccgagtacagcgtgagcggcggcatcggcaccggcgccaccagacccttccccccccccggcggcctgaccttcagctgctggttcctgatcagcagacacggcgccgccaccgagggccaccccctgagattcctgaccctggtgagacacctggccagaaccgagcagcccttcgtgtgcttcagcgtgagcctgtgccccgacgacctgagcctggtggtgagcaccgaggagaaggagttccagcccctggacgtgatggagcccgaggacgacagcgagcccagcgccggctgccagctgcaggtgagatgcggccagctgctggcctgcggccagtggcaccacctggccgtggtggtgaccaaggagatgaagagacactgcaccgtgagcacctgcctggacggccaggtgatcggcagcgccaagatgctgtacatccaggccctgcccggccccttcctgagcatggaccccagcgccttcgtggacgtgtacggctacatcgccacccccagagtgtggaagcagaagagcagcctgatctggagactgggccccacctacctgttcgaggaggccatcagcatggagaccctggaggtgatcaacaagctgggccccagatactgcggcaacttccaggccgtgcacgtgcagggcgaggacctggacagcgaggccacccccttcgtggccgaggagagagtgagcttcggcctgcacatcgccagcagcagcatcaccagcgtggccgacatcagaaacgcctacaacgaggtggacagcagactgatcgccaaggagatgaacatcagcagcagagacaacgccatgcccgtgttcctgctgagaaactgcgccggccacctgagcggcagcctgagaaccatcggcgccgtggccgtgggccagctgggcgtgagagtgttccacagcagccccgccgccagcagcctggacttcatcggcggccccgccatcctgctgggcctgatcagcctggccaccgacgaccacaccatgtacgccgccgtgaaggtgctgcacagcgtgctgaccagcaacgccatgtgcgacttcctgatgcagcacatctgcggctaccagatcatggccttcctgctgagaaagaaggccagcctgctgaaccacagaatcttccagctgatcctgagcgtggccggcaccgtggagctgggcttcagaagcagcgccatcaccaacaccggcgtgttccagcacatcctgtgcaacttcgagctgtggatgaacaccgccgacaacctggagctgagcctgttcagccacctgctggagatcctgcagagccccagagagggccccagaaacgccgaggccgcccaccaggcccagctgatccccaagctgatcttcctgttcaacgagcccagcctgatccccagcaagatcagcaccatcatcggcatcctggcctgccagctgagaggccacttcagcacccaggacctgctgagaatcggcctgttcgtggtgtacaccctgaagcccagcagcgtgaacgagagacagatctgcatggacggcgccctggaccccagcctgcccgccggcagccagaccagcggcaagaccatctggctgagaaaccagctgctggagatgctgctgagcgtgatcagcagcccccagctgcacctgagcagcgagagcaaggaggagatgttcctgaagctgggccccgactggttcctgctgctgctgcagggccacctgcacgccagcaccaccgtgctggccctgaagctgctgctgtacttcctggccagccccagcctgagaaccagattcagagacggcctgtgcgccggcagctgggtggagagaagcaccgagggcgtggacatcgtgatggacaacctgaagagccagagccccctgcccgagcagagcccctgcctgctgcccggcttcagagtgctgaacgacttcctggcccaccacgtgcacatccccgaggtgtacctgatcgtgagcaccttcttcctgcagacccccctgaccgagctgatggacggccccaaggacagcctggacgccatgctgcagtggctgctgcagagacaccaccaggaggaggtgctgcaggccggcctgtgcaccgagggcgccctgctgctgctggagatgctgaaggccaccatgagccagcccctggccggcagcgaggacggcgcctgggcccagaccttccccgccagcgtgctgcagttcctgagcctggtgcacagaacctacccccaggaccccgcctggagagcccccgagttcctgcagaccctggccatcgccgccttccccctgggcgcccagaagggcgtgggcgccgagagcaccagaaacaccagcagccccgaggccgccgccgagggcgacagcaccgtggagggcctgcaggcccccaccaaggcccaccccgccagaagaaagctgagagagttcacccagctgctgctgagagagctgctgctgggcgccagcagccccaagcagtggctgcccctggaggtgctgctggaggccagccccgaccacgccaccagccagcagaagagagacttccagagcgaggtgctgctgagcgccatggagctgttccacatgaccagcggcggcgacgccgccatgttcagagacggcaaggagccccagcccagcgccgaggccgccgccgcccccagcctggccaacatcagctgcttcacccagaagctggtggagaagctgtacagcggcatgttcagcgccgaccccagacacatcctgctgttcatcctggagcacatcatggtggtgatcgagaccgccagcagccagagagacaccgtgctgagcaccctgtacagcagcctgaacaaggtgatcctgtactgcctgagcaagccccagcagagcctgagcgagtgcctgggcctgctgagcatcctgggcttcctgcaggagcactgggacgtggtgttcgccacctacaacagcaacatcagcttcctgctgtgcctgatgcactgcctgctgctgctgaacgagagaagctaccccgagggcttcggcctggagcccaagcccagaatgagcacctaccaccaggtgttcctgagccccaacgaggacgtgaaggagaagagagaggacctgcccagcctgagcgacgtgcagcacaacatccagaagaccgtgcagaccctgtggcagcagctggtggcccagagacagcagaccctggaggacgccttcaagatcgacctgagcgtgaagcccggcgagagagaggtgaagatcgaggaggtgacccccctgtgggaggagaccatgctgaaggcctggcagcactacctggccagcgagaagaagagcctggccagcagaagcaacgtggcccaccacagcaaggtgaccctgtggagcggcagcctgagcagcgccatgaagctgatgcccggcagacaggccaaggaccccgagtgcaagaccgaggacttcgtgagctgcatcgagaactacagaagaagaggccaggagctgtacgccagcctgtacaaggaccacgtgcagagaagaaagtgcggcaacatcaaggccgccaacgcctgggccagaatccaggagcagctgttcggcgagctgggcctgtggagccagggcgaggagaccaagccctgcagcccctgggagctggactggagagagggccccgccagaatgagaaagagaatcaagagactgagccccctggaggccctgagcagcggcagacacaaggagagccaggacaagaacgaccacatcagccagaccaacgccgagaaccaggacgagctgaccctgagagaggccgagggcgagcccgacgaggtgggcgtggactgcacccagctgaccttcttccccgccctgcacgagagcctgcacagcgaggacttcctggagctgtgcagagagagacaggtgatcctgcaggagctgctggacaaggagaaggtgacccagaagttcagcctggtgatcgtgcagggccacctggtgagcgagggcgtgctgctgttcggccaccagcacttctacatctgcgagaacttcaccctgagccccaccggcgacgtgtactgcaccagacactgcctgagcaacatcagcgaccccttcatcttcaacctgtgcagcaaggacagaagcaccgaccactacagctgccagtgccacagctacgccgacatgagagagctgagacaggccagattcctgctgcaggacatcgccctggagatcttcttccacaacggctacagcaagttcctggtgttctacaacaacgacagaagcaaggccttcaagagcttctgcagcttccagcccagcctgaagggcaaggccaccagcgaggacaccctgagcctgagaagataccccggcagcgacagaatcatgctgcagaagtggcagaagagagacatcagcaacttcgagtacctgatgtacctgaacaccgccgccggcagaacctgcaacgactacatgcagtaccccgtgttcccctgggtgctggccgactacaccagcgagaccctgaacctggccaaccccaagatcttcagagacctgagcaagcccatgggcgcccagaccaaggagagaaagctgaagttcatccagagattcaaggaggtggagaagaccgagggcgacatgaccgtgcagtgccactactacacccactacagcagcgccatcatcgtggccagctacctggtgagaatgccccccttcacccaggccttctgcgccctgcagggcggcagcttcgacgtggccgacagaatgttccacagcgtgaagagcacctgggagagcgccagcagagagaacatgagcgacgtgagagagctgacccccgagttcttctacctgcccgagttcctgaccaactgcaacggcgtggagttcggctgcatgcaggacggcaccgtgctgggcgacgtgcagctgcccccctgggccgacggcgaccccagaaagttcatcagcctgcacagaaaggccctggagagcgacttcgtgagcgccaacctgcaccactggatcgacctgatcttcggctacaagcagcagggccccgccgccgtggacgccgtgaacatcttccacccctacttctacggcgacagaatggacctgagcagcatcaccgaccccctgatcaagagcaccatcctgggcttcgtgagcaacttcggccaggtgcccaagcagctgttcaccaagccccaccccgccagaaccgccgccggcaagcccctgcccggcaaggacgtgagcacccccgtgagcctgcccggccacccccagcccttcttctacagcctgcagagcctgagacccagccaggtgaccgtgaaggacatgtacctgttcagcctgggcagcgagagccccaagggcgccatcggccacatcgtgagcaccgagaagaccatcctggccgtggagagaaacaaggtgctgctgccccccctgtggaacagaaccttcagctggggcttcgacgacttcagctgctgcctgggcagctacggcagcgacaaggtgctgatgaccttcgagaacctggccgcctggggcagatgcctgtgcgccgtgtgccccagccccaccaccatcgtgaccagcggcaccagcaccgtggtgtgcgtgtgggagctgagcatgaccaagggcagacccagaggcctgagactgagacaggccctgtacggccacacccaggccgtgacctgcctggccgccagcgtgaccttcagcctgctggtgagcggcagccaggactgcacctgcatcctgtgggacctggaccacctgacccacgtgaccagactgcccgcccacagagagggcatcagcgccatcaccatcagcgacgtgagcggcaccatcgtgagctgcgccggcgcccacctgagcctgtggaacgtgaacggccagcccctggccagcatcaccaccgcctggggccccgagggcgccatcacctgctgctgcctgatggagggccccgcctgggacaccagccagatcatcatcaccggcagccaggacggcatggtgagagtgtggaagaccgaggacgtgaagatgagcgtgcccggcagacccgccggcgaggagccccccgcccagccccccagccccagaggccacaagtgggagaagaacctggccctgagcagagagctggacgtgagcatcgccctgaccggcaagcccagcaagaccagccccgccgtgaccgccctggccgtgagcagaaaccacaccaagctgctggtgggcgacgagagaggcagaatcttctgctggagcgccgacggctag

SEQ ID NO: 105255 - DNA, 1965 bp, Artificial Sequence
  Description of Artificial Sequence: Synthetic coding sequence
atggaggccgaggacctgagcaaggccgaggacagaaacgaggaccccggcagcaagaacgagggccagctggccgccgtgcagcccgacgtgccccacggcggccagagcagcagccccaccgccctgtgggacatgctggagagaaagttcctggagtaccagcagctgacccacaagagccccatcgagagacagaagagcctgctgagcctgctgcccctgttcctgaaggcctgggagcacagcgtgggcatcatctgcttccccagcctgcagagactggccgaggacgtgagcgaccagctggcccagcagctgcagaaggccctggtgggcaagcccgccgagcaggccagactggccgccggccagctgctgtggtggaagggcgacgtggaccaggacggctacctgctgctgaagagcgtgtacgtgctgaccggcaccgacagcgagaccctgggcagagtggccgagagcggcctgcccgccctgctgctgcagtgcctgtacctgttcttcgtgttccccctggacaaggacgagctgctggagagcgacctgcaggtgcagaagatgttcgtgcagatgctgctgaacatctgcagcgacagccagggcctggagggcctgctgagcggcagcgagctgcagagcctgctgatcgccaccacctgcctgagagagcacagctgctgcttctggaaggagcccaccttctgcgtgctgagagccatcagcaaggcccagaacctgagcatcatccagtacctgcaggccaccgactgcgtgagactgagcctgcagaacctgagcagactgaccgacaccctgcccgcccccgaggtgagcgaggccgtgagcctgatcctgggcttcgtgaaggacagctaccccgtgagcagcgccctgttcctggagttcgagaacagcgagggctaccccctgctgctgaaggtgctgctgagatacgacggcctgacccagagcgaggtggacccccacctggaggagctgctgggcctggtggtgtggctgaccacctgcggcagaagcgagctgaaggtgttcgacagcatcacctacccccagctggagggcttcaagttccaccacgaggccagcggcgtgaccgtgaagaacctgcaggccttccaggtgctgcagaacgtgttccacaaggccagcgacagcgtgctgtgcatccaggtgctgagcgtgatcagaaccatgtgggcctggaacgccagaaacttcttcctgctggagtggaccctgcagcccatcagccagttcgtggagatcatgcccctgaagcccgcccccgtgcaggagcacttcttccagctgctggaggccctggtgttcgagctgcactacgtgccccacgagatcctgagaaaggtgcagcacctgatcaaggagagccccggccccagctgcaccctgatggccctgcagagcatcctgagcatcgccggcggcgaccccctgttcaccgacatcttcagagacagcggcctgctgggcctgctgctggcccagctgagaaagcaggccaagatcatgagaaagagcggcaacaaggtgagcacccccggcgtgcaggaccccgagagagagctgacctgcgtgatgctgagaatcgtggtgaccctgctgaagggcagcgtgagaaacgccgtggtgctgaaggaccacggcatggtgcccttcatcaagatcttcctggacgacgagtgctacagagaggccagcctgagcatcctggagcagctgagcgccatcaacgccgaggagtacatgagcatcatcgtgggcgccctgtgcagcagcacccagggcgagctgcagctgaagctggacctgctgaaggtgatcagcagcccccccctgagactggccagcctgtggatctgcaccaagagaagcaccttcgcccaggccttcgtgttcatgtag

SEQ ID NO: 105256 - DNA, 1659 bp, Artificial Sequence
  Description of Artificial Sequence: Synthetic coding sequence
tgagacgacaccgtggtgtgggccgaggagtgcgtggcctgcgccaactggctgtggatgaacaccgccgacaacctggagctgagcctgttcagccacctgctggagatcctgcagagccccagagagggccccagaaacgccgaggccgcccaccaggcccagctgatccccaagctgatcttcctgttcaacgagcccagcctgatccccagcaagatcagcaccatcatcggcatcctggcctgccagctgagaggccacttcagcacccaggacctgctgagaatcggcctgttcgtggtgtacaccctgaagcccagcagcgtgaacgagagacagatctgcatggacggcgccctggaccccagcctgcccgccggcagccagaccagcggcaagaccatctggctgagaaaccagctgctggagatgctgctgagcgtgatcagcagcccccagctgcacctgagcagcgagagcaaggaggagatgttcctgaagctgggccccgactggttcctgctgctgctgcagggccacctgcacgccagcaccaccgtgctggccctgaagctgctgctgtacttcctggccagccccagcctgagaaccagattcagagacggcctgtgcgccggcagctgggtggagagaagcaccgagggcgtggacatcgtgatggacaacctgaagagccagagccccctgcccgagcagagcccctgcctgctgcccggcttcagagtgctgaacgacttcctggcccaccacgtgcacatccccgaggtgtacctgatcgtgagcaccttcttcctgcagacccccctgaccgagctgatggacggccccaaggacagcctggacgccatgctgcagtggctgctgcagagacaccaccaggaggaggtgctgcaggccggcctgtgcaccgagggcgccctgctgctgctggagatgctgaaggccaccatgagccagcccctggccggcagcgaggacggcgcctgggcccagaccttccccgccagcgtgctgcagttcctgagcctggtgcacagaacctacccccaggaccccgcctggagagcccccgagttcctgcagaccctggccatcgccgccttccccctgggcgcccagaagggcgtgggcgccgagagcaccagaaacaccagcagccccgaggccgccgccgagggcgacagcaccgtggagggcctgcaggcccccaccaaggcccaccccgccagaagaaagctgagagagttcacccagctgctgctgagagagctgctgctgggcgccagcagccccaagcagtggctgcccctggaggtgctgctggaggccagccccgaccacgccaccagccagcagaagagagacttccagagcgaggtgctgctgagcgccatggagctgttccacatgaccagcggcggcgacgccgccatgttcagagacggcaaggagccccagcccagcgccgaggccgccgccgcccccagcctggccaacatcagctgcttcacccagaagctggtggagaagctgtacagcggcatgttcagcgccgaccccagacacatcctgctgttcatcctggagcacatcatggtgatcagcgcccccctgcaggccagagacttcagctag

SEQ ID NO: 105257 - DNA, 3129 bp, Artificial Sequence
  Description of Artificial Sequence: Synthetic coding sequence
atggaggccgaggacctgagcaaggccgaggacagaaacgaggaccccggcagcaagaacgagggccagctggccgccgtgcagcccgacgtgccccacggcggccagagcagcagccccaccgccctgtgggacatgctggagagaaagttcctggagtaccagcagctgacccacaagagccccatcgagagacagaagagcctgctgagcctgctgcccctgttcctgaaggcctgggagcacagcgtgggcatcatctgcttccccagcctgcagagactggccgaggacgtgagcgaccagctggcccagcagctgcagaaggccctggtgggcaagcccgccgagcaggccagactggccgccggccagctgctgtggtggaagggcgacgtggaccaggacggctacctgctgctgaagagcgtgtacgtgctgaccggcaccgacagcgagaccctgggcagagtggccgagagcggcctgcccgccctgctgctgcagtgcctgtacctgttcttcgtgttccccctggacaaggacgagctgctggagagcgacctgcaggtgcagaagatgttcgtgcagatgctgctgaacatctgcagcgacagccagggcctggagggcctgctgagcggcagcgagctgcagagcctgctgatcgccaccacctgcctgagagagcacagctgctgcttctggaaggagcccaccttctgcgtgctgagagccatcagcaaggcccagaacctgagcatcatccagtacctgcaggccaccgactgcgtgagactgagcctgcagaacctgagcagactgaccgacaccctgcccgcccccgaggtgagcgaggccgtgagcctgatcctgggcttcgtgaaggacagctaccccgtgagcagcgccctgttcctggagttcgagaacagcgagggctaccccctgctgctgaaggtgctgctgagatacgacggcctgacccagagcgaggtggacccccacctggaggagctgctgggcctggtggtgtggctgaccacctgcggcagaagcgagctgaaggtgttcgacagcatcacctacccccagctggagggcttcaagttccaccacgaggccagcggcgtgaccgtgaagaacctgcaggccttccaggtgctgcagaacgtgttccacaaggccagcgacagcgtgctgtgcatccaggtgctgagcgtgatcagaaccatgtgggcctggaacgccagaaacttcttcctgctggagtggaccctgcagcccatcagccagttcgtggagatcatgcccctgaagcccgcccccgtgcaggagcacttcttccagctgctggaggccctggtgttcgagctgcactacgtgccccacgagatcctgagaaaggtgcagcacctgatcaaggagagccccggccccagctgcaccctgatggccctgcagagcatcctgagcatcgccggcggcgaccccctgttcaccgacatcttcagagacagcggcctgctgggcctgctgctggcccagctgagaaagcaggccaagatcatgagaaagagcggcaacaaggtgagcacccccggcgtgcaggaccccgagagagagctgacctgcgtgatgctgagaatcgtggtgaccctgctgaagggcagcgtgagaaacgccgtggtgctgaaggaccacggcatggtgcccttcatcaagatcttcctggacgacgagtgctacagagaggccagcctgagcatcctggagcagctgagcgccatcaacgccgaggagtacatgagcatcatcgtgggcgccctgtgcagcagcacccagggcgagctgcagctgaagctggacctgctgaagagcctgctgagaatcctggtgacccccaagggcagagccgccttcagagtgagcagcggcttcaacggcctgctgagcctgctgagcgacctggagggcagcctgcaggagccccccctgcaggcctggggcgccgtgagccccagacagaccctggagctggtgctgtacaccctgtgcgccgtgagcgccgccctgcactgggaccccgtgaacggctacttcttcagaagaaacggcctgttcgagaagctggccgaggacctgtgcctgctgggctgcttcggcgccctggaggaggagggcaacctgctgagaagctgggtggacaccaaggccagacccttcgccgacctgctgggcaccgccttcagcagcagcggcagcctgccccccagaatccagagctgcctgcagatcctgggcttcctggacagcatggccagcggcaccctgcacctgagaggcgacctgaaggagagcctgagaaccaagcagggccccgtggtggacgtgcagaagggcgagaccggcagcgacccccagagaaacttcaagcagtggcccgacctggaggagagaatggacgagggcgacgccgccatcatgcaccccggcgtggtgtgcatcatggtgagactgctgcccagactgtaccacgaggaccacccccagctgagcgaggagatccagtgcagcctggccagccacatccagagcctggtgaagagcgagaagaacagacaggtgatgtgcgaggccggcctgctgggcaccctgatggccagctgccacagagccctggtgaccagcggcagccccctgcacagcagactgatcagaatcttcgagaagctggccagccaggccatcgagcccgacgtgctgagacagttcctgggcctgggcatccccagcagcctgagcgccaccaccaagatcctggacagcagccacacccacagaggcaaccccggctgcagcggcagccagaccgcccagggcctggccgagggcccctggcccgccgcccccgacgccggcctgcaccccggcgtgacccaggccccccagcccctgggcgagagccaggacagcaccaccgccctgcagaccgccctgagcctgatcagcatgaccagcccccacatctggaagcccaacatctggaaggacaacctggcccagaagcccgtggccggcgacgccgcccagtgcaacatcttcccccccgccagcagcgtgctgtag

SEQ ID NO: 105258 - DNA, 9531 bp, Artificial Sequence
  Description of Artificial Sequence: Synthetic coding sequence
atggaggccgaggacctgagcaaggccgaggacagaaacgaggaccccggcagcaagaacgagggccagctggccgccgtgcagcccgacgtgccccacggcggccagagcagcagccccaccgccctgtgggacatgctggagagaaagttcctggagtaccagcagctgacccacaagagccccatcgagagacagaagagcctgctgagcctgctgcccctgttcctgaaggcctgggagcacagcgtgggcatcatctgcttccccagcctgcagagactggccgaggacgtgagcgaccagctggcccagcagctgcagaaggccctggtgggcaagcccgccgagcaggccagactggccgccggccagctgctgtggtggaagggcgacgtggaccaggacggctacctgctgctgaagagcgtgtacgtgctgaccggcaccgacagcgagaccctgggcagagtggccgagagcggcctgcccgccctgctgctgcagtgcctgtacctgttcttcgtgttccccctggacaaggacgagctgctggagagcgacctgcaggtgcagaagatgttcgtgcagatgctgctgaacatctgcagcgacagccagggcctggagggcctgctgagcggcagcgagctgcagagcctgctgatcgccaccacctgcctgagagagcacagctgctgcttctggaaggagcccaccttctgcgtgctgagagccatcagcaaggcccagaacctgagcatcatccagtacctgcaggccaccgactgcgtgagactgagcctgcagaacctgagcagactgaccgacaccctgcccgcccccgaggtgagcgaggccgtgagcctgatcctgggcttcgtgaaggacagctaccccgtgagcagcgccctgttcctggagttcgagaacagcgagggctaccccctgctgctgaaggtgctgctgagatacgacggcctgacccagagcgaggtggacccccacctggaggagctgctgggcctggtggtgtggctgaccacctgcggcagaagcgagctgaaggtgttcgacagcatcacctacccccagctggagggcttcaagttccaccacgaggccagcggcgtgaccgtgaagaacctgcaggccttccaggtgctgcagaacgtgttccacaaggccagcgacagcgtgctgtgcatccaggtgctgagcgtgatcagaaccatgtgggcctggaacgccagaaacttcttcctgctggagtggaccctgcagcccatcagccagttcgtggagatcatgcccctgaagcccgcccccgtgcaggagcacttcttccagctgctggaggccctggtgttcgagctgcactacgtgccccacgagatcctgagaaaggtgcagcacctgatcaaggagagccccggccccagctgcaccctgatggccctgcagagcatcctgagcatcgccggcggcgaccccctgttcaccgacatcttcagagacagcggcctgctgggcctgctgctggcccagctgagaaagcaggccaagatcatgagaaagagcggcaacaaggtgagcacccccggcgtgcaggaccccgagagagagctgacctgcgtgatgctgagaatcgtggtgaccctgctgaagggcagcgtgagaaacgccgtggtgctgaaggaccacggcatggtgcccttcatcaagatcttcctggacgacgagtgctacagagaggccagcctgagcatcctggagcagctgagcgccatcaacgccgaggagtacatgagcatcatcgtgggcgccctgtgcagcagcacccagggcgagctgcagctgaagctggacctgctgaagagcctgctgagaatcctggtgacccccaagggcagagccgccttcagagtgagcagcggcttcaacggcctgctgagcctgctgagcgacctggagggcagcctgcaggagccccccctgcaggcctggggcgccgtgagccccagacagaccctggagctggtgctgtacaccctgtgcgccgtgagcgccgccctgcactgggaccccgtgaacggctacttcttcagaagaaacggcctgttcgagaagctggccgaggacctgtgcctgctgggctgcttcggcgccctggaggaggagggcaacctgctgagaagctgggtggacaccaaggccagacccttcgccgacctgctgggcaccgccttcagcagcagcggcagcctgccccccagaatccagagctgcctgcagatcctgggcttcctggacagcatggccagcggcaccctgcacctgagaggcgacctgaaggagagcctgagaaccaagcagggccccgtggtggacgtgcagaagggcgagaccggcagcgacccccagagaaacttcaagcagtggcccgacctggaggagagaatggacgagggcgacgccgccatcatgcaccccggcgtggtgtgcatcatggtgagactgctgcccagactgtaccacgaggaccacccccagctgagcgaggagatccagtgcagcctggccagccacatccagagcctggtgaagagcgagaagaacagacaggtgatgtgcgaggccggcctgctgggcaccctgatggccagctgccacagagccctggtgaccagcggcagccccctgcacagcagactgatcagaatcttcgagaagctggccagccaggccatcgagcccgacgtgctgagacagttcctgggcctgggcatccccagcagcctgagcgccaccaccaagatcctggacagcagccacacccacagaggcaaccccggctgcagcggcagccagaccgcccagggcctggccgagggcccctggcccgccgcccccgacgccggcctgcaccccggcgtgacccaggccccccagcccctgggcgagagccaggacagcaccaccgccctgcagaccgccctgagcctgatcagcatgaccagccccagaaacctgcagccccagagagccgccctggcccccagcttcgtggagttcgacatgagcgtggagggctacggctgcctgttcatccccaccctgagcaccgtgatgggcaccagcaccgagtacagcgtgagcggcggcatcggcaccggcgccaccagacccttccccccccccggcggcctgaccttcagctgctggttcctgatcagcagacacggcgccgccaccgagggccaccccctgagattcctgaccctggtgagacacctggccagaaccgagcagcccttcgtgtgcttcagcgtgagcctgtgccccgacgacctgagcctggtggtgagcaccgaggagaaggagttccagcccctggacgtgatggagcccgaggacgacagcgagcccagcgccggctgccagctgcaggtgagatgcggccagctgctggcctgcggccagtggcaccacctggccgtggtggtgaccaaggagatgaagagacactgcaccgtgagcacctgcctggacggccaggtgatcggcagcgccaagatgctgtacatccaggccctgcccggccccttcctgagcatggaccccagcgccttcgtggacgtgtacggctacatcgccacccccagagtgtggaagcagaagagcagcctgatctggagactgggccccacctacctgttcgaggaggccatcagcatggagaccctggaggtgatcaacaagctgggccccagatactgcggcaacttccaggccgtgcacgtgcagggcgaggacctggacagcgaggccacccccttcgtggccgaggagagagtgagcttcggcctgcacatcgccagcagcagcatcaccagcgtggccgacatcagaaacgcctacaacgaggtggacagcagactgatcgccaaggagatgaacatcagcagcagagacaacgccatgcccgtgttcctgctgagaaactgcgccggccacctgagcggcagcctgagaaccatcggcgccgtggccgtgggccagctgggcgtgagagtgttccacagcagccccgccgccagcagcctggacttcatcggcggccccgccatcctgctgggcctgatcagcctggccaccgacgaccacaccatgtacgccgccgtgaaggtgctgcacagcgtgctgaccagcaacgccatgtgcgacttcctgatgcagcacatctgcggctaccagatcatggccttcctgctgagaaagaaggccagcctgctgaaccacagaatcttccagctgatcctgagcgtggccggcaccgtggagctgggcttcagaagcagcgccatcaccaacaccggcgtgttccagcacatcctgtgcaacttcgagctgtggatgaacaccgccgacaacctggagctgagcctgttcagccacctgctggagatcctgcagagccccagagagggccccagaaacgccgaggccgcccaccaggcccagctgatccccaagctgatcttcctgttcaacgagcccagcctgatccccagcaagatcagcaccatcatcggcatcctggcctgccagctgagaggccacttcagcacccaggacctgctgagaatcggcctgttcgtggtgtacaccctgaagcccagcagcgtgaacgagagacagatctgcatggacggcgccctggaccccagcctgcccgccggcagccagaccagcggcaagaccatctggctgagaaaccagctgctggagatgctgctgagcgtgatcagcagcccccagctgcacctgagcagcgagagcaaggaggagatgttcctgaagctgggccccgactggttcctgctgctgctgcagggccacctgcacgccagcaccaccgtgctggccctgaagctgctgctgtacttcctggccagccccagcctgagaaccagattcagagacggcctgtgcgccggcagctgggtggagagaagcaccgagggcgtggacatcgtgatggacaacctgaagagccagagccccctgcccgagcagagcccctgcctgctgcccggcttcagagtgctgaacgacttcctggcccaccacgtgcacatccccgaggtgtacctgatcgtgagcaccttcttcctgcagacccccctgaccgagctgatggacggccccaaggacagcctggacgccatgctgcagtggctgctgcagagacaccaccaggaggaggtgctgcaggccggcctgtgcaccgagggcgccctgctgctgctggagatgctgaaggccaccatgagccagcccctggccggcagcgaggacggcgcctgggcccagaccttccccgccagcgtgctgcagttcctgagcctggtgcacagaacctacccccaggaccccgcctggagagcccccgagttcctgcagaccctggccatcgccgccttccccctgggcgcccagaagggcgtgggcgccgagagcaccagaaacaccagcagccccgaggccgccgccgagggcgacagcaccgtggagggcctgcaggcccccaccaaggcccaccccgccagaagaaagctgagagagttcacccagctgctgctgagagagctgctgctgggcgccagcagccccaagcagtggctgcccctggaggtgctgctggaggccagccccgaccacgccaccagccagcagaagagagacttccagagcgaggtgctgctgagcgccatggagctgttccacatgaccagcggcggcgacgccgccatgttcagagacggcaaggagccccagcccagcgccgaggccgccgccgcccccagcctggccaacatcagctgcttcacccagaagctggtggagaagctgtacagcggcatgttcagcgccgaccccagacacatcctgctgttcatcctggagcacatcatggtggtgatcgagaccgccagcagccagagagacaccgtgctgagcaccctgtacagcagcctgaacaaggtgatcctgtactgcctgagcaagccccagcagagcctgagcgagtgcctgggcctgctgagcatcctgggcttcctgcaggagcactgggacgtggtgttcgccacctacaacagcaacatcagcttcctgctgtgcctgatgcactgcctgctgctgctgaacgagagaagctaccccgagggcttcggcctggagcccaagcccagaatgagcacctaccaccaggtgttcctgagccccaacgaggacgtgaaggagaagagagaggacctgcccagcctgagcgacgtgcagcacaacatccagaagaccgtgcagaccctgtggcagcagctggtggcccagagacagcagaccctggaggacgccttcaagatcgacctgagcgtgaagcccggcgagagagaggtgaagatcgaggaggtgacccccctgtgggaggagaccatgctgaaggcctggcagcactacctggccagcgagaagaagagcctggccagcagaagcaacgtggcccaccacagcaaggtgaccctgtggagcggcagcctgagcagcgccatgaagctgatgcccggcagacaggccaaggaccccgagtgcaagaccgaggacttcgtgagctgcatcgagaactacagaagaagaggccaggagctgtacgccagcctgtacaaggaccacgtgcagagaagaaagtgcggcaacatcaaggccgccaacgcctgggccagaatccaggagcagctgttcggcgagctgggcctgtggagccagggcgaggagaccaagccctgcagcccctgggagctggactggagagagggccccgccagaatgagaaagagaatcaagagactgagccccctggaggccctgagcagcggcagacacaaggagagccaggacaagaacgaccacatcagccagaccaacgccgagaaccaggacgagctgaccctgagagaggccgagggcgagcccgacgaggtgggcgtggactgcacccagctgaccttcttccccgccctgcacgagagcctgcacagcgaggacttcctggagctgtgcagagagagacaggtgatcctgcaggagctgctggacaaggagaaggtgacccagaagttcagcctggtgatcgtgcagggccacctggtgagcgagggcgtgctgctgttcggccaccagcacttctacatctgcgagaacttcaccctgagccccaccggcgacgtgtactgcaccagacactgcctgagcaacatcagcgaccccttcatcttcaacctgtgcagcaaggacagaagcaccgaccactacagctgccagtgccacagctacgccgacatgagagagctgagacaggccagattcctgctgcaggacatcgccctggagatcttcttccacaacggctacagcaagttcctggtgttctacaacaacgacagaagcaaggccttcaagagcttctgcagcttccagcccagcctgaagggcaaggccaccagcgaggacaccctgagcctgagaagataccccggcagcgacagaatcatgctgcagaagtggcagaagagagacatcagcaacttcgagtacctgatgtacctgaacaccgccgccggcagaacctgcaacgactacatgcagtaccccgtgttcccctgggtgctggccgactacaccagcgagaccctgaacctggccaaccccaagatcttcagagacctgagcaagcccatgggcgcccagaccaaggagagaaagctgaagttcatccagagattcaaggaggtggagaagaccgagggcgacatgaccgtgcagtgccactactacacccactacagcagcgccatcatcgtggccagctacctggtgagaatgccccccttcacccaggccttctgcgccctgcagggcggcagcttcgacgtggccgacagaatgttccacagcgtgaagagcacctgggagagcgccagcagagagaacatgagcgacgtgagagagctgacccccgagttcttctacctgcccgagttcctgaccaactgcaacggcgtggagttcggctgcatgcaggacggcaccgtgctgggcgacgtgcagctgcccccctgggccgacggcgaccccagaaagttcatcagcctgcacagaaaggccctggagagcgacttcgtgagcgccaacctgcaccactggatcgacctgatcttcggctacaagcagcagggccccgccgccgtggacgccgtgaacatcttccacccctacttctacggcgacagaatggacctgagcagcatcaccgaccccctgatcaagagcaccatcctgggcttcgtgagcaacttcggccaggtgcccaagcagctgttcaccaagccccaccccgccagaaccgccgccggcaagcccctgcccggcaaggacgtgagcacccccgtgagcctgcccggccacccccagcccttcttctacagcctgcagagcctgagacccagccaggtgaccgtgaaggacatgtacctgttcagcctgggcagcgagagccccaagggcgccatcggccacatcgtgagcaccgagaagaccatcctggccgtggagagaaacaaggtgctgctgccccccctgtggaacagaaccttcagctggggcttcgacgacttcagctgctgcctgggcagctacggcagcgacaaggtgctgatgaccttcgagaacctggccgcctggggcagatgcctgtgcgccgtgtgccccagccccaccaccatcgtgaccagcggcaccagcaccgtggtgtgcgtgtgggagctgagcatgaccaagggcagacccagaggcctgagactgagacaggccctgtacggccacacccaggccgtgacctgcctggccgccagcgtgaccttcagcctgctggtgagcggcagccaggactgcacctgcatcctgtgggacctggaccacctgacccacgtgaccagactgcccgcccacagagagggcatcagcgccatcaccatcagcgacgtgagcggcaccatcgtgagctgcgccggcgcccacctgagcctgtggaacgtgaacggccagcccctggccagcatcaccaccgcctggggccccgagggcgccatcacctgctgctgcctgatggagggccccgcctgggacaccagccagatcatcatcaccggcagccaggacggcatggtgagagtgtggaagaccgaggacgtgaagatgagcgtgcccggcctgcagatgggcagaaagagagaggccgccgaggccctggcccagcagtgccaggccgagggcggcagaggcgactggggcctgagcagcgcctacagaagaaacccccagggcctgctgccccacagcagccagggcagagccagcggcaaccacagcagcgccgcccagcccagcccctggcccatgggcctgctgtag

SEQ ID NO: 105259 - DNA, 3159 bp, Artificial Sequence
  Description of Artificial Sequence: Synthetic coding sequence
ctgaacagcgacctgctgtgccacggcatggaggccgaggacctgagcaaggccgaggacagaaacgaggaccccggcagcaagaacgagggccagctggccgccgtgcagcccgacgtgccccacggcggccagagcagcagccccaccgccctgtgggacatgctggagagaaagttcctggagtaccagcagctgacccacaagagccccatcgagagacagaagagcctgctgagcctgctgcccctgttcctgaaggcctgggagcacagcgtgggcatcatctgcttccccagcctgcagagactggccgaggacgtgagcgaccagctggcccagcagctgcagaaggccctggtgggcaagcccgccgagcaggccagactggccgccggccagctgctgtggtggaagggcgacgtggaccaggacggctacctgctgctgaagagcgtgtacgtgctgaccggcaccgacagcgagaccctgggcagagtggccgagagcggcctgcccgccctgctgctgcagtgcctgtacctgttcttcgtgttccccctggacaaggacgagctgctggagagcgacctgcaggtgcagaagatgttcgtgcagatgctgctgaacatctgcagcgacagccagggcctggagggcctgctgagcggcagcgagctgcagagcctgctgatcgccaccacctgcctgagagagcacagctgctgcttctggaaggagcccaccttctgcgtgctgagagccatcagcaaggcccagaacctgagcatcatccagtacctgcaggccaccgactgcgtgagactgagcctgcagaacctgagcagactgaccgacaccctgcccgcccccgaggtgagcgaggccgtgagcctgatcctgggcttcgtgaaggacagctaccccgtgagcagcgccctgttcctggagttcgagaacagcgagggctaccccctgctgctgaaggtgctgctgagatacgacggcctgacccagagcgaggtggacccccacctggaggagctgctgggcctggtggtgtggctgaccacctgcggcagaagcgagctgaaggtgttcgacagcatcacctacccccagctggagggcttcaagttccaccacgaggccagcggcgtgaccgtgaagaacctgcaggccttccaggtgctgcagaacgtgttccacaaggccagcgacagcgtgctgtgcatccaggtgctgagcgtgatcagaaccatgtgggcctggaacgccagaaacttcttcctgctggagtggaccctgcagcccatcagccagttcgtggagatcatgcccctgaagcccgcccccgtgcaggagcacttcttccagctgctggaggccctggtgttcgagctgcactacgtgccccacgagatcctgagaaaggtgcagcacctgatcaaggagagccccggccccagctgcaccctgatggccctgcagagcatcctgagcatcgccggcggcgaccccctgttcaccgacatcttcagagacagcggcctgctgggcctgctgctggcccagctgagaaagcaggccaagatcatgagaaagagcggcaacaaggtgagcacccccggcgtgcaggaccccgagagagagctgacctgcgtgatgctgagaatcgtggtgaccctgctgaagggcagcgtgagaaacgccgtggtgctgaaggaccacggcatggtgcccttcatcaagatcttcctggacgacgagtgctacagagaggccagcctgagcatcctggagcagctgagcgccatcaacgccgaggagtacatgagcatcatcgtgggcgccctgtgcagcagcacccagggcgagctgcagctgaagctggacctgctgaagagcctgctgagaatcctggtgacccccaagggcagagccgccttcagagtgagcagcggcttcaacggcctgctgagcctgctgagcgacctggagggcagcctgcaggagccccccctgcaggcctggggcgccgtgagccccagacagaccctggagctggtgctgtacaccctgtgcgccgtgagcgccgccctgcactgggaccccgtgaacggctacttcttcagaagaaacggcctgttcgagaagctggccgaggacctgtgcctgctgggctgcttcggcgccctggaggaggagggcaacctgctgagaagctgggtggacaccaaggccagacccttcgccgacctgctgggcaccgccttcagcagcagcggcagcctgccccccagaatccagagctgcctgcagatcctgggcttcctggacagcatggccagcggcaccctgcacctgagaggcgacctgaaggagagcctgagaaccaagcagggccccgtggtggacgtgcagaagggcgagaccggcagcgacccccagagaaacttcaagcagtggcccgacctggaggagagaatggacgagggcgacgccgccatcatgcaccccggcgtggtgtgcatcatggtgagactgctgcccagactgtaccacgaggaccacccccagctgagcgaggagatccagtgcagcctggccagccacatccagagcctggtgaagagcgagaagaacagacaggtgatgtgcgaggccggcctgctgggcaccctgatggccagctgccacagagccctggtgaccagcggcagccccctgcacagcagactgatcagaatcttcgagaagctggccagccaggccatcgagcccgacgtgctgagacagttcctgggcctgggcatccccagcagcctgagcgccaccaccaagatcctggacagcagccacacccacagaggcaaccccggctgcagcggcagccagaccgcccagggcctggccgagggcccctggcccgccgcccccgacgccggcctgcaccccggcgtgacccaggccccccagcccctgggcgagagccaggacagcaccaccgccctgcagaccgccctgagcctgatcagcatgaccagccccgtggccggcagccagaccagcggcaagaccatctggctgagaaaccagctgctggagatgctgctgagcgtgatcagcagcccccagctgcacctgagcagcgagtag

SEQ ID NO: 105260 - DNA, 1875 bp, Artificial Sequence
  Description of Artificial Sequence: Synthetic coding sequence
atgctgcagaagtggcagaagagagacatcagcaacttcgagtacctgatgtacctgaacaccgccgccggcagaacctgcaacgactacatgcagtaccccgtgttcccctgggtgctggccgactacaccagcgagaccctgaacctggccaaccccaagatcttcagagacctgagcaagcccatgggcgcccagaccaaggagagaaagctgaagttcatccagagattcaaggaggtggagaagaccgagggcgacatgaccgtgcagtgccactactacacccactacagcagcgccatcatcgtggccagctacctggtgagaatgccccccttcacccaggccttctgcgccctgcagggcggcagcttcgacgtggccgacagaatgttccacagcgtgaagagcacctgggagagcgccagcagagagaacatgagcgacgtgagagagctgacccccgagttcttctacctgcccgagttcctgaccaactgcaacggcgtggagttcggctgcatgcaggacggcaccgtgctgggcgacgtgcagctgcccccctgggccgacggcgaccccagaaagttcatcagcctgcacagaaaggccctggagagcgacttcgtgagcgccaacctgcaccactggatcgacctgatcttcggctacaagcagcagggccccgccgccgtggacgccgtgaacatcttccacccctacttctacggcgacagaatggacctgagcagcatcaccgaccccctgatcaagagcaccatcctgggcttcgtgagcaacttcggccaggtgcccaagcagctgttcaccaagccccaccccgccagaaccgccgccggcaagcccctgcccggcaaggacgtgagcacccccgtgagcctgcccggccacccccagcccttcttctacagcctgcagagcctgagacccagccaggtgaccgtgaaggacatgtacctgttcagcctgggcagcgagagccccaagggcgccatcggccacatcgtgagcaccgagaagaccatcctggccgtggagagaaacaaggtgctgctgccccccctgtggaacagaaccttcagctggggcttcgacgacttcagctgctgcctgggcagctacggcagcgacaaggtgctgatgaccttcgagaacctggccgcctggggcagatgcctgtgcgccgtgtgccccagccccaccaccatcgtgaccagcggcaccagcaccgtggtgtgcgtgtgggagctgagcatgaccaagggcagacccagaggcctgagactgagacaggccctgtacggccacacccaggccgtgacctgcctggccgccagcgtgaccttcagcctgctggtgagcggcagccaggactgcacctgcatcctgtgggacctggaccacctgacccacgtgaccagactgcccgcccacagagagggcatcagcgccatcaccatcagcgacgtgagcggcaccatcgtgagctgcgccggcgcccacctgagcctgtggaacgtgaacggccagcccctggccagcatcaccaccgcctggggccccgagggcgccatcacctgctgctgcctgatggagggccccgcctgggacaccagccagatcatcatcaccggcagccaggacggcatggtgagagtgtggaagaccgaggacgtgaagatgagcgtgcccggcagacccgccggcgaggagccccccgcccagccccccaccctgagcatggccgacggcaccagcatgaagagaatgagcacccacaccagaagagccgagcagcacgccggcaactgcgacctggtgatgcccagctgcaccagaaactacacctag

SEQ ID NO: 105261 - DNA, 1704 bp, Artificial Sequence
  Description of Artificial Sequence: Synthetic coding sequence
atggacgacaaggacatcgacaaggagctgagacagaagctgaacttcagctactgcgaggagaccgagatcgagggccagaagaaggtggaggagagcagagaggccagcagccagacccccgagaagggcgaggtgcaggacagcgaggccaagggcacccccccctggacccccctgagcaacgtgcacgagctggacaccagcagcgagaaggacaaggagagccccgaccagatcctgagaacccccgtgagccaccccctgaagtgccccgagacccccgcccagcccgacagcagaagcaagctgctgcccagcgacagccccagcacccccaagaccatgctgagcagactggtgatcagccccaccggcaagctgcccagcagaggccccaagcacctgaagctgacccccgcccccctgaaggacgagatgaccagcctggccctggtgaacatcaaccccttcacccccgagagctacaagaagctgttcctgcagagcggcggcaagagaaagatcagaggcgacctggaggaggccggccccgaggagggcaagggcggcctgcccgccaagagatgcgtgctgagagagaccaacatggccagcagatacgagaaggagttcctggaggtggagaagatcggcgtgggcgagttcggcaccgtgtacaagtgcatcaagagactggacggctgcgtgtacgccatcaagagaagcatgaagaccttcaccgagctgagcaacgagaacagcgccctgcacgaggtgtacgcccacgccgtgctgggccaccacccccacgtggtgagatactacagcagctgggccgaggacgaccacatgatcatccagaacgagtactgcaacggcggcagcctgcaggccgccatcagcgagaacaccaagagcggcaaccacttcgaggagcccaagctgaaggacatcctgctgcagatcagcctgggcctgaactacatccacaacagcagcatggtgcacctggacatcaagcccagcaacatcttcatctgccacaagatgcagagcgagagcagcggcgtgatcgaggaggtggagaacgaggccgactggttcctgagcgccaacgtgatgtacaagatcggcgacctgggccacgccaccagcatcaacaagcccaaggtggaggagggcgacagcagattcctggccaacgagatcctgcaggaggactacagacacctgcccaaggccgacatcttcgccctgggcctgaccatcgccgtggccgccggcgccgagagcctgcccaccaacggcgccgcctggcaccacatcagaaagggcaacttccccgacgtgccccaggagctgagcgagagcttcagcagcctgctgaagaacatgatccagcccgacgccgagcagagacccagcgccgccgccctggccagaaacaccgtgctgagacccagcctgggcaagaccgaggagctgcagcagcagctgaacctggagaagttcaagaccgccaccctggagagagagctgagagaggcccagcaggcccagagcccccagggctacacccaccacggcgacaccggcgtgagcggcacccacaccggcagcagaagcaccaagagactggtgggcggcaagagcgccagaagcagcagcttcaccagcggcgagagagagcccctgcactag

SEQ ID NO: 105262 - DNA, 846 bp, Artificial Sequence
  Description of Artificial Sequence: Synthetic coding sequence
atggtgaccatcctgatgagagccatcaacagcctgggcatccacgtgctggacagcagcagacccaccgaccccctgagccacagcagcaacagcagcagcgagcccgccatgttcatcgaggacaaggccgtggacaccctggcctacctgagcgacggcgacgccagagccggcctgaacggcctgcagctggccgtgctggccagactgagcagcagaaagatgttctgcaagaagagcggccagagctacagccccagcagagtgctgatcaccgagaacgacgtgaaggagggcctgcagagaagccacatcctgtacgacagagccggcgaggagcactacaactgcatcagcgccctgcacaagagcatgagaggcagcgaccagaacgccagcctgtactggctggccagaatgctggagggcggcgaggaccccctgtacgtggccagaagactggtgagattcgccagcgaggacatcggcctggccgaccccagcgccctgacccaggccgtggccgcctaccagggctgccacttcatcggcatgcccgagtgcgaggtgctgctggcccagtgcgtggtgtacttcgccagagcccccaagagcatcgaggtgtacagcgcctacaacaacgtgaaggcctgcctgagaaaccaccagggccccctgccccccgtgcccctgcacctgagaaacgcccccaccagactgatgaaggacctgggctacggcaagggctacaagtacaaccccatgtacagcgagcccgtggaccaggagtacctgcccgaggagctgagaggcgtggacttcttcaagcagagaagatgctag

SEQ ID NO: 105263 - DNA, 1338 bp, Artificial Sequence
  Description of Artificial Sequence: Synthetic coding sequence
atgctgcagggcaagcccctggccgacaccatgagacccgacaccctgcaggactacttcggccagagcaaggccgtgggccaggacaccctgctgagaagcctgctggagaccaacgagatccccagcctgatcctgtggggcccccccggctgcggcaagaccaccctggcccacatcatcgccagcaacagcaagaagcacagcatcagattcgtgaccctgagcgccaccaacgccaagaccaacgacgtgagagacgtgatcaagcaggcccagaacgagaagagcttcttcaagagaaagaccatcctgttcatcgacgagatccacagattcaacaagagccagcaggacaccttcctgccccacgtggagtgcggcaccatcaccctgatcggcgccaccaccgagaaccccagcttccaggtgaacgccgccctgctgagcagatgcagagtgatcgtgctggagaagctgcccgtggaggccatggtgaccatcctgatgagagccatcaacagcctgggcatccacgtgctggacagcagcagacccaccgaccccctgagccacagcagcaacagcagcagcgagcccgccatgttcatcgaggacaaggccgtggacaccctggcctacctgagcgacggcgacgccagagccggcctgaacggcctgcagctggccgtgctggccagactgagcagcagaaagatgttctgcaagaagagcggccagagctacagccccagcagagtgctgatcaccgagaacgacgtgaaggagggcctgcagagaagccacatcctgtacgacagagccggcgaggagcactacaactgcatcagcgccctgcacaagagcatgagaggcagcgaccagaacgccagcctgtactggctggccagaatgctggagggcggcgaggaccccctgtacgtggccagaagactggtgagattcgccagcgaggacatcggcctggccgaccccagcgccctgacccaggccgtggccgcctaccagggctgccacttcatcggcatgcccgagtgcgaggtgctgctggcccagtgcgtggtgtacttcgccagagcccccaagagcatcgaggtgtacagcgcctacaacaacgtgaaggcctgcctgagaaaccaccagggccccctgccccccgtgcccctgcacctgagaaacgcccccaccagactgatgaaggacctgggctacggcaagggctacaagtacaaccccatgtacagcgagcccgtggaccaggagtacctgcccgaggagctgagaggcgtggacttcttcaagcagagaagatgctag

SEQ ID NO: 105264 - DNA, 1923 bp, Artificial Sequence
  Description of Artificial Sequence: Synthetic coding sequence
atggaggtgagcggccccgaggacgaccccttcctgagccagctgcaccaggtgcagtgccccgtgtgccagcagatgatgcccgccgcccacatcaacagccacctggacagatgcctgctgctgcaccccgccggccacgccgagcccgccgccggcagccacagagccggcgagagagccaagggccccagcccccccggcgccaagagaagaagactgagcgagagcagcgccctgaagcagcccgccacccccaccgccgccgagagcagcgagggcgagggcgaggagggcgacgacggcggcgagaccgagagcagagagagctacgacgccccccccacccccagcggcgccagactgatccccgacttccccgtggccagaagcagcagccccggcagaaagggcagcggcaagagacccgccgccgccgccgccgccggcagcgccagccccagaagctgggacgaggccgaggcccaggaggaggaggaggccgtgggcgacggcgacggcgacggcgacgccgacgccgacggcgaggacgaccccggccactgggacgccgacgccgccgaggccgccaccgccttcggcgccagcggcggcggcagaccccaccccagagccctggccgccgaggagatcagacagatgctgcagggcaagcccctggccgacaccatgagacccgacaccctgcaggactacttcggccagagcaaggccgtgggccaggacaccctgctgagaagcctgctggagaccaacgagatccccagcctgatcctgtggggcccccccggctgcggcaagaccaccctggcccacatcatcgccagcaacagcaagaagcacagcatcagattcgtgaccctgagcgccaccaacgccaagaccaacgacgtgagagacgtgatcaagcaggcccagaacgagaagagcttcttcaagagaaagaccatcctgttcatcgacgagatccacagattcaacaagagccagcaggtgaacgccgccctgctgagcagatgcagagtgatcgtgctggagaagctgcccgtggaggccatggtgaccatcctgatgagagccatcaacagcctgggcatccacgtgctggacagcagcagacccaccgaccccctgagccacagcagcaacagcagcagcgagcccgccatgttcatcgaggacaaggccgtggacaccctggcctacctgagcgacggcgacgccagagccggcctgaacggcctgcagctggccgtgctggccagactgagcagcagaaagatgttctgcaagaagagcggccagagctacagccccagcagagtgctgatcaccgagaacgacgtgaaggagggcctgcagagaagccacatcctgtacgacagagccggcgaggagcactacaactgcatcagcgccctgcacaagagcatgagaggcagcgaccagaacgccagcctgtactggctggccagaatgctggagggcggcgaggaccccctgtacgtggccagaagactggtgagattcgccagcgaggacatcggcctggccgaccccagcgccctgacccaggccgtggccgcctaccagggctgccacttcatcggcatgcccgagtgcgaggtgctgctggcccagtgcgtggtgtacttcgccagagcccccaagagcatcgaggtgtacagcgcctacaacaacgtgaaggcctgcctgagaaaccaccagggccccctgccccccgtgcccctgcacctgagaaacgcccccaccagactgatgaaggacctgggctacggcaagggctacaagtacaaccccatgtacagcgagcccgtggaccaggagtacctgcccgaggagctgagaggcgtggacttcttcaagcagagaagatgctag

SEQ ID NO: 105265 - DNA, 1998 bp, Artificial Sequence
  Description of Artificial Sequence: Synthetic coding sequence
atggaggtgagcggccccgaggacgaccccttcctgagccagctgcaccaggtgcagtgccccgtgtgccagcagatgatgcccgccgcccacatcaacagccacctggacagatgcctgctgctgcaccccgccggccacgccgagcccgccgccggcagccacagagccggcgagagagccaagggccccagcccccccggcgccaagagaagaagactgagcgagagcagcgccctgaagcagcccgccacccccaccgccgccgagagcagcgagggcgagggcgaggagggcgacgacggcggcgagaccgagagcagagagagctacgacgccccccccacccccagcggcgccagactgatccccgacttccccgtggccagaagcagcagccccggcagaaagggcagcggcaagagacccgccgccgccgccgccgccggcagcgccagccccagaagctgggacgaggccgaggcccaggaggaggaggaggccgtgggcgacggcgacggcgacggcgacgccgacgccgacggcgaggacgaccccggccactgggacgccgacgccgccgaggccgccaccgccttcggcgccagcggcggcggcagaccccaccccagagccctggccgccgaggagatcagacagatgctgcagggcaagcccctggccgacaccatgagacccgacaccctgcaggactacttcggccagagcaaggccgtgggccaggacaccctgctgagaagcctgctggagaccaacgagatccccagcctgatcctgtggggcccccccggctgcggcaagaccaccctggcccacatcatcgccagcaacagcaagaagcacagcatcagattcgtgaccctgagcgccaccaacgccaagaccaacgacgtgagagacgtgatcaagcaggcccagaacgagaagagcttcttcaagagaaagaccatcctgttcatcgacgagatccacagattcaacaagagccagcaggacaccttcctgccccacgtggagtgcggcaccatcaccctgatcggcgccaccaccgagaaccccagcttccaggtgaacgccgccctgctgagcagatgcagagtgatcgtgctggagaagctgcccgtggaggccatggtgaccatcctgatgagagccatcaacagcctgggcatccacgtgctggacagcagcagacccaccgaccccctgagccacagcagcaacagcagcagcgagcccgccatgttcatcgaggacaaggccgtggacaccctggcctacctgagcgacggcgacgccagagccggcctgaacggcctgcagctggccgtgctggccagactgagcagcagaaagatgttctgcaagaagagcggccagagctacagccccagcagagtgctgatcaccgagaacgacgtgaaggagggcctgcagagaagccacatcctgtacgacagagccggcgaggagcactacaactgcatcagcgccctgcacaagagcatgagaggcagcgaccagaacgccagcctgtactggctggccagaatgctggagggcggcgaggaccccctgtacgtggccagaagactggtgagattcgccagcgaggacatcggcctggccgaccccagcgccctgacccaggccgtggccgcctaccagggctgccacttcatcggcatgcccgagtgcgaggtgctgctggcccagtgcgtggtgtacttcgccagagcccccaagagcatcgaggtgtacagcgcctacaacaacgtgaaggcctgcctgagaaaccaccagggccccctgccccccgtgcccctgcacctgagaaacgcccccaccagactgatgaaggacctgggctacggcaagggctacaagtacaaccccatgtacagcgagcccgtggaccaggagtacctgcccgaggagctgagaggcgtggacttcttcaagcagagaagatgctag

SEQ ID NO: 105266 - DNA, 4299 bp, Artificial Sequence
  Description of Artificial Sequence: Synthetic coding sequence
atgagcgagaagaagctggagaccaccgcccagcagagaaagtgccccgagtggatgaacgtgcagaacaagagatgcgccgtggaggagagaaaggcctgcgtgagaaagagcgtgttcgaggacgacctgcccttcctggagttcaccggcagcatcgtgtacagctacgacgccagcgactgcagcttcctgagcgaggacatcagcatgagcctgagcgacggcgacgtggtgggcttcgacatggagtggccccccctgtacaacagaggcaagctgggcaaggtggccctgatccagctgtgcgtgagcgagagcaagtgctacctgttccacgtgagcagcatgagcgtgttcccccagggcctgaagatgctgctggagaacaaggccgtgaagaaggccggcgtgggcatcgagggcgaccagtggaagctgctgagagacttcgacatcaagctgaagaacttcgtggagctgaccgacgtggccaacaagaagctgaagtgcaccgagacctggagcctgaacagcctggtgaagcacctgctgggcaagcagctgctgaaggacaagagcatcagatgcagcaactggagcaagttccccctgaccgaggaccagaagctgtacgccgccaccgacgcctacgccggcttcatcatctacagaaacctggagatcctggacgacaccgtgcagagattcgccatcaacaaggaggaggagatcctgctgagcgacatgaacaagcagctgaccagcatcagcgaggaggtgatggacctggccaagcacctgccccacgccttcagcaagctggagaaccccagaagagtgagcatcctgctgaaggacatcagcgagaacctgtacagcctgagaagaatgatcatcggcagcaccaacatcgagaccgagctgagacccagcaacaacctgaacctgctgagcttcgaggacagcaccaccggcggcgtgcagcagaagcagatcagagagcacgaggtgctgatccacgtggaggacgagacctgggaccccaccctggaccacctggccaagcacgacggcgaggacgtgctgggcaacaaggtggagagaaaggaggacggcttcgaggacggcgtggaggacaacaagctgaaggagaacatggagagagcctgcctgatgagcctggacatcaccgagcacgagctgcagatcctggagcagcagagccaggaggagtacctgagcgacatcgcctacaagagcaccgagcacctgagccccaacgacaacgagaacgacaccagctacgtgatcgagagcgacgaggacctggagatggagatgctgaagcacctgagccccaacgacaacgagaacgacaccagctacgtgatcgagagcgacgaggacctggagatggagatgctgaagagcctggagaacctgaacagcggcaccgtggagcccacccacagcaagtgcctgaagatggagagaaacctgggcctgcccaccaaggaggaggaggaggacgacgagaacgaggccaacgagggcgaggaggacgacgacaaggacttcctgtggcccgcccccaacgaggagcaggtgacctgcctgaagatgtacttcggccacagcagcttcaagcccgtgcagtggaaggtgatccacagcgtgctggaggagagaagagacaacgtggccgtgatggccaccggctacggcaagagcctgtgcttccagtacccccccgtgtacgtgggcaagatcggcctggtgatcagccccctgatcagcctgatggaggaccaggtgctgcagctgaagatgagcaacatccccgcctgcttcctgggcagcgcccagagcgagaacgtgctgaccgacatcaagctgggcaagtacagaatcgtgtacgtgacccccgagtactgcagcggcaacatgggcctgctgcagcagctggaggccgacatcggcatcaccctgatcgccgtggacgaggcccactgcatcagcgagtggggccacgacttcagagacagcttcagaaagctgggcagcctgaagaccgccctgcccatggtgcccatcgtggccctgaccgccaccgccagcagcagcatcagagaggacatcgtgagatgcctgaacctgagaaacccccagatcacctgcaccggcttcgacagacccaacctgtacctggaggtgagaagaaagaccggcaacatcctgcaggacctgcagcccttcctggtgaagaccagcagccactgggagttcgagggccccaccatcatctactgccccagcagaaagatgacccagcaggtgaccggcgagctgagaaagctgaacctgagctgcggcacctaccacgccggcatgagcttcagcaccagaaaggacatccaccacagattcgtgagagacgagatccagtgcgtgatcgccaccatcgccttcggcatgggcatcaacaaggccgacatcagacaggtgatccactacggcgcccccaaggacatggagagctactaccaggagatcggcagagccggcagagacggcctgcagagcagctgccacgtgctgtgggcccccgccgacatcaacctgaacagacacctgctgaccgagatcagaaacgagaagttcagactgtacaagctgaagatgatggccaagatggagaagtacctgcacagcagcagatgcagaagacagatcatcctgagccacttcgaggacaagcaggtgcagaaggccagcctgggcatcatgggcaccgagaagtgctgcgacaactgcagaagcagactggaccactgctacagcatggacgacagcgaggacaccagctgggacttcggcccccaggccttcaagctgctgagcgccgtggacatcctgggcgagaagttcggcatcggcctgcccatcctgttcctgagaggcagcaacagccagagactggccgaccagtacagaagacacagcctgttcggcaccggcaaggaccagaccgagagctggtggaaggccttcagcagacagctgatcaccgagggcttcctggtggaggtgagcagatacaacaagttcatgaagatctgcgccctgaccaagaagggcagaaactggctgcacaaggccaacaccgagagccagagcctgatcctgcaggccaacgaggagctgtgccccaagaagctgctgctgcccagcagcaagaccgtgagcagcggcaccaaggagcactgctacaaccaggtgcccgtggagctgagcaccgagaagaagagcaacctggagaagctgtacagctacaagccctgcgacaagatcagcagcggcagcaacatcagcaagaagagcatcatggtgcagagccccgagaaggcctacagcagcagccagcccgtgatcagcgcccaggagcaggagacccagatcgtgctgtacggcaagctggtggaggccagacagaagcacgccaacaagatggacgtgccccccgccatcctggccaccaacaagatcctggtggacatggccaagatgagacccaccaccgtggagaacgtgaagagaatcgacggcgtgagcgagggcaaggccgccatgctggcccccctgctggaggtgatcaagcacttctgccagaccaacagcgtgcagaccgacctgttcagcagcaccaagccccaggaggagcagaagaccagcctggtggccaagaacaagatctgcaccctgagccagagcatggccatcacctacagcctgttccaggagaagaagatgcccctgaagagcatcgccgagagcagaatcctgcccctgatgaccatcggcatgcacctgagccaggccgtgaaggccggctgccccctggacctggagagagccggcctgacccccgaggtgcagaagatcatcgccgacgtgatcagaaacccccccgtgaacagcgacatgagcaagatcagcctgatcagaatgctggtgcccgagaacatcgacacctacctgatccacatggccatcgagatcctgaagcacggccccgacagcggcctgcagcccagctgcgacgtgaacaagagaagatgcttccccggcagcgaggagatctgcagcagcagcaagagaagcaaggaggaggtgggcatcaacaccgagaccagcagcgccgagagaaagagaagactgcccgtgtggttcgccaagggcagcgacaccagcaagaagctgatggacaagaccaagagaggcggcctgttcagctag

SEQ ID NO: 105267 - DNA, 738 bp, Artificial Sequence
  Description of Artificial Sequence: Synthetic coding sequence
atggcccaggaggagggcggcagcctgcccgaggtgagagccagagtgagagccgcccacggcatccccgacctggcccagaagctgcacttctacgacagatgggcccccgactacgaccaggacgtggccaccctgctgtacagagcccccagactggccgtggactgcctgacccaggccctgcccggccccccccacagcgccctgatcctggacgtggcctgcggcaccggcctggtggccgccgagctgagagcccccggcttcctgcagctgcacggcgtggacggcagccccggcatgctggagcaggcccaggcccccggcctgtaccagagactgagcctgtgcaccctgggccaggagcccctgcccagccccgagggcaccttcgacgccgtgctgatcgtgggcgccctgagcgacggccaggtgccctgcaacgccatccccgagctgcacgtgaccaagcccggcggcctggtgtgcctgaccaccagaaccaacagcagcaacctgcagtacaaggaggccctggaggccaccctggacagactggagcaggccggcatgtgggagggcctggtggcctggcccgtggacagactgtggaccgccggcagctggctgccccccagctggagatggtaccccgccagcctgcccagaatggccagcagccccgccctgagcacctgcaccgagagcggcagaagacccagactgagaaagtag

SEQ ID NO: 105268 - DNA, 798 bp, Artificial Sequence
  Description of Artificial Sequence: Synthetic coding sequence
atggaggccctgccccccgtgagaagcagcctgctgggcatcctgctgcaggtgaccagactgagcgtgctgctggtgcagaacagagaccacctgtacaacttcctgctgctgaagatcaacctgttcaaccactgggtgagcggcctggcccaggaggccagaggcagctgcaactggcaggcccacctgcccctgggcgccgccgcctgccccctgggccaggccctgtgggccggcctggccctgatccaggtgcccgtgtggctggtgctgcagggccccagactgatgtgggccggcatgtggggcagcaccaagggcctgggcctggccctgctgagcgcctgggagcagctgggcctgagcgtggccatctggaccgacctgttcctgagctgcctgcacggcctgatgctggtggccctgctgctggtggtggtgacctggagagtgtgccagaagagccactgcttcagactgggcagacagctgagcaaggccctgcaggtgaactgcgtggtgagaaagctgctggtgcagctgagaagactgtactggtgggtggagaccatgaccgccctgaccagctggcacctggcctacctgatcacctggaccacctgcctggccagccacctgctgcaggccgccttcgagcacaccacccagctggccgaggcccaggaggtggagccccaggaggtgagcggcagcagcctgctgcccagcctgagcgccagcagcgacagcgagagcggcaccgtgctgcccgagcaggagacccccagagagtag

SEQ ID NO: 105269 - DNA, 456 bp, Artificial Sequence
  Description of Artificial Sequence: Synthetic coding sequence
atgaccaacgaggagcccctgcccaagaaggtgagactgagcgagaccgacttcaaggtgatggccagagacgagctgatcctgagatggaagcagtacgaggcctacgtgcaggccctggagggcaagtacaccgacctgaacagcaacgacgtgaccggcctgagagagagcgaggagaagctgaagcagcagcagcaggagagcgccagaagagagaacatcctggtgatgagactggccaccaaggagcaggagatgcaggagtgcaccacccagatccagtacctgaagcaggtgcagcagcccagcgtggcccagctgagaagcaccatggtggaccccgccatcaacctgttcttcctgaagatgaagggcgagctggagcagaccaaggacaagctggagcaggcccagaacgagctgagcgcctggaagttcacccccgacagatag

SEQ ID NO: 105270 - DNA, 1191 bp, Artificial Sequence
  Description of Artificial Sequence: Synthetic coding sequence
atgaccaacgaggagcccctgcccaagaaggtgagactgagcgagaccgacttcaaggtgatggccagagacgagctgatcctgagatggaagcagtacgaggcctacgtgcaggccctggagggcaagtacaccgacctgaacagcaacgacgtgaccggcctgagagagagcgaggagaagctgaagcagcagcagcaggagagcgccagaagagagaacatcctggtgatgagactggccaccaaggagcaggagatgcaggagtgcaccacccagatccagtacctgaagcaggtgcagcagcccagcgtggcccagctgagaagcaccatggtggaccccgccatcaacctgttcttcctgaagatgaagggcgagctggagcagaccaaggacaagctggagcaggcccagaacgagctgagcgcctggaagttcacccccgacagccagaccggcaagaagctgatggccaagtgcagaatgctgatccaggagaaccaggagctgggcagacagctgagccagggcagaatcgcccagctggaggccgagctggccctgcagaagaagtacagcgaggagctgaagagcagccaggacgagctgaacgacttcatcatccagctggacgaggaggtggagggcatgcagagcaccatcctggtgctgcagcagcagctgaaggagaccagacagcagctggcccagtaccagcagcagcagagccaggccagcgcccccagcaccagcagaaccaccgccagcgagcccgtggagcagagcgaggccaccagcaaggactgcagcagactgaccaacggccccagcaacggcagcagcagcagacagagaaccagcggcagcggcttccacagagagggcaacaccaccgaggacgacttccccagcagccccggcaacggcaacaagagcagcaacagcagcgaggagagaaccggcagaggcggcagcggctacgtgaaccagctgagcgccggctacgagagcgtggacagccccaccggcagcgagaacagcctgacccaccagagcaacgacaccgacagcagccacgacccccaggaggagaaggccgtgagcggcaagggcaacagaaccgtgggcagcagacacgtgcagaacggcctggacagcagcgtgaacgtgcagggcagcgtgctgtag

SEQ ID NO: 105271 - DNA, 1083 bp, Artificial Sequence
  Description of Artificial Sequence: Synthetic coding sequence
atgaacgcccccctgggcggcatctggctgtggctgcccctgctgctgacctggctgacccccgaggtgaacagcagctggtggtacatgagagccaccggcggcagcagcagagtgatgtgcgacaacgtgcccggcctggtgagcagccagagacagctgtgccacagacaccccgacgtgatgagagccatcagccagggcgtggccgagtggaccgccgagtgccagcaccagttcagacagcacagatggaactgcaacaccctggacagagaccacagcctgttcggcagagtgctgctgagaagcagcagagagagcgccttcgtgtacgccatcagcagcgccggcgtggtgttcgccatcaccagagcctgcagccagggcgaggtgaagagctgcagctgcgaccccaagaagatgggcagcgccaaggacagcaagggcatcttcgactggggcggctgcagcgacaacatcgactacggcatcaagttcgccagagccttcgtggacgccaaggagagaaagggcaaggacgccagagccctgatgaacctgcacaacaacagagccggcagaaaggccgtgaagagattcctgaagcaggagtgcaagtgccacggcgtgagcggcagctgcaccctgagaacctgctggctggccatggccgacttcagaaagaccggcgactacctgtggagaaagtacaacggcgccatccaggtggtgatgaaccaggacggcaccggcttcaccgtggccaacgagagattcaagaagcccaccaagaacgacctggtgtacttcgagaacagccccgactactgcatcagagacagagaggccggcagcctgggcaccgccggcagagtgtgcaacctgaccagcagaggcatggacagctgcgaggtgatgtgctgcggcagaggctacgacaccagccacgtgaccagaatgaccaagtgcggctgcaagttccactggtgctgcgccgtgagatgccaggactgcctggaggccctggacgtgcacacctgcaaggcccccaagaacgccgactggaccaccgccacctag

SEQ ID NO: 105272 - DNA, 1113 bp, Artificial Sequence
  Description of Artificial Sequence: Synthetic coding sequence
atgggcctgtgggccctgctgcccggctgggtgagcgccaccctgctgctggccctggccgccctgcccgccgccctggccgccaacagcagcggcagatggtggggcatcgtgaacgtggccagcagcaccaacctgctgaccgacagcaagagcctgcagctggtgctggagcccagcctgcagctgctgagcagaaagcagagaagactgatcagacagaaccccggcatcctgcacagcgtgagcggcggcctgcagagcgccgtgagagagtgcaagtggcagttcagaaacagaagatggaactgccccaccgcccccggcccccacctgttcggcaagatcgtgaacagaggctgcagagagaccgccttcatcttcgccatcaccagcgccggcgtgacccacagcgtggccagaagctgcagcgagggcagcatcgagagctgcacctgcgactacagaagaagaggccccggcggccccgactggcactggggcggctgcagcgacaacatcgacttcggcagactgttcggcagagagttcgtggacagcggcgagaagggcagagacctgagattcctgatgaacctgcacaacaacgaggccggcagaaccaccgtgttcagcgagatgagacaggagtgcaagtgccacggcatgagcggcagctgcaccgtgagaacctgctggatgagactgcccaccctgagagccgtgggcgacgtgctgagagacagattcgacggcgccagcagagtgctgtacggcaacagaggcagcaacagagccagcagagccgagctgctgagactggagcccgaggaccccgcccacaagccccccagcccccacgacctggtgtacttcgagaagagccccaacttctgcacctacagcggcagactgggcaccgccggcaccgccggcagagcctgcaacagcagcagccccgccctggacggctgcgagctgctgtgctgcggcagaggccacagaaccagaacccagagagtgaccgagagatgcaactgcaccttccactggtgctgccacgtgagctgcagaaactgcacccacaccagagtgctgcacgagtgcctgtag

SEQ ID NO: 105273 - DNA, 588 bp, Artificial Sequence
  Description of Artificial Sequence: Synthetic coding sequence
tggcactggggcggctgcagcgacaacatcgacttcggcagactgttcggcagagagttcgtggacagcggcgagaagggcagagacctgagattcctgatgaacctgcacaacaacgaggccggcagaaccaccgtgttcagcgagatgagacaggagtgcaagtgccacggcatgagcggcagctgcaccgtgagaacctgctggatgagactgcccaccctgagagccgtgggcgacgtgctgagagacagattcgacggcgccagcagagtgctgtacggcaacagaggcagcaacagagccagcagagccgagctgctgagactggagcccgacctggtgtacttcgagaagagccccaacttctgcacctacagcggcagactgggcaccgccggcaccgccggcagagcctgcaacagcagcagccccgccctggacggctgcgagctgctgtgctgcggcagaggccacagaaccagaacccagagagtgaccgagagatgcaactgcaccttccactggtgctgccacgtgagctgcagaaactgcacccacaccagagtgctgcacgagtgcctgtag

SEQ ID NO: 105274 - DNA, 1254 bp, Artificial Sequence
  Description of Artificial Sequence: Synthetic coding sequence
atgggcagcgcccaccccagaccctggctgagactgagaccccagccccagcccagacccgccctgtgggtgctgctgttcttcctgctgctgctggccgccgccatgcccagaagcgcccccaacgacatcctggacctgagactgccccccgagcccgtgctgaacgccaacaccgtgtgcctgaccctgcccggcctgagcagaagacagatggaggtgtgcgtgagacaccccgacgtggccgccagcgccatccagggcatccagatcgccatccacgagtgccagcaccagttcagagaccagagatggaactgcagcagcctggagaccagaaacaagatcccctacgagagccccatcttcagcagaggcttcagagagagcgccttcgcctacgccatcgccgccgccggcgtggtgcacgccgtgagcaacgcctgcgccctgggcaagctgaaggcctgcggctgcgacgccagcagaagaggcgacgaggaggccttcagaagaaagctgcacagactgcagctggacgccctgcagagaggcaagggcctgagccacggcgtgcccgagcaccccgccctgcccaccgccagccccggcctgcaggacagctgggagtggggcggctgcagccccgacatgggcttcggcgagagattcagcaaggacttcctggacagcagagagccccacagagacatccacgccagaatgagactgcacaacaacagagtgggcagacaggccgtgatggagaacatgagaagaaagtgcaagtgccacggcaccagcggcagctgccagctgaagacctgctggcaggtgacccccgagttcagaaccgtgggcgccctgctgagaagcagattccacagagccaccctgatcagaccccacaacagaaacggcggccagctggagcccggccccgccggcgcccccagccccgcccccggcgcccccggccccagaagaagagccagccccgccgacctggtgtacttcgagaagagccccgacttctgcgagagagagcccagactggacagcgccggcaccgtgggcagactgtgcaacaagagcagcgccggcagcgacggctgcggcagcatgtgctgcggcagaggccacaacatcctgagacagaccagaagcgagagatgccactgcagattccactggtgctgcttcgtggtgtgcgaggagtgcagaatcaccgagtgggtgagcgtgtgcaagtag

SEQ ID NO: 105275 - DNA, 1170 bp, Artificial Sequence
  Description of Artificial Sequence: Synthetic coding sequence
atgctggaggagcccagacccagacccccccccagcggcctggccggcctgctgttcctggccctgtgcagcagagccctgagcaacgagatcctgggcctgaagctgcccggcgagccccccctgaccgccaacaccgtgtgcctgaccctgagcggcctgagcaagagacagctgggcctgtgcctgagaaaccccgacgtgaccgccagcgccctgcagggcctgcacatcgccgtgcacgagtgccagcaccagctgagagaccagagatggaactgcagcgccctggagggcggcggcagactgccccaccacagcgccatcctgaagagaggcttcagagagagcgccttcagcttcagcatgctggccgccggcgtgatgcacgccgtggccaccgcctgcagcctgggcaagctggtgagctgcggctgcggctggaagggcagcggcgagcaggacagactgagagccaagctgctgcagctgcaggccctgagcagaggcaagagcttcccccacagcctgcccagccccggccccggcagcagccccagccccggcccccaggacacctgggagtggggcggctgcaaccacgacatggacttcggcgagaagttcagcagagacttcctggacagcagagaggcccccagagacatccaggccagaatgagaatccacaacaacagagtgggcagacaggtggtgaccgagaacctgaagagaaagtgcaagtgccacggcaccagcggcagctgccagttcaagacctgctggagagccgcccccgagttcagagccgtgggcgccgccctgagagagagactgggcagagccatcttcatcgacacccacaacagaaacagcggcgccttccagcccagactgagacccagaagactgagcggcgagctggtgtacttcgagaagagccccgacttctgcgagagagaccccaccatgggcagccccggcaccagaggcagagcctgcaacaagaccagcagactgctggacggctgcggcagcctgtgctgcggcagaggccacaacgtgctgagacagaccagagtggagagatgccactgcagattccactggtgctgctacgtgctgtgcgacgagtgcaaggtgaccgagtgggtgaacgtgtgcaagtag

SEQ ID NO: 105276 - DNA, 576 bp, Artificial Sequence
  Description of Artificial Sequence: Synthetic coding sequence
atgctggaggagcccagacccagacccccccccagcggcctggccggcctgctgttcctggccctgtgcagcagagccctgagcaacgagatcctgggcctgaagctgcccggcgagccccccctgaccgccaacaccgtgtgcctgaccctgagcggcctgagcaagagacagctgggcctgtgcctgagaaaccccgacgtgaccgccagcgccctgcagggcctgcacatcgccgtgcacgagtgccagcaccagctgagagaccagagatggaactgcagcgccctggagggcggcggcagactgccccaccacagcgccatcctgaagagaggcttcagagagagcgccttcagcttcagcatgctggccgccggcgtgatgcacgccgtggccaccgcctgcagcctgggcaagctggtgagctgcggctgcggctggaagggcagcggcgagcaggacagactgagagccaagctgctgcagctgcaggccctgagcagaggcaagctgcccggcaccagcagacacgagtgcgagagcaccaccaccggctggggcgccagatggtag

SEQ ID NO: 105277 - DNA, 309 bp, Artificial Sequence
  Description of Artificial Sequence: Synthetic coding sequence
atgctggaggagcccagacccagacccccccccagcggcctggccggcctgctgttcctggccctgtgcagcagagccctgagcaacgagatcctgggcctgaagctgcccggcgagccccccctgaccgccaacaccgtgtgcctgaccctgagcggcctgagcaagagacagctgggcctgtgcctgagaaaccccgacgtgaccgccagcgccctgcagggcctgcacatcgccgtgcacgagtgccagcaccagctgagagaccagagatggaactgcagcgccctggagggcggcggcagatag

SEQ ID NO: 105278 - DNA, 354 bp, Artificial Sequence
  Description of Artificial Sequence: Synthetic coding sequence
atggccctggagaccgtgcccaaggacctgagacacctgagagcctgcctgctgtgcagcctggtgaagaccatcgaccagttcgagtacgacggctgcgacaactgcgacgcctacctgcagatgaagggcaacagagagatggtgtacgactgcaccagcagcagcttcgacggcatcatcgccatgatgagccccgaggacagctgggtgagcaagtggcagagagtgagcaacttcaagcccggcgtgtacgccgtgagcgtgaccggcagactgccccagggcatcgtgagagagctgaagagcagaggcgtggcctacaagagcagagacaccgccatcaagacctag

SEQ ID NO: 105279 - DNA, 1059 bp, Artificial Sequence
  Description of Artificial Sequence: Synthetic coding sequence
atggcccccctgggctacttcctgctgctgtgcagcctgaagcaggccctgggcagctaccccatctggtggagcctggccgtgggcccccagtacagcagcctgggcagccagcccatcctgtgcgccagcatccccggcctggtgcccaagcagctgagattctgcagaaactacgtggagatcatgcccagcgtggccgagggcatcaagatcggcatccaggagtgccagcaccagttcagaggcagaagatggaactgcaccaccgtgcacgacagcctggccatcttcggccccgtgctggacaaggccaccagagagagcgccttcgtgcacgccatcgccagcgccggcgtggccttcgccgtgaccagaagctgcgccgagggcaccgccgccatctgcggctgcagcagcagacaccagggcagccccggcaagggctggaagtggggcggctgcagcgaggacatcgagttcggcggcatggtgagcagagagttcgccgacgccagagagaacagacccgacgccagaagcgccatgaacagacacaacaacgaggccggcagacaggccatcgccagccacatgcacctgaagtgcaagtgccacggcctgagcggcagctgcgaggtgaagacctgctggtggagccagcccgacttcagagccatcggcgacttcctgaaggacaagtacgacagcgccagcgagatggtggtggagaagcacagagagagcagaggctgggtggagaccctgagacccagatacacctacttcaaggtgcccaccgagagagacctggtgtactacgaggccagccccaacttctgcgagcccaaccccgagaccggcagcttcggcaccagagacagaacctgcaacgtgagcagccacggcatcgacggctgcgacctgctgtgctgcggcagaggccacaacgccagagccgagagaagaagagagaagtgcagatgcgtgttccactggtgctgctacgtgagctgccaggagtgcaccagagtgtacgacgtgcacacctgcaagtag

SEQ ID NO: 105280 - DNA, 1158 bp, Artificial Sequence
  Description of Artificial Sequence: Synthetic coding sequence
atggcccccctgggctacttcctgctgctgtgcagcctgaagcaggccctgggcagctaccccatctggtggagcctggccgtgggcccccagtacagcagcctgggcagccagcccatcctgtgcgccagcatccccggcctggtgcccaagcagctgagattctgcagaaactacgtggagatcatgcccagcgtggccgagggcatcaagatcggcatccaggagtgccagcaccagttcagaggcagaagatggaactgcaccaccgtgcacgacagcctggccatcttcggccccgtgctggacaaggccaccagagagagcgccttcgtgcacgccatcgccagcgccggcgtggccttcgccgtgaccagaagctgcgccgagggcaccgccgccatctgcggctgcagcagcagacaccagggcagccccggcaagggctggaagtggggcggctgcagcgaggacatcgagttcggcggcatggtgagcagagagttcgccgacgccagagagaacagacccgacgccagaagcgccatgaacagacacaacaacgaggccggcagacaggccatcgccagccacatgcacctgaagtgcaagtgccacggcctgagcggcagctgcgaggtgaagacctgctggtggagccagcccgacttcagagccatcggcgacttcctgaaggacaagtacgacagcgccagcgagatggtggtggagaagcacagagagagcagaggctgggtggagaccctgagacccagatacacctacttcaaggtgcccaccgagagagacctggtgtactacgaggccagccccaacttctgcgagcccaaccccgagaccggcagcttcggcaccagagacagaacctgcaacgtgagcagccacggcatcgacggctgcgacctgctgtgctgcggcagaggccacaacgccagagccgagagaagaagagagaagtgcagatgcgtgttccactggtgctgctacgtgagctgccaggagtgcaccagagtgtacgacgtgcacacctgcaagaaccccggcagcagagccggcaacagcgcccaccagcccccccacccccagccccccgtgagattccacccccccctgagaagagccggcaaggtgccctag

SEQ ID NO: 105281 - DNA, 1056 bp, Artificial Sequence
  Description of Artificial Sequence: Synthetic coding sequence
atgagccccagaagctgcctgagaagcctgagactgctggtgttcgccgtgttcagcgccgccgccagcaactggctgtacctggccaagctgagcagcgtgggcagcatcagcgaggaggagacctgcgagaagctgaagggcctgatccagagacaggtgcagatgtgcaagagaaacctggaggtgatggacagcgtgagaagaggcgcccagctggccatcgaggagtgccagtaccagttcagaaacagaagatggaactgcagcaccctggacagcctgcccgtgttcggcaaggtggtgacccagggcaccagagaggccgccttcgtgtacgccatcagcagcgccggcgtggccttcgccgtgaccagagcctgcagcagcggcgagctggagaagtgcggctgcgacagaaccgtgcacggcgtgagcccccagggcttccagtggagcggctgcagcgacaacatcgcctacggcgtggccttcagccagagcttcgtggacgtgagagagagaagcaagggcgccagcagcagcagagccctgatgaacctgcacaacaacgaggccggcagaaaggccatcctgacccacatgagagtggagtgcaagtgccacggcgtgagcggcagctgcgaggtgaagacctgctggagagccgtgccccccttcagacaggtgggccacgccctgaaggagaagttcgacggcgccaccgaggtggagcccagaagagtgggcagcagcagagccctggtgcccagaaacgcccagttcaagccccacaccgacgaggacctggtgtacctggagcccagccccgacttctgcgagcaggacatgagaagcggcgtgctgggcaccagaggcagaacctgcaacaagaccagcaaggccatcgacggctgcgagctgctgtgctgcggcagaggcttccacaccgcccaggtggagctggccgagagatgcagctgcaagttccactggtgctgcttcgtgaagtgcagacagtgccagagactggtggagctgcacacctgcagatag

SEQ ID NO: 105282 - DNA, 528 bp, Artificial Sequence
  Description of Artificial Sequence: Synthetic coding sequence
atgagccccagaagctgcctgagaagcctgagactgctggtgttcgccgtgttcagcgccgccgccagcaactggctgtacctggccaagctgagcagcgtgggcagcatcagcgaggaggagacctgcgagaagctgaagggcctgatccagagacaggtgcagatgtgcaagagaaacctggaggtgatggacagcgtgagaagaggcgcccagctggccatcgaggagtgccagtaccagttcagaaacagaagatggaactgcagcaccctggacagcctgcccgtgttcggcaaggtggtgacccagggcggcaaggcctggcacggcggcgacagcggctgccacctgctgaccgagagcagaagcggcgagagaacccagagaagaaaggagggcggcagcctgggccagtgctggcccgaggccatcgtgggcacccaggaccccatgagaagccccccctacctgtggggcagaaaccagggcggcacccacaccggcagcgccagcgagggccactag

SEQ ID NO: 105283 - DNA, 453 bp, Artificial Sequence
  Description of Artificial Sequence: Synthetic coding sequence
tgatacctggccaagctgagcagcgtgggcagcatcagcgaggaggagacctgcgagaagctgaagggcctgatccagagacaggtgcagatgtgcaagagaaacctggaggtgatggacagcgtgagaagaggcgcccagctggccatcgaggagtgccagtaccagttcagaaacagaagatggaactgcagcaccctggacagcctgcccgtgttcggcaaggtggtgacccagggcggcaaggcctggcacggcggcgacagcggctgccacctgctgaccgagagcagaagcggcgagagaacccagagaagaaaggagggcggcagcctgggccagtgctggcccgaggccatcgtgggcacccaggaccccatgagaagccccccctacctgtggggcagaaaccagggcggcacccacaccggcagcgccagcgagggccactag

SEQ ID NO: 105284 - DNA, 159 bp, Artificial Sequence
  Description of Artificial Sequence: Synthetic coding sequence
atgtgcaagagaaacctggaggtgatggacagcgtgagaagaggcgcccagctggccatcgaggagtgccagtaccagttcagaaacagaagatggaactgcagcaccctggacagcctgcccgtgttcggcaaggtggtgacccagggcggcaagtag

SEQ ID NO: 105285 - DNA, 891 bp, Artificial Sequence
  Description of Artificial Sequence: Synthetic coding sequence
atgtgcaagagaaacctggaggtgatggacagcgtgagaagaggcgcccagctggccatcgaggagtgccagtaccagttcagaaacagaagatggaactgcagcaccctggacagcctgcccgtgttcggcaaggtggtgacccagggcaccagagaggccgccttcgtgtacgccatcagcagcgccggcgtggccttcgccgtgaccagagcctgcagcagcggcgagctggagaagtgcggctgcgacagaaccgtgcacggcgtgagcccccagggcttccagtggagcggctgcagcgacaacatcgcctacggcgtggccttcagccagagcttcgtggacgtgagagagagaagcaagggcgccagcagcagcagagccctgatgaacctgcacaacaacgaggccggcagaaaggccatcctgacccacatgagagtggagtgcaagtgccacggcgtgagcggcagctgcgaggtgaagacctgctggagagccgtgccccccttcagacaggtgggccacgccctgaaggagaagttcgacggcgccaccgaggtggagcccagaagagtgggcagcagcagagccctggtgcccagaaacgcccagttcaagccccacaccgacgaggacctggtgtacctggagcccagccccgacttctgcgagcaggacatgagaagcggcgtgctgggcaccagaggcagaacctgcaacaagaccagcaaggccatcgacggctgcgagctgctgtgctgcggcagaggcttccacaccgcccaggtggagctggccgagagatgcagctgcaagttccactggtgctgcttcgtgaagtgcagacagtgccagagactggtggagctgcacacctgcagatag

SEQ ID NO: 105286 - DNA, 1710 bp, Artificial Sequence
  Description of Artificial Sequence: Synthetic coding sequence
atgaaggtgctgctgagactgatctgcttcatcgccctgctgatcagcagcctggaggccgacaagtgcaaggagagagaggagaagatcatcctggtgagcagcgccaacgagatcgacgtgagaccctgccccctgaaccccaacgagcacaagggcaccatcacctggtacaaggacgacagcaagacccccgtgagcaccgagcaggccagcagaatccaccagcacaaggagaagctgtggttcgtgcccgccaaggtggaggacagcggccactactactgcgtggtgagaaacagcagctactgcctgagaatcaagatcagcgccaagttcgtggagaacgagcccaacctgtgctacaacgcccaggccatcttcaagcagaagctgcccgtggccggcgacggcggcctggtgtgcccctacatggagttcttcaagaacgagaacaacgagctgcccaagctgcagtggtacaaggactgcaagcccctgctgctggacaacatccacttcagcggcgtgaaggacagactgatcgtgatgaacgtggccgagaagcacagaggcaactacacctgccacgccagctacacctacctgggcaagcagtaccccatcaccagagtgatcgagttcatcaccctggaggagaacaagcccaccagacccgtgatcgtgagccccgccaacgagaccatggaggtggacctgggcagccagatccagctgatctgcaacgtgaccggccagctgagcgacatcgcctactggaagtggaacggcagcgtgatcgacgaggacgaccccgtgctgggcgaggactactacagcgtggagaaccccgccaacaagagaagaagcaccctgatcaccgtgctgaacatcagcgagatcgagagcagattctacaagcaccccttcacctgcttcgccaagaacacccacggcatcgacgccgcctacatccagctgatctaccccgtgaccaacttccagaagcacatgatcggcatctgcgtgaccctgaccgtgatcatcgtgtgcagcgtgttcatctacaagatcttcaagatcgacatcgtgctgtggtacagagacagctgctacgacttcctgcccatcaaggccagcgacggcaagacctacgacgcctacatcctgtaccccaagaccgtgggcgagggcagcaccagcgactgcgacatcttcgtgttcaaggtgctgcccgaggtgctggagaagcagtgcggctacaagctgttcatctacggcagagacgactacgtgggcgaggacatcgtggaggtgatcaacgagaacgtgaagaagagcagaagactgatcatcatcctggtgagagagaccagcggcttcagctggctgggcggcagcagcgaggagcagatcgccatgtacaacgccctggtgcaggacggcatcaaggtggtgctgctggagctggagaagatccaggactacgagaagatgcccgagagcatcaagttcatcaagcagaagcacggcgccatcagatggagcggcgacttcacccagggcccccagagcgccaagaccagattctggaagaacgtgagataccacatgcccgtgcagagaagaagccccagcagcaagcaccagctgctgagccccgccaccaaggagaagctgcagagagaggcccacgtgcccctgggctag

SEQ ID NO: 105287 - DNA, 1050 bp, Artificial Sequence
  Description of Artificial Sequence: Synthetic coding sequence
atgaacagaaaggccagaagatgcctgggccacctgttcctgagcctgggcatggtgtacctgagaatcggcggcttcagcagcgtggtggccctgggcgccagcatcatctgcaacaagatccccggcctggcccccagacagagagccatctgccagagcagacccgacgccatcatcgtgatcggcgagggcagccagatgggcctggacgagtgccagttccagttcagaaacggcagatggaactgcagcgccctgggcgagagaaccgtgttcggcaaggagctgaaggtgggcagcagagaggccgccttcacctacgccatcatcgccgccggcgtggcccacgccatcaccgccgcctgcacccagggcaacctgagcgactgcggctgcgacaaggagaagcagggccagtaccacagagacgagggctggaagtggggcggctgcagcgccgacatcagatacggcatcggcttcgccaaggtgttcgtggacgccagagagatcaagcagaacgccagaaccctgatgaacctgcacaacaacgaggccggcagaaagatcctggaggagaacatgaagctggagtgcaagtgccacggcgtgagcggcagctgcaccaccaagacctgctggaccaccctgccccagttcagagagctgggctacgtgctgaaggacaagtacaacgaggccgtgcacgtggagcccgtgagagccagcagaaacaagagacccaccttcctgaagatcaagaagcccctgagctacagaaagcccatggacaccgacctggtgtacatcgagaagagccccaactactgcgaggaggaccccgtgaccggcagcgtgggcacccagggcagagcctgcaacaagaccgccccccaggccagcggctgcgacctgatgtgctgcggcagaggctacaacacccaccagtacgccagagtgtggcagtgcaactgcaagttccactggtgctgctacgtgaagtgcaacacctgcagcgagagaaccgagatgtacacctgcaagtag

SEQ ID NO: 105288 - DNA, 1050 bp, Artificial Sequence
  Description of Artificial Sequence: Synthetic coding sequence
atgcacagaaacttcagaaagtggatcttctacgtgttcctgtgcttcggcgtgctgtacgtgaagctgggcgccctgagcagcgtggtggccctgggcgccaacatcatctgcaacaagatccccggcctggcccccagacagagagccatctgccagagcagacccgacgccatcatcgtgatcggcgagggcgcccagatgggcatcaacgagtgccagtaccagttcagattcggcagatggaactgcagcgccctgggcgagaagaccgtgttcggccaggagctgagagtgggcagcagagaggccgccttcacctacgccatcaccgccgccggcgtggcccacgccgtgaccgccgcctgcagccagggcaacctgagcaactgcggctgcgacagagagaagcagggctactacaaccaggccgagggctggaagtggggcggctgcagcgccgacgtgagatacggcatcgacttcagcagaagattcgtggacgccagagagatcaagaagaacgccagaagactgatgaacctgcacaacaacgaggccggcagaaaggtgctggaggacagaatgcagctggagtgcaagtgccacggcgtgagcggcagctgcaccaccaagacctgctggaccaccctgcccaagttcagagaggtgggccacctgctgaaggagaagtacaacgccgccgtgcaggtggaggtggtgagagccagcagactgagacagcccaccttcctgagaatcaagcagctgagaagctaccagaagcccatggagaccgacctggtgtacatcgagaagagccccaactactgcgaggaggacgccgccaccggcagcgtgggcacccagggcagactgtgcaacagaaccagccccggcgccgacggctgcgacaccatgtgctgcggcagaggctacaacacccaccagtacaccaaggtgtggcagtgcaactgcaagttccactggtgctgcttcgtgaagtgcaacacctgcagcgagagaaccgaggtgttcacctgcaagtag

SEQ ID NO: 105289 - DNA, 1062 bp, Artificial Sequence
  Description of Artificial Sequence: Synthetic coding sequence
atgctgctgctgagccccagaagcgccctggtgagcgtgtactgcccccagatcttcctgctgctgagcagcggcagctacctggccctgagcagcgtggtggccctgggcgccaacatcatctgcaacaagatccccggcctggcccccagacagagagccatctgccagagcagacccgacgccatcatcgtgatcggcgagggcgcccagatgggcatcaacgagtgccagtaccagttcagattcggcagatggaactgcagcgccctgggcgagaagaccgtgttcggccaggagctgagagtgggcagcagagaggccgccttcacctacgccatcaccgccgccggcgtggcccacgccgtgaccgccgcctgcagccagggcaacctgagcaactgcggctgcgacagagagaagcagggctactacaaccaggccgagggctggaagtggggcggctgcagcgccgacgtgagatacggcatcgacttcagcagaagattcgtggacgccagagagatcaagaagaacgccagaagactgatgaacctgcacaacaacgaggccggcagaaaggtgctggaggacagaatgcagctggagtgcaagtgccacggcgtgagcggcagctgcaccaccaagacctgctggaccaccctgcccaagttcagagaggtgggccacctgctgaaggagaagtacaacgccgccgtgcaggtggaggtggtgagagccagcagactgagacagcccaccttcctgagaatcaagcagctgagaagctaccagaagcccatggagaccgacctggtgtacatcgagaagagccccaactactgcgaggaggacgccgccaccggcagcgtgggcacccagggcagactgtgcaacagaaccagccccggcgccgacggctgcgacaccatgtgctgcggcagaggctacaacacccaccagtacaccaaggtgtggcagtgcaactgcaagttccactggtgctgcttcgtgaagtgcaacacctgcagcgagagaaccgaggtgttcacctgcaagtag

SEQ ID NO: 105290 - DNA, 618 bp, Artificial Sequence
  Description of Artificial Sequence: Synthetic coding sequence
atgcacagaaacttcagaaagtggatcttctacgtgttcctgtgcttcggcgtgctgtacgtgaagctgggcgccctgagcagcgtggtggccctgggcgccaacatcatctgcaacaagatccccggcctggcccccagacagagagccatctgccagagcagacccgacgccatcatcgtgatcggcgagggcgcccagatgggcatcaacgagtgccagtaccagttcagattcggcagatggaactgcagcgccctgggcgagaagaccgtgttcggccaggagctgagagtgggcagcagagaggccgccttcacctacgccatcaccgccgccggcgtggcccacgccgtgaccgccgcctgcagccagggcaacctgagcaactgcggctgcgacagagagaagcagggctactacaaccaggccgagggctggaagtggggcggctgcagcgccgacgtgagatacggcatcgacttcagcagaagattcgtggacgccagagagatcaagaagaacgccagaagactgatgaacctgcacaacaacgaggccggcagaaagggcctgctgggccagcccagagtgaccagcagccccctgttcccctag

SEQ ID NO: 105291 - DNA, 1002 bp, Artificial Sequence
  Description of Artificial Sequence: Synthetic coding sequence
atgagcgccccccccttctacagagccctgagcagcgtggtggccctgggcgccaacatcatctgcaacaagatccccggcctggcccccagacagagagccatctgccagagcagacccgacgccatcatcgtgatcggcgagggcgcccagatgggcatcaacgagtgccagtaccagttcagattcggcagatggaactgcagcgccctgggcgagaagaccgtgttcggccaggagctgagagtgggcagcagagaggccgccttcacctacgccatcaccgccgccggcgtggcccacgccgtgaccgccgcctgcagccagggcaacctgagcaactgcggctgcgacagagagaagcagggctactacaaccaggccgagggctggaagtggggcggctgcagcgccgacgtgagatacggcatcgacttcagcagaagattcgtggacgccagagagatcaagaagaacgccagaagactgatgaacctgcacaacaacgaggccggcagaaaggtgctggaggacagaatgcagctggagtgcaagtgccacggcgtgagcggcagctgcaccaccaagacctgctggaccaccctgcccaagttcagagaggtgggccacctgctgaaggagaagtacaacgccgccgtgcaggtggaggtggtgagagccagcagactgagacagcccaccttcctgagaatcaagcagctgagaagctaccagaagcccatggagaccgacctggtgtacatcgagaagagccccaactactgcgaggaggacgccgccaccggcagcgtgggcacccagggcagactgtgcaacagaaccagccccggcgccgacggctgcgacaccatgtgctgcggcagaggctacaacacccaccagtacaccaaggtgtggcagtgcaactgcaagttccactggtgctgcttcgtgaagtgcaacacctgcagcgagagaaccgaggtgttcacctgcaagtag

SEQ ID NO: 105292 - DNA, 174 bp, Artificial Sequence
  Description of Artificial Sequence: Synthetic coding sequence
atgggcatcaacgagtgccagtaccagttcagattcggcagatggaactgcagcgccctgggcgagaagaccgtgttcggccaggagctgagagtgggcagcagagaggccgccttcacctacgccatcaccgccgccggcgtggcccacgccgtgaccgccgcctgcagctag

SEQ ID NO: 105293 - DNA, 1056 bp, Artificial Sequence
  Description of Artificial Sequence: Synthetic coding sequence
atgttcctgagcaagcccagcgtgtacatctgcctgttcacctgcgtgctgcagctgagccacagctggagcgtgaacaacttcctgatgaccggccccaaggcctacctgatctacagcagcagcgtggccgccggcgcccagagcggcatcgaggagtgcaagtaccagttcgcctgggacagatggaactgccccgagagagccctgcagctgagcagccacggcggcctgagaagcgccaacagagagaccgccttcgtgcacgccatcagcagcgccggcgtgatgtacaccctgaccagaaactgcagcctgggcgacttcgacaactgcggctgcgacgacagcagaaacggccagctgggcggccagggctggctgtggggcggctgcagcgacaacgtgggcttcggcgaggccatcagcaagcagttcgtggacgccctggagaccggccaggacgccagagccgccatgaacctgcacaacaacgaggccggcagaaaggccgtgaagggcaccatgaagagaacctgcaagtgccacggcgtgagcggcagctgcaccacccagacctgctggctgcagctgcccgagttcagagaggtgggcgcccacctgaaggagaagtaccacgccgccctgaaggtggacctgctgcagggcgccggcaacagcgccgccggcagaggcgccatcgccgacaccttcagaagcatcagcaccagagagctggtgcacctggaggacagccccgactactgcctggagaacaagaccctgggcctgctgggcaccgagggcagagagtgcctgagaagaggcagagccctgggcagatgggagagaagaagctgcagaagactgtgcggcgactgcggcctggccgtggaggagagaagagccgagaccgtgagcagctgcaactgcaagttccactggtgctgcgccgtgagatgcgagcagtgcagaagaagagtgaccaagtacttctgcagcagagccgagagacccagaggcggcgccgcccacaagcccggcagaaagccctag

SEQ ID NO: 105294 - DNA, 1209 bp, Artificial Sequence
  Description of Artificial Sequence: Synthetic coding sequence
atggacctggacagagccagcctggacctgatgatcagactgctggagctggagcaggacgccagcagcgccaagctgctgaacgagaaggacatgaacaagatcaaggagaagatcagaagactgtgcgagaccgtgcacaacaagcacctggacctggagaacatcaccaccggccacctggccatggagaccctgctgagcctgaccagcaagagagccggcgactggttcaaggaggagctgagactgctgggcggcctggaccacatcgtggacaaggtgaaggagtgcgtggaccacctgagcagagacgaggacgaggagaagctggtggccagcctgtggggcgccgagagatgcctgagagtgctggagagcgtgaccgtgcacaaccccgagaaccagagctacctgatcgcctacaaggacagccagctgatcgtgagcagcgccaaggccctgcagcactgcgaggagctgatccagcagtacaacagagccgaggacagcatctgcctggccgacagcaagcccctgccccaccagaacgtgaccaaccacgtgggcaaggccgtggaggactgcatgagagccatcatcggcgtgctgctgaacctgaccaacgacaacgagtggggcagcaccaagaccggcgagcaggacggcctgatcggcaccgccctgaactgcgtgctgcaggtgcccaagtacctgccccaggagcagagattcgacatcagagtgctgctgttcctggagagagagagagccgcccagctggccgagagcaagaccgacgagctgatcaaggacgcccccaccacccagcacgacaagagcggcgagtggcaggagaccagcggcgagatccagtgggtgagcaccgagaagaccgacggcaccgaggagaagcacaagaaggaggaggaggacgaggagctggacctgaacaaggccctgcagcacgccggcaagcacatggaggactgcatcgtggccagctacaccgccctgctgctgggctgcctgtgccaggagagccccatcaacgtgaccaccgtgagagagtacctgcccgagggcgacttcagcatcatgaccgagatgctgaagaagttcctgagcttcatgaacctgacctgcgccgtgggcaccaccggccagaagagcatcagcagagtgatcgagtacctggagcactgctag

SEQ ID NO: 105295 - DNA, 3573 bp, Artificial Sequence
  Description of Artificial Sequence: Synthetic coding sequence
atgaccagcagattcggcaagacctacagcagaaagggcggcaacggcagcagcaagttcgacgaggtgttcagcaacaagagaaccaccctgagcaccaagtggggcgagaccaccttcatggccaagctgggccagaagagacccaacttcaagcccgacatccaggagatccccaagaagcccaaggtggaggaggagagcaccggcgaccccttcggcttcgacagcgacgacgagagcctgcccgtgagcagcaagaacctggcccaggtgaagtgcagcagctacagcgagagcagcgaggccgcccagctggaggaggtgaccagcgtgctggaggccaacagcaagatcagccacgtggtggtggaggacaccgtggtgagcgacaagtgcttccccctggaggacaccctgctgggcaaggagaagagcaccaacagaatcgtggaggacgacgccagcatcagcagctgcaacaagctgatcaccagcgacaaggtggagaacttccacgaggagcacgagaagaacagccaccacatccacaagaacgccgacgacagcaccaagaagcccaacgccgagaccaccgtggccagcgagatcaaggagaccaacgacacctggaacagccagttcggcaagagacccgagagccccagcgagatcagccccatcaagggcagcgtgagaaccggcctgttcgagtgggacaacgacttcgaggacatcagaagcgaggactgcatcctgagcctggacagcgaccccctgctggagatgaaggacgacgacttcaagaacagactggagaacctgaacgaggccatcgaggaggacatcgtgcagagcgtgctgagacccaccaactgcagaacctactgcagagccaacaagaccaagagcagccagggcgccagcaacttcgacaagctgatggacggcaccagccaggccctggccaaggccaacagcgagagcagcaaggacggcctgaaccaggccaagaagggcggcgtgagctgcggcaccagcttcagaggcaccgtgggcagaaccagagactacaccgtgctgcaccccagctgcctgagcgtgtgcaacgtgaccatccaggacaccatggagagaagcatggacgagttcaccgccagcacccccgccgacctgggcgaggccggcagactgagaaagaaggccgacatcgccaccagcaagaccaccaccagattcagacccagcaacaccaagagcaagaaggacgtgaagctggagttcttcggcttcgaggaccacgagaccggcggcgacgagggcggcagcggcagcagcaactacaagatcaagtacttcggcttcgacgacctgagcgagagcgaggacgacgaggacgacgactgccaggtggagagaaagaccagcaagaagagaaccaagaccgcccccagccccagcctgcagcccccccccgagagcaacgacaacagccaggacagccagagcggcaccaacaacgccgagaacctggacttcaccgaggacctgcccggcgtgcccgagagcgtgaagaagcccatcaacaagcagggcgacaagagcaaggagaacaccagaaagatcttcagcggccccaagagaagccccaccaaggccgtgtacaacgccagacactggaaccaccccgacagcgaggagctgcccggcccccccgtggtgaagccccagagcgtgaccgtgagactgagcagcaaggagcccaaccagaaggacgacggcgtgttcaaggcccccgccccccccagcaaggtgatcaagaccgtgaccatccccacccagccctaccaggacatcgtgaccgccctgaagtgcagaagagaggacaaggagctgtacaccgtggtgcagcacgtgaagcacttcaacgacgtggtggagttcggcgagaaccaggagttcaccgacgacatcgagtacctgctgagcggcctgaagagcacccagcccctgaacaccagatgcctgagcgtgatcagcctggccaccaagtgcgccatgcccagcttcagaatgcacctgagagcccacggcatggtggccatggtgttcaagaccctggacgacagccagcaccaccagaacctgagcctgtgcaccgccgccctgatgtacatcctgagcagagacagactgaacatggacctggacagagccagcctggacctgatgatcagactgctggagctggagcaggacgccagcagcgccaagctgctgaacgagaaggacatgaacaagatcaaggagaagatcagaagactgtgcgagaccgtgcacaacaagcacctggacctggagaacatcaccaccggccacctggccatggagaccctgctgagcctgaccagcaagagagccggcgactggttcaaggaggagctgagactgctgggcggcctggaccacatcgtggacaaggtgaaggagtgcgtggaccacctgagcagagacgaggacgaggagaagctggtggccagcctgtggggcgccgagagatgcctgagagtgctggagagcgtgaccgtgcacaaccccgagaaccagagctacctgatcgcctacaaggacagccagctgatcgtgagcagcgccaaggccctgcagcactgcgaggagctgatccagcagtacaacagagccgaggacagcatctgcctggccgacagcaagcccctgccccaccagaacgtgaccaaccacgtgggcaaggccgtggaggactgcatgagagccatcatcggcgtgctgctgaacctgaccaacgacaacgagtggggcagcaccaagaccggcgagcaggacggcctgatcggcaccgccctgaactgcgtgctgcaggtgcccaagtacctgccccaggagcagagattcgacatcagagtgctgggcctgggcctgctgatcaacctggtggagtacagcgccagaaacagacactgcctggtgaacatggagaccagctgcagcttcgacagcagcatctgcagcggcgagggcgacgacagcctgagaatcggcggccaggtgcacgccgtgcaggccctggtgcagctgttcctggagagagagagagccgcccagctggccgagagcaagaccgacgagctgatcaaggacgcccccaccacccagcacgacaagagcggcgagtggcaggagaccagcggcgagatccagtgggtgagcaccgagaagaccgacggcaccgaggagaagcacaagaaggaggaggaggacgaggagctggacctgaacaaggccctgcagcacgccggcaagcacatggaggactgcatcgtggccagctacaccgccctgctgctgggctgcctgtgccaggagagccccatcaacgtgaccaccgtgagagagtacctgcccgagggcgacttcagcatcatgaccgagatgctgaagaagttcctgagcttcatgaacctgacctgcgccgtgggcaccaccggccagaagagcatcagcagagtgatcgagtacctggagcactgctag

SEQ ID NO: 105296 - DNA, 3828 bp, Artificial Sequence
  Description of Artificial Sequence: Synthetic coding sequence
atggtgcagggccccgtgcagacccccgccctgaccatccacagaagaaagagaagaagaagctgcccccccaacagagccagctacctgcccaaggccgagagcctggccagcctgggcagccacctgcccgccctgctgagcagagccagagtgcccagaccccccgccggcagaagagagagagagagaagaagaagacccgtggccaaggcccccgccagactgagaggcgagtacgagaccggcgtgaagatgaccagcagattcggcaagacctacagcagaaagggcggcaacggcagcagcaagttcgacgaggtgttcagcaacaagagaaccaccctgagcaccaagtggggcgagaccaccttcatggccaagctgggccagaagagacccaacttcaagcccgacatccaggagatccccaagaagcccaaggtggaggaggagagcaccggcgaccccttcggcttcgacagcgacgacgagagcctgcccgtgagcagcaagaacctggcccaggtgaagtgcagcagctacagcgagagcagcgaggccgcccagctggaggaggtgaccagcgtgctggaggccaacagcaagatcagccacgtggtggtggaggacaccgtggtgagcgacaagtgcttccccctggaggacaccctgctgggcaaggagaagagcaccaacagaatcgtggaggacgacgccagcatcagcagctgcaacaagctgatcaccagcgacaaggtggagaacttccacgaggagcacgagaagaacagccaccacatccacaagaacgccgacgacagcaccaagaagcccaacgccgagaccaccgtggccagcgagatcaaggagaccaacgacacctggaacagccagttcggcaagagacccgagagccccagcgagatcagccccatcaagggcagcgtgagaaccggcctgttcgagtgggacaacgacttcgaggacatcagaagcgaggactgcatcctgagcctggacagcgaccccctgctggagatgaaggacgacgacttcaagaacagactggagaacctgaacgaggccatcgaggaggacatcgtgcagagcgtgctgagacccaccaactgcagaacctactgcagagccaacaagaccaagagcagccagggcgccagcaacttcgacaagctgatggacggcaccagccaggccctggccaaggccaacagcgagagcagcaaggacggcctgaaccaggccaagaagggcggcgtgagctgcggcaccagcttcagaggcaccgtgggcagaaccagagactacaccgtgctgcaccccagctgcctgagcgtgtgcaacgtgaccatccaggacaccatggagagaagcatggacgagttcaccgccagcacccccgccgacctgggcgaggccggcagactgagaaagaaggccgacatcgccaccagcaagaccaccaccagattcagacccagcaacaccaagagcaagaaggacgtgaagctggagttcttcggcttcgaggaccacgagaccggcggcgacgagggcggcagcggcagcagcaactacaagatcaagtacttcggcttcgacgacctgagcgagagcgaggacgacgaggacgacgactgccaggtggagagaaagaccagcaagaagagaaccaagaccgcccccagccccagcctgcagcccccccccgagagcaacgacaacagccaggacagccagagcggcaccaacaacgccgagaacctggacttcaccgaggacctgcccggcgtgcccgagagcgtgaagaagcccatcaacaagcagggcgacaagagcaaggagaacaccagaaagatcttcagcggccccaagagaagccccaccaaggccgtgtacaacgccagacactggaaccaccccgacagcgaggagctgcccggcccccccgtggtgaagccccagagcgtgaccgtgagactgagcagcaaggagcccaaccagaaggacgacggcgtgttcaaggcccccgccccccccagcaaggtgatcaagaccgtgaccatccccacccagccctaccaggacatcgtgaccgccctgaagtgcagaagagaggacaaggagctgtacaccgtggtgcagcacgtgaagcacttcaacgacgtggtggagttcggcgagaaccaggagttcaccgacgacatcgagtacctgctgagcggcctgaagagcacccagcccctgaacaccagatgcctgagcgtgatcagcctggccaccaagtgcgccatgcccagcttcagaatgcacctgagagcccacggcatggtggccatggtgttcaagaccctggacgacagccagcaccaccagaacctgagcctgtgcaccgccgccctgatgtacatcctgagcagagacagactgaacatggacctggacagagccagcctggacctgatgatcagactgctggagctggagcaggacgccagcagcgccaagctgctgaacgagaaggacatgaacaagatcaaggagaagatcagaagactgtgcgagaccgtgcacaacaagcacctggacctggagaacatcaccaccggccacctggccatggagaccctgctgagcctgaccagcaagagagccggcgactggttcaaggaggagctgagactgctgggcggcctggaccacatcgtggacaaggtgaaggagtgcgtggaccacctgagcagagacgaggacgaggagaagctggtggccagcctgtggggcgccgagagatgcctgagagtgctggagagcgtgaccgtgcacaaccccgagaaccagagctacctgatcgcctacaaggacagccagctgatcgtgagcagcgccaaggccctgcagcactgcgaggagctgatccagcagtacaacagagccgaggacagcatctgcctggccgacagcaagcccctgccccaccagaacgtgaccaaccacgtgggcaaggccgtggaggactgcatgagagccatcatcggcgtgctgctgaacctgaccaacgacaacgagtggggcagcaccaagaccggcgagcaggacggcctgatcggcaccgccctgaactgcgtgctgcaggtgcccaagtacctgccccaggagcagagattcgacatcagagtgctgggcctgggcctgctgatcaacctggtggagtacagcgccagaaacagacactgcctggtgaacatggagaccagctgcagcttcgacagcagcatctgcagcggcgagggcgacgacagcctgagaatcggcggccaggtgcacgccgtgcaggccctggtgcagctgttcctggagagagagagagccgcccagctggccgagagcaagaccgacgagctgatcaaggacgcccccaccacccagcacgacaagagcggcgagtggcaggagaccagcggcgagatccagtgggtgagcaccgagaagaccgacggcaccgaggagaagcacaagaaggaggaggaggacgaggagctggacctgaacaaggccctgcagcacgccggcaagcacatggaggactgcatcgtggccagctacaccgccctgctgctgggctgcctgtgccaggagagccccatcaacgtgaccaccgtgagagagtacctgcccgagggcgacttcagcatcatgaccgagatgctgaagaagttcctgagcttcatgaacctgacctgcgccgtgggcaccaccggccagaagagcatcagcagagtgatcgagtacctggagcactgctag

SEQ ID NO: 105297 - DNA, 1209 bp, Artificial Sequence; identical to SEQ ID NO: 105294
  Description of Artificial Sequence: Synthetic coding sequence

SEQ ID NO: 105298 - DNA, 3828 bp, Artificial Sequence; identical to SEQ ID NO: 105296
  Description of Artificial Sequence: Synthetic coding sequence

SEQ ID NO: 105299 - DNA, 1509 bp, Artificial Sequence
  Description of Artificial Sequence: Synthetic coding sequence
atgagcggcggccccatgggcggcagacccggcggcagaggcgcccccgccgtgcagcagaacatccccagcaccctgctgcaggaccacgagaaccagagactgttcgagatgctgggcagaaagtgcctgaccctggccaccgccgtggtgcagctgtacctggccctgccccccggcgccgagcactggaccaaggagcactgcggcgccgtgtgcttcgtgaaggacaacccccagaagagctacttcatcagactgtacggcctgcaggccggcagactgctgtgggagcaggagctgtacagccagctggtgtacagcacccccacccccttcttccacaccttcgccggcgacgactgccaggccggcctgaacttcgccgacgaggacgaggcccaggccttcagagccctggtgcaggagaagatccagaagagaaaccagagacagagcggcgacagaagacagctgccccccccccccacccccgccaacgaggagagaagaggcggcctgccccccctgcccctgcaccccggcggcgaccagggcggcccccccgtgggccccctgagcctgggcctggccaccgtggacatccagaaccccgacatcaccagcagcagatacagaggcctgcccgcccccggccccagccccgccgacaagaagagaagcggcaagaagaagatcagcaaggccgacatcggcgcccccagcggcttcaagcacgtgagccacgtgggctgggacccccagaacggcttcgacgtgaacaacctggaccccgacctgagaagcctgttcagcagagccggcatcagcgaggcccagctgaccgacgccgagaccagcaagctgatctacgacttcatcgaggaccagggcggcctggaggccgtgagacaggagatgagaagacaggagcccctgccccccccccccccccccagcagaggcggcaaccagctgcccagaccccccatcgtgggcggcaacaagggcagaagcggccccctgccccccgtgcccctgggcatcgccccccccccccccacccccagaggcccccccccccccggcagaggcggccccccccccccccccccccccgccaccggcagaagcggccccctgcccccccccccccccggcgccggcggcccccccatgcccccccccccccccccccccccccccccccccagcagcggcaacggccccgcccccccccccctgccccccgccctggtgcccgccggcggcctggcccccggcggcggcagaggcgccctgctggaccagatcagacagggcatccagctgaacaagacccccggcgcccccgagagcagcgccctgcagccccccccccagagcagcgagggcctggtgggcgccctgatgcacgtgatgcagaagagaagcagagccatccacagcagcgacgagggcgaggaccaggccggcgacgaggacgaggacgacgagtgggacgactag

SEQ ID NO: 105300 - DNA, 654 bp, Artificial Sequence
  Description of Artificial Sequence: Synthetic coding sequence
atgagcggcggccccatgggcggcagacccggcggcagaggcgcccccgccgtgcagcagaacatccccagcaccctgctgcaggaccacgagaaccagagactgttcgagatgctgggcagaaagtgcctgaccctggccaccgccgtggtgcagctgtacctggccctgccccccggcgccgagcactggaccaaggagcactgcggcgccgtgtgcttcgtgaaggacaacccccagaagagctacttcatcagactgtacggcctgcaggccggcagactgctgtgggagcaggagctgtacagccagctggtgtacagcacccccacccccttcttccacaccttcgccggcgacgactgccaggccggcctgaacttcgccgacgaggacgaggcccaggccttcagagccctggtgcaggagaagatccagaagagaaaccagagacagagcggcgacagaagacagctgccccccccccccacccccgccaacgaggagagaagaggcggcctgccccccctgcccctgcaccccggcggcgaccagggcggcccccccgtgggccccctgagcctgggcctggccaccgtggacatccagaaccccgacatcaccagcagcagatacagaggcctgcccgcctag

SEQ ID NO: 105301 - DNA, 4668 bp, Artificial Sequence
  Description of Artificial Sequence: Synthetic coding sequence
atggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtgcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaagggcgtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105302 - DNA, 7149 bp, Artificial Sequence
  Description of Artificial Sequence: Synthetic coding sequence
atgagcggcggcgccgccgagaagcagagcagcacccccggcagcctgttcctgagcccccccgcccccgcccccaagaacggcagcagcagcgacagcagcgtgggcgagaagctgggcgccgccgccgccgacgccgtgaccggcagaaccgaggagtacagaagaagaagacacaccatggacaaggacagcagaggcgccgccgccaccaccaccaccaccgagcacagattcttcagaagaagcgtgatctgcgacagcaacgccaccgccctggagctgcccggcctgcccctgagcctgccccagcccagcatccccgccgccgtgccccagagcgccccccccgagccccacagagaggagaccgtgaccgccaccgccaccagccaggtggcccagcagccccccgccgccgccgcccccggcgagcaggccgtggccggccccgcccccagcaccgtgcccagcagcaccagcaaggacagacccgtgagccagcccagcctggtgggcagcaaggaggagcccccccccgccagaagcggcagcggcggcggcagcgccaaggagccccaggaggagagaagccagcagcaggacgacatcgaggagctggagaccaaggccgtgggcatgagcaacgacggcagattcctgaagttcgacatcgagatcggcagaggcagcttcaagaccgtgtacaagggcctggacaccgagaccaccgtggaggtggcctggtgcgagctgcaggacagaaagctgaccaagagcgagagacagagattcaaggaggaggccgagatgctgaagggcctgcagcaccccaacatcgtgagattctacgacagctgggagagcaccgtgaagggcaagaagtgcatcgtgctggtgaccgagctgatgaccagcggcaccctgaagacctacctgaagagattcaaggtgatgaagatcaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagaagtacgacgagagcgtggacgtgtacgccttcggcatgtgcatgctggagatggccaccagcgagtacccctacagcgagtgccagaacgccgcccagatctacagaagagtgaccagcggcgtgaagcccgccagcttcgacaaggtggccatccccgaggtgaaggagatcatcgagggctgcatcagacagaacaaggacgagagatacagcatcaaggacctgctgaaccacgccttcttccaggaggagaccggcgtgagagtggagctggccgaggaggacgacggcgagaagatcgccatcaagctgtggctgagaatcgaggacatcaagaagctgaagggcaagtacaaggacaacgaggccatcgagttcagcttcgacctggagagagacgtgcccgaggacgtggcccaggagatggtggagagcggctacgtgtgcgagggcgaccacaagaccatggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtggcccagggccagagccagggccagcccagcagcagcagcctgaccggcgtgagcagcagccagcccatccagcacccccagcagcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagctgcccgtgagccagcccgtgcccaccatccagggcgagccccagatccccgtggccacccagcccagcgtggtgcccgtgcacagcggcgcccacttcctgcccgtgggccagcccctgcccacccccctgctgccccagtaccccgtgagccagatccccatcagcaccccccacgtgagcaccgcccagaccggcttcagcagcctgcccatcaccatggccgccggcatcacccagcccctgctgaccctggccagcagcgccaccaccgccgccatccccggcgtgagcaccgtggtgcccagccagctgcccaccctgctgcagcccgtgacccagctgcccagccaggtgcacccccagctgctgcagcccgccgtgcagagcatgggcatccccgccaacctgggccaggccgccgaggtgcccctgagcagcggcgacgtgctgtaccagggcttcccccccagactgcccccccagtaccccggcgacagcaacatcgcccccagcagcaacgtggccagcgtgtgcatccacagcaccgtgctgagcccccccatgcccaccgaggtgctggccacccccggctacttccccaccgtggtgcagccctacgtggagagcaacctgctggtgcccatgggcggcgtgggcggccaggtgcaggtgagccagcccggcggcagcctggcccaggcccccaccaccagcagccagcaggccgtgctggagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaagggcgtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105303 - DNA, 5928 bp, Artificial Sequence
  Description of Artificial Sequence: Synthetic coding sequence
atggacatcaagaagaaggacttctgcagcgtgttcgtgatcatcaacagccactgctgctgctgcccccagaaggactgcatcaacgagggcgtgaagcccgccagcttcgacaaggtggccatccccgaggtgaaggagatcatcgagggctgcatcagacagaacaaggacgagagatacagcatcaaggacctgctgaaccacgccttcttccaggaggagaccggcgtgagagtggagctggccgaggaggacgacggcgagaagatcgccatcaagctgtggctgagaatcgaggacatcaagaagctgaagggcaagtacaaggacaacgaggccatcgagttcagcttcgacctggagagagacgtgcccgaggacgtggcccaggagatggtggagagcggctacgtgtgcgagggcgaccacaagaccatggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtggcccagggccagagccagggccagcccagcagcagcagcctgaccggcgtgagcagcagccagcccatccagcacccccagcagcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagctgcccgtgagccagcccgtgcccaccatccagggcgagccccagatccccgtggccacccagcccagcgtggtgcccgtgcacagcggcgcccacttcctgcccgtgggccagcccctgcccacccccctgctgccccagtaccccgtgagccagatccccatcagcaccccccacgtgagcaccgcccagaccggcttcagcagcctgcccatcaccatggccgccggcatcacccagcccctgctgaccctggccagcagcgccaccaccgccgccatccccggcgtgagcaccgtggtgcccagccagctgcccaccctgctgcagcccgtgacccagctgcccagccaggtgcacccccagctgctgcagcccgccgtgcagagcatgggcatccccgccaacctgggccaggccgccgaggtgcccctgagcagcggcgacgtgctgtaccagggcttcccccccagactgcccccccagtaccccggcgacagcaacatcgcccccagcagcaacgtggccagcgtgtgcatccacagcaccgtgctgagcccccccatgcccaccgaggtgctggccacccccggctacttccccaccgtggtgcagccctacgtggagagcaacctgctggtgcccatgggcggcgtgggcggccaggtgcaggtgagccagcccggcggcagcctggcccaggcccccaccaccagcagccagcaggccgtgctggagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaagggcgtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105304 - DNA, 1182 bp, Artificial Sequence
  Description of Artificial Sequence: Synthetic coding sequence
atgagcggcggcgccgccgagaagcagagcagcacccccggcagcctgttcctgagcccccccgcccccgcccccaagaacggcagcagcagcgacagcagcgtgggcgagaagctgggcgccgccgccgccgacgccgtgaccggcagaaccgaggagtacagaagaagaagacacaccatggacaaggacagcagaggcgccgccgccaccaccaccaccaccgagcacagattcttcagaagaagcgtgatctgcgacagcaacgccaccgccctggagctgcccggcctgcccctgagcctgccccagcccagcatccccgccgccgtgccccagagcgccccccccgagccccacagagaggagaccgtgaccgccaccgccaccagccaggtggcccagcagccccccgccgccgccgcccccggcgagcaggccgtggccggccccgcccccagcaccgtgcccagcagcaccagcaaggacagacccgtgagccagcccagcctggtgggcagcaaggaggagcccccccccgccagaagcggcagcggcggcggcagcgccaaggagccccaggaggagagaagccagcagcaggacgacatcgaggagctggagaccaaggccgtgggcatgagcaacgacggcagattcctgaagttcgacatcgagatcggcagaggcagcttcaagaccgtgtacaagggcctggacaccgagaccaccgtggaggtggcctggtgcgagctgcaggacagaaagctgaccaagagcgagagacagagattcaaggaggaggccgagatgctgaagggcctgcagcaccccaacatcgtgagattctacgacagctgggagagcaccgtgaagggcaagaagtgcatcgtgctggtgaccgagctgatgaccagcggcaccctgaagacctacctgaagagattcaaggtgatgaagatcaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcatgttccaggtgtacctgggcgcctag

SEQ ID NO: 105305 - DNA, 8643 bp, Artificial Sequence
  Description of Artificial Sequence: Synthetic coding sequence
atgagcggcggcgccgccgagaagcagagcagcacccccggcagcctgttcctgagcccccccgcccccgcccccaagaacggcagcagcagcgacagcagcgtgggcgagaagctgggcgccgccgccgccgacgccgtgaccggcagaaccgaggagtacagaagaagaagacacaccatggacaaggacagcagaggcgccgccgccaccaccaccaccaccgagcacagattcttcagaagaagcgtgatctgcgacagcaacgccaccgccctggagctgcccggcctgcccctgagcctgccccagcccagcatccccgccgccgtgccccagagcgccccccccgagccccacagagaggagaccgtgaccgccaccgccaccagccaggtggcccagcagccccccgccgccgccgcccccggcgagcaggccgtggccggccccgcccccagcaccgtgcccagcagcaccagcaaggacagacccgtgagccagcccagcctggtgggcagcaaggaggagcccccccccgccagaagcggcagcggcggcggcagcgccaaggagccccaggaggagagaagccagcagcaggacgacatcgaggagctggagaccaaggccgtgggcatgagcaacgacggcagattcctgaagttcgacatcgagatcggcagaggcagcttcaagaccgtgtacaagggcctggacaccgagaccaccgtggaggtggcctggtgcgagctgcaggacagaaagctgaccaagagcgagagacagagattcaaggaggaggccgagatgctgaagggcctgcagcaccccaacatcgtgagattctacgacagctgggagagcaccgtgaagggcaagaagtgcatcgtgctggtgaccgagctgatgaccagcggcaccctgaagacctacctgaagagattcaaggtgatgaagatcaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagaagtacgacgagagcgtggacgtgtacgccttcggcatgtgcatgctggagatggccaccagcgagtacccctacagcgagtgccagaacgccgcccagatctacagaagagtgaccagcggcgtgaagcccgccagcttcgacaaggtggccatccccgaggtgaaggagatcatcgagggctgcatcagacagaacaaggacgagagatacagcatcaaggacctgctgaaccacgccttcttccaggaggagaccggcgtgagagtggagctggccgaggaggacgacggcgagaagatcgccatcaagctgtggctgagaatcgaggacatcaagaagctgaagggcaagtacaaggacaacgaggccatcgagttcagcttcgacctggagagagacgtgcccgaggacgtggcccaggagatggtggagagcggctacgtgtgcgagggcgaccacaagaccatggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtgcccagaagaggcagaagcatgagcgtgtgcgtgcccatcttcctgctgctgcccctgtgccccgccagcctgcccgtgctgttccaccccaccgccagcaccgtgtgcaccagcttcagcttccccccccccgactgccccgaggagaccttcgccgagaagctgagcaaggccctggagagcgtgctgcccatgcacagcgccagccagagaaagcacagaagaagcagcctgcccagcctgttcgtgagcaccccccagagcatggcccacccctgcggcggcacccccacctaccccgagagccagatcttcttccccaccatccacgagagacccgtgagcttcagccccccccccacctgcccccccaaggtggccatcagccagagaagaaagagcaccagcttcctggaggcccagacccaccacttccagcccctgctgagaaccgtgggccagagcctgctgccccccggcggcagccccaccaactggacccccgaggccgtggtgatgctgggcaccaccgccagcagagtgaccggcgagagctgcgagatccaggtgcaccccatgttcgagcccagccaggtgtacagcgactacagacccggcctggtgctgcccgaggaggcccactacttcatcccccaggaggccgtgtacgtggccggcgtgcactaccaggccagagtggccgagcagtacgagggcatcccctacaacagcagcgtgctgagcagccccatgaagcagatccccgagcagaagcccgtgcagggcggccccaccagcagcagcgtgttcgagttccccagcggccaggccttcctggtgggccacctgcagaacctgagactggacagcggcctgggccccggcagccccctgagcagcatcagcgcccccatcagcaccgacgccaccagactgaagttccaccccgtgttcgtgccccacagcgcccccgccgtgctgacccacaacaacgagagcagaagcaactgcgtgttcgagttccacgtgcacacccccagcagcagcagcggcgagggcggcggcatcctgccccagagagtgtacagaaacagacaggtggccgtggacctgaaccaggaggagctgcccccccagagcgtgggcctgcacggctacctgcagcccgtgaccgaggagaagcacaactaccacgcccccgagctgaccgtgagcgtggtggagcccatcggccagaactggcccatcggcagccccgagtacagcagcgacagcagccagatcaccagcagcgaccccagcgacttccagagccccccccccaccggcggcgccgccgcccccttcggcagcgacgtgagcatgcccttcatccacctgccccagaccgtgctgcaggagagccccctgttcttctgcttcccccagggcaccaccagccagcaggtgctgaccgccagcttcagcagcggcggcagcgccctgcacccccaggcccagggccagagccagggccagcccagcagcagcagcctgaccggcgtgagcagcagccagcccatccagcacccccagcagcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagctgcccgtgagccagcccgtgcccaccatccagggcgagccccagatccccgtggccacccagcccagcgtggtgcccgtgcacagcggcgcccacttcctgcccgtgggccagcccctgcccacccccctgctgccccagtaccccgtgagccagatccccatcagcaccccccacgtgagcaccgcccagaccggcttcagcagcctgcccatcaccatggccgccggcatcacccagcccctgctgaccctggccagcagcgccaccaccgccgccatccccggcgtgagcaccgtggtgcccagccagctgcccaccctgctgcagcccgtgacccagctgcccagccaggtgcacccccagctgctgcagcccgccgtgcagagcatgggcatccccgccaacctgggccaggccgccgaggtgcccctgagcagcggcgacgtgctgtaccagggcttcccccccagactgcccccccagtaccccggcgacagcaacatcgcccccagcagcaacgtggccagcgtgtgcatccacagcaccgtgctgagcccccccatgcccaccgaggtgctggccacccccggctacttccccaccgtggtgcagccctacgtggagagcaacctgctggtgcccatgggcggcgtgggcggccaggtgcaggtgagccagcccggcggcagcctggcccaggcccccaccaccagcagccagcaggccgtgctggagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaagggcgtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105306 - DNA, 6405 bp, Artificial Sequence
  Description of Artificial Sequence: Synthetic coding sequence
atgagcggcggcgccgccgagaagcagagcagcacccccggcagcctgttcctgagcccccccgcccccgcccccaagaacggcagcagcagcgacagcagcgtgggcgagaagctgggcgccgccgccgccgacgccgtgaccggcagaaccgaggagtacagaagaagaagacacaccatggacaaggacagcagaggcgccgccgccaccaccaccaccaccgagcacagattcttcagaagaagcgtgatctgcgacagcaacgccaccgccctggagctgcccggcctgcccctgagcctgccccagcccagcatccccgccgccgtgccccagagcgccccccccgagccccacagagaggagaccgtgaccgccaccgccaccagccaggtggcccagcagccccccgccgccgccgcccccggcgagcaggccgtggccggccccgcccccagcaccgtgcccagcagcaccagcaaggacagacccgtgagccagcccagcctggtgggcagcaaggaggagcccccccccgccagaagcggcagcggcggcggcagcgccaaggagccccaggaggagagaagccagcagcaggacgacatcgaggagctggagaccaaggccgtgggcatgagcaacgacggcagattcctgaagttcgacatcgagatcggcagaggcagcttcaagaccgtgtacaagggcctggacaccgagaccaccgtggaggtggcctggtgcgagctgcaggacagaaagctgaccaagagcgagagacagagattcaaggaggaggccgagatgctgaagggcctgcagcaccccaacatcgtgagattctacgacagctgggagagcaccgtgaagggcaagaagtgcatcgtgctggtgaccgagctgatgaccagcggcaccctgaagacctacctgaagagattcaaggtgatgaagatcaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagaagtacgacgagagcgtggacgtgtacgccttcggcatgtgcatgctggagatggccaccagcgagtacccctacagcgagtgccagaacgccgcccagatctacagaagagtgaccagcggcgtgaagcccgccagcttcgacaaggtggccatccccgaggtgaaggagatcatcgagggctgcatcagacagaacaaggacgagagatacagcatcaaggacctgctgaaccacgccttcttccaggaggagaccggcgtgagagtggagctggccgaggaggacgacggcgagaagatcgccatcaagctgtggctgagaatcgaggacatcaagaagctgaagggcaagtacaaggacaacgaggccatcgagttcagcttcgacctggagagagacgtgcccgaggacgtggcccaggagatggtggagagcggctacgtgtgcgagggcgaccacaagaccatggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtggcccagggccagagccagggccagcccagcagcagcagcctgaccggcgtgagcagcagccagcccatccagcacccccagcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaaggtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105307 - DNA, 975 bp, Artificial Sequence
  Description of Artificial Sequence: Synthetic coding sequence
atgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105308 - DNA, 7929 bp, Artificial Sequence
  Description of Artificial Sequence: Synthetic coding sequence
atgagcggcggcgccgccgagaagcagagcagcacccccggcagcctgttcctgagcccccccgcccccgcccccaagaacggcagcagcagcgacagcagcgtgggcgagaagctgggcgccgccgccgccgacgccgtgaccggcagaaccgaggagtacagaagaagaagacacaccatggacaaggacagcagaggcgccgccgccaccaccaccaccaccgagcacagattcttcagaagaagcgtgatctgcgacagcaacgccaccgccctggagctgcccggcctgcccctgagcctgccccagcccagcatccccgccgccgtgccccagagcgccccccccgagccccacagagaggagaccgtgaccgccaccgccaccagccaggtggcccagcagccccccgccgccgccgcccccggcgagcaggccgtggccggccccgcccccagcaccgtgcccagcagcaccagcaaggacagacccgtgagccagcccagcctggtgggcagcaaggaggagcccccccccgccagaagcggcagcggcggcggcagcgccaaggagccccaggaggagagaagccagcagcaggacgacatcgaggagctggagaccaaggccgtgggcatgagcaacgacggcagattcctgaagttcgacatcgagatcggcagaggcagcttcaagaccgtgtacaagggcctggacaccgagaccaccgtggaggtggcctggtgcgagctgcaggacagaaagctgaccaagagcgagagacagagattcaaggaggaggccgagatgctgaagggcctgcagcaccccaacatcgtgagattctacgacagctgggagagcaccgtgaagggcaagaagtgcatcgtgctggtgaccgagctgatgaccagcggcaccctgaagacctacctgaagagattcaaggtgatgaagatcaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagaagtacgacgagagcgtggacgtgtacgccttcggcatgtgcatgctggagatggccaccagcgagtacccctacagcgagtgccagaacgccgcccagatctacagaagagtgaccagcggcgtgaagcccgccagcttcgacaaggtggccatccccgaggtgaaggagatcatcgagggctgcatcagacagaacaaggacgagagatacagcatcaaggacctgctgaaccacgccttcttccaggaggagaccggcgtgagagtggagctggccgaggaggacgacggcgagaagatcgccatcaagctgtggctgagaatcgaggacatcaagaagctgaagggcaagtacaaggacaacgaggccatcgagttcagcttcgacctggagagagacgtgcccgaggacgtggcccaggagatggtggagagcggctacgtgtgcgagggcgaccacaagaccatggccaaggccatcaaggacagagtgagcctgatcaagagaaagagagagcagagacagctggtgagagaggagcaggagaagaagaagcaggaggagagcagcctgaagcagcaggtggagcagagcagcgccagccagaccggcatcaagcagctgcccagcgccagcaccggcatccccaccgccagcaccaccagcgccagcgtgagcacccaggtggagcccgaggagcccgaggccgaccagcaccagcagctgcagtaccagcagcccagcatcagcgtgctgagcgacggcaccgtggacagcggccagggcagcagcgtgttcaccgagagcagagtgagcagccagcagaccgtgagctacggcagccagcacgagcaggcccacagcaccggcaccgtgcccggccacatccccagcaccgtgcaggcccagagccagccccacggcgtgtacccccccagcagcgtgccccagagcatggcccacccctgcggcggcacccccacctaccccgagagccagatcttcttccccaccatccacgagagacccgtgagcttcagccccccccccacctgcccccccaaggtggccatcagccagagaagaaagagcaccagcttcctggaggcccagacccaccacttccagcccctgctgagaaccgtgggccagagcctgctgccccccggcggcagccccaccaactggacccccgaggccgtggtgatgctgggcaccaccgccagcagagtgaccggcgagagctgcgagatccaggtgcaccccatgttcgagcccagccaggtgtacagcgactacagacccggcctggtgctgcccgaggaggcccactacttcatcccccaggaggccgtgtacgtggccggcgtgcactaccaggccagagtggccgagcagtacgagggcatcccctacaacagcagcgtgctgagcagccccatgaagcagatccccgagcagaagcccgtgcagggcggccccaccagcagcagcgtgttcgagttccccagcggccaggccttcctggtgggccacctgcagaacctgagactggacagcggcctgggccccggcagccccctgagcagcatcagcgcccccatcagcaccgacgccaccagactgaagttccaccccgtgttcgtgccccacagcgcccccgccgtgctgacccacaacaacgagagcagaagcaactgcgtgttcgagttccacgtgcacacccccagcagcagcagcggcgagggcggcggcatcctgccccagagagtgtacagaaacagacaggtggccgtggacctgaaccaggaggagctgcccccccagagcgtgggcctgcacggctacctgcagcccgtgaccgaggagaagcacaactaccacgcccccgagctgaccgtgagcgtggtggagcccatcggccagaactggcccatcggcagccccgagtacagcagcgacagcagccagatcaccagcagcgaccccagcgacttccagagccccccccccaccggcggcgccgccgcccccttcggcagcgacgtgagcatgcccttcatccacctgccccagaccgtgctgcaggagagccccctgttcttctgcttcccccagggcaccaccagccagcaggtgctgaccgccagcttcagcagcggcggcagcgccctgcacccccaggcccagggccagagccagggccagcccagcagcagcagcctgaccggcgtgagcagcagccagcccatccagcacccccagcagcagcagggcatccagcagaccgcccccccccagcagaccgtgcagtacagcctgagccagaccagcaccagcagcgaggccaccaccgcccagcccgtgagccagccccaggccccccaggtgctgccccaggtgagcgccggcaagcagggcttcccccccagactgcccccccagtaccccggcgacagcaacatcgcccccagcagcaacgtggccagcgtgtgcatccacagcaccgtgctgagcccccccatgcccaccgaggtgctggccacccccggctacttccccaccgtggtgcagccctacgtggagagcaacctgctggtgcccatgggcggcgtgggcggccaggtgcaggtgagccagcccggcggcagcctggcccaggcccccaccaccagcagccagcaggccgtgctggagagcacccagggcgtgagccaggtggcccccgccgagcccgtggccgtggcccagacccaggccacccagcccaccaccctggccagcagcgtggacagcgcccacagcgacgtggccagcggcatgagcgacggcaacgagaacgtgcccagcagcagcggcagacacgagggcagaaccaccaagagacactacagaaagagcgtgagaagcagaagcagacacgagaagaccagcagacccaagctgagaatcctgaacgtgagcaacaagggcgacagagtggtggagtgccagctggagacccacaacagaaagatggtgaccttcaagttcgacctggacggcgacaaccccgaggagatcgccaccatcatggtgaacaacgacttcatcctggccatcgagagagagagcttcgtggaccaggtgagagagatcatcgagaaggccgacgagatgctgagcgaggacgtgagcgtggagcccgagggcgaccagggcctggagagcctgcagggcaaggacgactacggcttcagcggcagccagaagctggagggcgagttcaagcagcccatccccgccagcagcatgccccagcagatcggcatccccaccagcagcctgacccaggtggtgcacagcgccggcagaagattcatcgtgagccccgtgcccgagagcagactgagagagagcaaggtgttccccagcgagatcaccgacaccgtggccgccagcaccgcccagagccccggcatgaacctgagccacagcgccagcagcctgagcctgcagcaggccttcagcgagctgagaagagcccagatgaccgagggccccaacaccgccccccccaacttcagccacaccggccccaccttccccgtggtgccccccttcctgagcagcatcgccggcgtgcccaccaccgccgccgccaccgcccccgtgcccgccaccagcagcccccccaacgacatcagcaccagcgtgatccagagcgaggtgaccgtgcccaccgaggagggcatcgccggcgtggccaccagcaccggcgtggtgaccagcggcggcctgcccatcccccccgtgagcgagagccccgtgctgagcagcgtggtgagcagcatcaccatccccgccgtggtgagcatcagcaccaccagccccagcctgcaggtgcccaccagcaccagcgagatcgtggtgagcagcaccgccctgtaccccagcgtgaccgtgagcgccaccagcgccagcgccggcggcagcaccgccacccccggccccaagccccccgccgtggtgagccagcaggccgccggcagcaccaccgtgggcgccaccctgaccagcgtgagcaccaccaccagcttccccagcaccgccagccagctgtgcatccagctgagcagcagcaccagcacccccaccctggccgagaccgtggtggtgagcgcccacagcctggacaagaccagccacagcagcaccaccggcctggccttcagcctgagcgcccccagcagcagcagcagccccggcgccggcgtgagcagctacatcagccagcccggcggcctgcaccccctggtgatccccagcgtgatcgccagcacccccatcctgccccaggccgccggccccaccagcacccccctgctgccccaggtgcccagcatcccccccctggtgcagcccgtggccaacgtgcccgccgtgcagcagaccctgatccacagccagccccagcccgccctgctgcccaaccagccccacacccactgccccgaggtggacagcgacacccagcccaaggcccccggcatcgacgacatcaagaccctggaggagaagctgagaagcctgttcagcgagcacagcagcagcggcgcccagcacgccagcgtgagcctggagaccagcctggtgatcgagagcaccgtgacccccggcatccccaccaccgccgtggcccccagcaagctgctgaccagcaccaccagcacctgcctgccccccaccaacctgcccctgggcaccgtggccctgcccgtgacccccgtggtgacccccggccaggtgagcacccccgtgagcaccaccaccagcggcgtgaagcccggcaccgcccccagcaagccccccctgaccaaggcccccgtgctgcccgtgggcaccgagctgcccgccggcaccctgcccagcgagcagctgccccccttccccggccccagcctgacccagagccagcagcccctggaggacctggacgcccagctgagaagaaccctgagccccgagatgatcaccgtgaccagcgccgtgggccccgtgagcatggccgcccccaccgccatcaccgaggccggcacccagccccagaagggcgtgagccaggtgaaggagggccccgtgctggccaccagcagcggcgccggcgtgttcaagatgggcagattccaggtgagcgtggccgccgacggcgcccagaaggagggcaagaacaagagcgaggacgccaagagcgtgcacttcgagagcagcaccagcgagagcagcgtgctgagcagcagcagccccgagagcaccctggtgaagcccgagcccaacggcatcaccatccccggcatcagcagcgacgtgcccgagagcgcccacaagaccaccgccagcgaggccaagagcgacaccggccagcccaccaaggtgggcagattccaggtgaccaccaccgccaacaaggtgggcagattcagcgtgagcaagaccgaggacaagatcaccgacaccaagaaggagggccccgtggccagcccccccttcatggacctggagcaggccgtgctgcccgccgtgatccccaagaaggagaagcccgagctgagcgagcccagccacctgaacggccccagcagcgaccccgaggccgccttcctgagcagagacgtggacgacggcagcggcagcccccacagcccccaccagctgagcagcaagagcctgcccagccagaacctgagccagagcctgagcaacagcttcaacagcagctacatgagcagcgacaacgagagcgacatcgaggacgaggacctgaagctggagctgagaagactgagagacaagcacctgaaggagatccaggacctgcagagcagacagaagcacgagatcgagagcctgtacaccaagctgggcaaggtgccccccgccgtgatcatcccccccgccgcccccctgagcggcagaagaagaagacccaccaagagcaagggcagcaagagcagcagaagcagcagcctgggcaacaagagcccccagctgagcggcaacctgagcggccagagcgccgccagcgtgctgcacccccagcagaccctgcacccccccggcaacatccccgagagcggccagaaccagctgctgcagcccctgaagcccagccccagcagcgacaacctgtacagcgccttcaccagcgacggcgccatcagcgtgcccagcctgagcgcccccggccagggcaccagcagcaccaacaccgtgggcgccaccgtgaacagccaggccgcccaggcccagccccccgccatgaccagcagcagaaagggcaccttcaccgacgacctgcacaagctggtggacaactgggccagagacgccatgaacctgagcggcagaagaggcagcaagggccacatgaactacgagggccccggcatggccagaaagttcagcgcccccggccagctgtgcatcagcatgaccagcaacctgggcggcagcgcccccatcagcgccgccagcgccaccagcctgggccacttcaccaagagcatgtgccccccccagcagtacggcttccccgccacccccttcggcgcccagtggagcggcaccggcggccccgccccccagcccctgggccagttccagcccgtgggcaccgccagcctgcagaacttcaacatcagcaacctgcagaagagcatcagcaacccccccggcagcaacctgagaaccacctag

SEQ ID NO: 105309 - DNA, 6894 bp, Artificial Sequence
  Description of Artificial Sequence: Synthetic coding sequence
atggacggcgacggcggcagaagagacgtgcccggcaccctgatggagcccggcagaggcgccggccccgccggcatggccgagcccagagccaaggccgccagacccggcccccagagattcctgagaagaagcgtggtggagagcgaccaggaggagccccccggcctggaggccgccgaggcccccggcccccagcccccccagcccctgcagagaagagtgctgctgctgtgcaagaccagaagactgatcgccgagagagccagaggcagacccgccgcccccgcccccgccgccctggtggcccagcccggcgcccccggcgcccccgccgacgccggccccgagcccgtgggcacccaggagcccggccccgaccccatcgccgccgccgtggagaccgcccccgcccccgacggcggccccagagaggaggccgccgccaccgtgagaaaggaggacgagggcgccgccgaggccaagcccgagcccggcagaaccagaagagacgagcccgaggaggaggaggacgacgaggacgacctgaaggccgtggccaccagcctggacggcagattcctgaagttcgacatcgagctgggcagaggcagcttcaagaccgtgtacaagggcctggacaccgagacctgggtggaggtggcctggtgcgagctgcaggacagaaagctgaccaagctggagagacagagattcaaggaggaggccgagatgctgaagggcctgcagcaccccaacatcgtgagattctacgacttctgggagagcagcgccaagggcaagagatgcatcgtgctggtgaccgagctgatgaccagcggcaccctgaagacctacctgaagagattcaaggtgatgaagcccaaggtgctgagaagctggtgcagacagatcctgaagggcctgctgttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgacctgcggcatcaagcccgccagcttcgagaaggtgcacgaccccgagatcaaggagatcatcggcgagtgcatctgcaagaacaaggaggagagatacgagatcaaggacctgctgagccacgccttcttcgccgaggacaccggcgtgagagtggagctggccgaggaggaccacggcagaaagagcaccatcgccctgagactgtgggtggaggaccccaagaagctgaagggcaagcccaaggacaacggcgccatcgagttcaccttcgacctggagaaggagacccccgacgaggtggcccaggagatgatcgagagcggcttcttccacgagagcgacgtgaagatcgtggccaagagcatcagagacagagtggccctgatccagtggagaagagagagaatctggcccgccctgcagcccaaggagcagcaggacgtgggcagccccgacaaggccagaggcccccccgtgcccctgcaggtgcaggtgacctaccacgcccaggccggccagcccggcccccccgagcccgaggagcccgaggccgaccagcacctgctgccccccaccctgcccaccagcgccaccagcctggccagcgacagcaccttcgacagcggccagggcagcaccgtgtacagcgacagccagagcagccagcagagcgtgatgctgggcagcctggccgacgccgcccccagccccgcccagtgcgtgtgcagcccccccgtgagcgagggccccgtgctgccccagagcctgcccagcctgggcgcctaccagcagcccaccgccgcccccggcctgcccgtgggcagcgtgcccgcccccgcctgcccccccagcctgcagcagcacttccccgaccccgccatgagcttcgcccccgtgctgcccccccccagcacccccatgcccaccggccccggccagcccgccccccccggccagcagcccccccccctggcccagcccacccccctgccccaggtgctggccccccagcccgtggtgcccctgcagcccgtgcccccccacctgcccccctacctggcccccgccagccaggtgggcgcccccgcccagctgaagcccctgcagatgccccaggcccccctgcagcccctggcccaggtgcccccccagatgccccccatccccgtggtgccccccatcacccccctggccggcatcgacggcctgccccccgccctgcccgacctgcccaccgccaccgtgccccccgtgccccccccccagtacttcagccccgccgtgatcctgcccagcctggccgcccccctgccccccgccagccccgccctgcccctgcaggccgtgaagctgccccacccccccggcgcccccctggccatgccctgcagaaccatcgtgcccaacgcccccgccaccatccccctgctggccgtggccccccccggcgtggccgccctgagcatccacagcgccgtggcccagctgcccggccagcccgtgtaccccgccgccttcccccagatggcccccaccgacgtgccccccagcccccaccacaccgtgcagaacatgagagccacccccccccagcccgccctgcccccccagcccaccctgcccccccagcccgtgctgcccccccagcccaccctgcccccccagcccgtgctgcccccccagcccaccagacccccccagcccgtgctgcccccccagcccatgctgcccccccagcccgtgctgcccccccagcccgccctgcccgtgagacccgagcccctgcagccccacctgcccgagcaggccgcccccgccgccacccccggcagccagatcctgctgggccaccccgccccctacgccgtggacgtggccgcccaggtgcccaccgtgcccgtgccccccgccgccgtgctgagcccccccctgcccgaggtgctgctgcccgccgcccccgagctgctgccccagttccccagcagcctggccaccgtgagcgccagcgtgcagagcgtgcccacccagaccgccaccctgctgccccccgccaacccccccctgcccggcggccccggcatcgccagcccctgccccaccgtgcagctgaccgtggagcccgtgcaggaggagcaggccagccaggacaagccccccggcctgccccagagctgcgagagctacggcggcagcgacgtgaccagcggcaaggagctgagcgacagctgcgagggcgccttcggcggcggcagactggagggcagagccgccagaaagcaccacagaagaagcaccagagccagaagcagacaggagagagccagcagacccagactgaccatcctgaacgtgtgcaacaccggcgacaagatggtggagtgccagctggagacccacaaccacaagatggtgaccttcaagttcgacctggacggcgacgcccccgacgagatcgccacctacatggtggagcacgacttcatcctgcaggccgagagagagaccttcatcgagcagatgaaggacgtgatggacaaggccgaggacatgctgagcgaggacaccgacgccgacagaggcagcgaccccggcaccagccccccccacctgagcacctgcggcctgggcaccggcgaggagagcagacagagccaggccaacgcccccgtgtaccagcagaacgtgctgcacaccggcaagagatggttcatcatctgccccgtggccgagcaccccgcccccgaggcccccgagagcagcccccccctgcccctgagcagcctgccccccgaggccagccagggcccctgcagaggcctgaccctgccctgcctgccctggagaagagccgcctgcggcgccgtgttcctgagcctgttcagcgccgagagcgcccagagcaagcagccccccgacagcgccccctacaaggaccagctgagcagcaaggagcagcccagcttcctggccagccagcagctgctgagccaggccggccccagcaacccccccggcgccccccccgcccccctggcccccagcagcccccccgtgaccgccctgccccaggacggcgccgcccccgccaccagcaccatgcccgagcccgccagcggcaccgccagccaggccggcggccccggcaccccccagggcctgaccagcgagctggagaccagccagcccctggccgagacccacgaggcccccctggccgtgcagcccctggtggtgggcctggccccctgcacccccgcccccgaggccgccagcaccagagacgccagcgcccccagagagcccctgcccccccccgcccccgagcccagcccccacagcggcaccccccagcccgccctgggccagcccgcccccctgctgcccgccgccgtgggcgccgtgagcctggccaccagccagctgcccagcccccccctgggccccaccgtgcccccccagccccccagcgccctggagagcgacggcgagggccccccccccagagtgggcttcgtggacagcaccatcaagagcctggacgagaagctgagaaccctgctgtaccaggagcacgtgcccaccagcagcgccagcgccggcacccccgtggaggtgggcgacagagacttcaccctggagcccctgagaggcgaccagcccagaagcgaggtgtgcggcggcgacctggccctgccccccgtgcccaaggaggccgtgagcggcagagtgcagctgccccagcccctggtggagaagagcgagctggcccccaccagaggcgccgtgatggagcagggcaccagcagcagcatgaccgccgagagcagccccagaagcatgctgggctacgacagagacggcagacaggtggccagcgacagccacgtggtgcccagcgtgccccaggacgtgcccgccttcgtgagacccgccagagtggagcccaccgacagagacggcggcgaggccggcgagagcagcgccgagcccccccccagcgacatgggcaccgtgggcggccaggccagccacccccagaccctgggcgccagagccctgggcagccccagaaagagacccgagcagcaggacgtgagcagccccgccaagaccgtgggcagattcagcgtggtgagcacccaggacgagtggaccctggccagcccccacagcctgagatacagcgccccccccgacgtgtacctggacgaggcccccagcagccccgacgtgaagctggccgtgagaagagcccagaccgccagcagcatcgaggtgggcgtgggcgagcccgtgagcagcgacagcggcgacgagggccccagagccagaccccccgtgcagaagcaggccagcctgcccgtgagcggcagcgtggccggcgacttcgtgaagaaggccaccgccttcctgcagagacccagcagagccggcagcctgggccccgagacccccagcagagtgggcatgaaggtgcccaccatcagcgtgaccagcttccacagccagagcagctacatcagcagcgacaacgacagcgagctggaggacgccgacatcaagaaggagctgcagagcctgagagagaagcacctgaaggagatcagcgagctgcagagccagcagaagcaggagatcgaggccctgtacagaagactgggcaagcccctgccccccaacgtgggcttcttccacaccgccccccccaccggcagaagaagaaagaccagcaagagcaagctgaaggccggcaagctgctgaaccccctggtgagacagctgaaggtggtggccagcagcaccggccacctggccgacagcagcagaggcccccccgccaaggaccccgcccaggccagcgtgggcctgaccgccgacagcaccggcctgagcggcaaggccgtgcagacccagcagccctgcagcgtgagagccagcctgagcagcgacatctgcagcggcctggccagcgacggcggcggcgccagaggccagggctggaccgtgtaccaccccaccagcgagagagtgacctacaagagcagcagcaagcccagagccagattcctgagcggccccgtgagcgtgagcatctggagcgccctgaagagactgtgcctgggcaaggagcacagcagcagaagcagcaccagcagcctggcccccggccccgagcccggcccccagcccgccctgcacgtgcaggcccaggtgaacaacagcaacaacaagaagggcaccttcaccgacgacctgcacaagctggtggacgagtggaccagcaagaccgtgggcgccgcccagctgaagcccaccctgaaccagctgaagcagacccagaagctgcaggacatggaggcccaggccggctgggccgcccccggcgaggccagagccatgaccgcccccagagccggcgtgggcatgcccagactgccccccgcccccggccccctgagcaccaccgtgatccccggcgccgcccccaccctgagcgtgcccacccccgacggcgccctgggcaccgccagaagaaaccaggtgtggttcggcctgagagtgccccccaccgcctgctgcggccacagcacccagcccagaggcggccagagagtgggcagcaagaccgccagcttcgccgccagcgaccccgtgagaagctag

SEQ ID NO: 105310 - DNA, 5601 bp, Artificial Sequence
  Description of Artificial Sequence: Synthetic coding sequence
atggccaccagcgagtacccctacagcgagtgccagaacgccgcccagatctacagaaaggtgacctgcggcatcaagcccgccagcttcgagaaggtgcacgaccccgagatcaaggagatcatcggcgagtgcatctgcaagaacaaggaggagagatacgagatcaaggacctgctgagccacgccttcttcgccgaggacaccggcgtgagagtggagctggccgaggaggaccacggcagaaagagcaccatcgccctgagactgtgggtggaggaccccaagaagctgaagggcaagcccaaggacaacggcgccatcgagttcaccttcgacctggagaaggagacccccgacgaggtggcccaggagatgatcgagagcggcttcttccacgagagcgacgtgaagatcgtggccaagagcatcagagacagagtggccctgatccagtggagaagagagagaatctggcccgccctgcagcccaaggagcagcaggacgtgggcagccccgacaaggccagaggcccccccgtgcccctgcaggtgcaggtgacctaccacgcccaggccggccagcccggcccccccgagcccgaggagcccgaggccgaccagcacctgctgccccccaccctgcccaccagcgccaccagcctggccagcgacagcaccttcgacagcggccagggcagcaccgtgtacagcgacagccagagcagccagcagagcgtgatgctgggcagcctggccgacgccgcccccagccccgcccagtgcgtgtgcagcccccccgtgagcgagggccccgtgctgccccagagcctgcccagcctgggcgcctaccagcagcccaccgccgcccccggcctgcccgtgggcagcgtgcccgcccccgcctgcccccccagcctgcagcagcacttccccgaccccgccatgagcttcgcccccgtgctgcccccccccagcacccccatgcccaccggccccggccagcccgccccccccggccagcagcccccccccctggcccagcccacccccctgccccaggtgctggccccccagcccgtggtgcccctgcagcccgtgcccccccacctgcccccctacctggcccccgccagccaggtgggcgcccccgcccagctgaagcccctgcagatgccccaggcccccctgcagcccctggcccaggtgcccccccagatgccccccatccccgtggtgccccccatcacccccctggccggcatcgacggcctgccccccgccctgcccgacctgcccaccgccaccgtgccccccgtgccccccccccagtacttcagccccgccgtgatcctgcccagcctggccgcccccctgccccccgccagccccgccctgcccctgcaggccgtgaagctgccccacccccccggcgcccccctggccatgccctgcagaaccatcgtgcccaacgcccccgccaccatccccctgctggccgtggccccccccggcgtggccgccctgagcatccacagcgccgtggcccagctgcccggccagcccgtgtaccccgccgccttcccccagatggcccccaccgacgtgccccccagcccccaccacaccgtgcagaacatgagagccacccccccccagcccgccctgcccccccagcccaccctgcccccccagcccgtgctgcccccccagcccaccctgcccccccagcccgtgctgcccccccagcccaccagacccccccagcccgtgctgcccccccagcccatgctgcccccccagcccgtgctgcccccccagcccgccctgcccgtgagacccgagcccctgcagccccacctgcccgagcaggccgcccccgccgccacccccggcagccagatcctgctgggccaccccgccccctacgccgtggacgtggccgcccaggtgcccaccgtgcccgtgccccccgccgccgtgctgagcccccccctgcccgaggtgctgctgcccgccgcccccgagctgctgccccagttccccagcagcctggccaccgtgagcgccagcgtgcagagcgtgcccacccagaccgccaccctgctgccccccgccaacccccccctgcccggcggccccggcatcgccagcccctgccccaccgtgcagctgaccgtggagcccgtgcaggaggagcaggccagccaggacaagccccccggcctgccccagagctgcgagagctacggcggcagcgacgtgaccagcggcaaggagctgagcgacagctgcgagggcgccttcggcggcggcagactggagggcagagccgccagaaagcaccacagaagaagcaccagagccagaagcagacaggagagagccagcagacccagactgaccatcctgaacgtgtgcaacaccggcgacaagatggtggagtgccagctggagacccacaaccacaagatggtgaccttcaagttcgacctggacggcgacgcccccgacgagatcgccacctacatggtggagcacgacttcatcctgcaggccgagagagagaccttcatcgagcagatgaaggacgtgatggacaaggccgaggacatgctgagcgaggacaccgacgccgacagaggcagcgaccccggcaccagccccccccacctgagcacctgcggcctgggcaccggcgaggagagcagacagagccaggccaacgcccccgtgtaccagcagaacgtgctgcacaccggcaagagatggttcatcatctgccccgtggccgagcaccccgcccccgaggcccccgagagcagcccccccctgcccctgagcagcctgccccccgaggccagccagggcccctgcagaggcctgaccctgccctgcctgccctggagaagagccgcctgcggcgccgtgttcctgagcctgttcagcgccgagagcgcccagagcaagcagccccccgacagcgccccctacaaggaccagctgagcagcaaggagcagcccagcttcctggccagccagcagctgctgagccaggccggccccagcaacccccccggcgccccccccgcccccctggcccccagcagcccccccgtgaccgccctgccccaggacggcgccgcccccgccaccagcaccatgcccgagcccgccagcggcaccgccagccaggccggcggccccggcaccccccagggcctgaccagcgagctggagaccagccagcccctggccgagacccacgaggcccccctggccgtgcagcccctggtggtgggcctggccccctgcacccccgcccccgaggccgccagcaccagagacgccagcgcccccagagagcccctgcccccccccgcccccgagcccagcccccacagcggcaccccccagcccgccctgggccagcccgcccccctgctgcccgccgccgtgggcgccgtgagcctggccaccagccagctgcccagcccccccctgggccccaccgtgcccccccagccccccagcgccctggagagcgacggcgagggccccccccccagagtgggcttcgtggacagcaccatcaagagcctggacgagaagctgagaaccctgctgtaccaggagcacgtgcccaccagcagcgccagcgccggcacccccgtggaggtgggcgacagagacttcaccctggagcccctgagaggcgaccagcccagaagcgaggtgtgcggcggcgacctggccctgccccccgtgcccaaggaggccgtgagcggcagagtgcagctgccccagcccctggtggagaagagcgagctggcccccaccagaggcgccgtgatggagcagggcaccagcagcagcatgaccgccgagagcagccccagaagcatgctgggctacgacagagacggcagacaggtggccagcgacagccacgtggtgcccagcgtgccccaggacgtgcccgccttcgtgagacccgccagagtggagcccaccgacagagacggcggcgaggccggcgagagcagcgccgagcccccccccagcgacatgggcaccgtgggcggccaggccagccacccccagaccctgggcgccagagccctgggcagccccagaaagagacccgagcagcaggacgtgagcagccccgccaagaccgtgggcagattcagcgtggtgagcacccaggacgagtggaccctggccagcccccacagcctgagatacagcgccccccccgacgtgtacctggacgaggcccccagcagccccgacgtgaagctggccgtgagaagagcccagaccgccagcagcatcgaggtgggcgtgggcgagcccgtgagcagcgacagcggcgacgagggccccagagccagaccccccgtgcagaagcaggccagcctgcccgtgagcggcagcgtggccggcgacttcgtgaagaaggccaccgccttcctgcagagacccagcagagccggcagcctgggccccgagacccccagcagagtgggcatgaaggtgcccaccatcagcgtgaccagcttccacagccagagcagctacatcagcagcgacaacgacagcgagctggaggacgccgacatcaagaaggagctgcagagcctgagagagaagcacctgaaggagatcagcgagctgcagagccagcagaagcaggagatcgaggccctgtacagaagactgggcaagcccctgccccccaacgtgggcttcttccacaccgccccccccaccggcagaagaagaaagaccagcaagagcaagctgaaggccggcaagctgctgaaccccctggtgagacagctgaaggtggtggccagcagcaccggccacctggccgacagcagcagaggcccccccgccaaggaccccgcccaggccagcgtgggcctgaccgccgacagcaccggcctgagcggcaaggccgtgcagacccagcagccctgcagcgtgagagccagcctgagcagcgacatctgcagcggcctggccagcgacggcggcggcgccagaggccagggctggaccgtgtaccaccccaccagcgagagagtgacctacaagagcagcagcaagcccagagccagattcctgagcggccccgtgagcgtgagcatctggagcgccctgaagagactgtgcctgggcaaggagcacagcagcagaagcagcaccagcagcctggcccccggccccgagcccggcccccagcccgccctgcacgtgcaggcccaggtgaacaacagcaacaacaagaagggcaccttcaccgacgacctgcacaagctggtggacgagtggaccagcaagaccgtgggcgccgcccagctgaagcccaccctgaaccagctgaagcagacccagaagctgcaggacatggaggcccaggccggctgggccgcccccggcgaggccagagccatgaccgcccccagagccggcgtgggcatgcccagactgccccccgcccccggccccctgagcaccaccgtgatccccggcgccgcccccaccctgagcgtgcccacccccgaccccgagagcgagaagcccgactag

SEQ ID NO: 105311 - DNA, 1092 bp, Artificial Sequence
  Description of Artificial Sequence: Synthetic coding sequence
atggagcagggcaccagcagcagcatgaccgagagcagccccagaagcatgctgggctacgacagagacggcagacaggtggccagcgacagccacgtggtgcccagcgtgccccaggacgtgcccgccttcgtgagacccgccagagtggagcccaccgacagagacggcggcgaggccggcgagagcagcgccgagcccccccccagcgacatgggcaccgtgggcggccaggccagccacccccagaccctgggcgccagagccctgggcagccccagaaagagacccgagcagcaggacgtgagcagccccgccaagaccgtgggcagattcagcgtggtgagcacccaggacgagtggaccctggccagcccccacagcctgagatacagcgccccccccgacgtgtacctggacgaggcccccagcagccccgacgtgaagctggccgtgagaagagcccagaccgccagcagcatcgaggtgggcgtgggcgagcccgtgagcagcgacagcggcgacgagggccccagagccagaccccccgtgcagaagcaggccagcctgcccgtgagcggcagcgtggccggcgacttcgtgaagaaggccaccagctgcagaggcctgctgggccccagcctgggccccgagacccccagcagagtgggcatgaaggtgcccaccatcagcgtgaccagcttccacagccagagcagctacatcagcagcgacaacgacagcgagctggaggacgccgacatcaagaaggagctgcagagcctgagagagaagcacctgaaggagatcagcgagctgcagagccagcagaagcaggagatcgaggccctgtacagaagactgggcaagcccctgccccccaacgtgggcttcttccacaccgccccccccaccggcagaagaagaaagaccagcaagagcaagctgaaggccggcaagctgctgaaccccctggtgagacagctgaaggtggtggccagcagcaccggccacctggccgacagcagcagaggcccccccgccaaggaccccaagcccgtgtggggcagcctgcagaccgccagagcctag

SEQ ID NO: 105312 - DNA, 2340 bp, Artificial Sequence
  Description of Artificial Sequence: Synthetic coding sequence
atggagcccggcagaggcgccggccccgccggcatggccgagcccagagccaaggccgccagacccggcccccagagattcctgagaagaagcgtggtggagagcgaccaggaggagccccccggcctggaggccgccgaggcccccggcccccagcccccccagcccctgcagagaagagtgctgctgctgtgcaagaccagaagactgatcgccgagagagccagaggcagacccgccgcccccgcccccgccgccctggtggcccagcccggcgcccccggcgcccccgccgacgccggccccgagcccgtgggcacccaggagcccggccccgaccccatcgccgccgccgtggagaccgcccccgcccccgacggcggccccagagaggaggccgccgccaccgtgagaaaggaggacgagggcgccgccgaggccaagcccgagcccggcagaaccagaagagacgagcccgaggaggaggaggacgacgaggacgacctgaaggccgtggccaccagcctggacggcagattcctgaagttcgacatcgagctgggcagaggcagcttcaagaccgtgtacaagggcctggacaccgagacctgggtggaggtggcctggtgcgagctgcaggacagaaagctgaccaagctggagagacagagattcaaggaggaggccgagatgctgaagggcctgcagcaccccaacatcgtgagattctacgacttctgggagagcagcgccaagggcaagagatgcatcgtgctggtgaccgagctgatgaccagcggcaccctgaagacctacctgaagagattcaaggtgatgaagcccaaggtgctgagaagctggtgcagacagatcctgaagggcctgctgttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgacctgcggcatcaagcccgccagcttcgagaaggtgcacgaccccgagatcaaggagatcatcggcgagtgcatctgcaagaacaaggaggagagatacgagatcaaggacctgctgagccacgccttcttcgccgaggacaccggcgtgagagtggagctggccgaggaggaccacggcagaaagagcaccatcgccctgagactgtgggtggaggaccccaagaagctgaagggcaagcccaaggacaacggcgccatcgagttcaccttcgacctggagaaggagacccccgacgaggtggcccaggagatgatcgagagcggcttcttccacgagagcgacgtgaagatcgtggccaagagcatcagagacagagtggccctgatccagtggagaagagagagaatctggcccgccctgcagcccaaggagcagcaggacgtgggcagccccgacaaggccagaggcccccccgtgcccctgcaggtgcaggtgacctaccacgcccaggccggccagcccggcccccccgagcccgaggagcccgaggccgaccagcacctgctgccccccaccctgcccaccagcgccaccagcctggccagcgacagcaccttcgacagcggccagggcagcaccgtgtacagcgacagccagagcagccagcagagcgtgatgctgggcagcctggccgacgccgcccccagccccgcccagtgcgtgtgcagcccccccgtgagcgagggccccgtgctgccccagagcctgcccagcctgggcgcctaccagcagcccaccgccgcccccccccccctggcccagcccacccccctgccccaggtgctggccccccagcccgtggtgcccctgcagcccgtgcccccccacctgcccccctacctggcccccgccagccaggtgggcgcccccgcccagctgaagcccctgcagatgccccaggcccccctgcagcccctggcccaggtgcccccccagatgccccccatccccgtggtgccccccatcacccccctggccggcatcgacggcctgccccccgccctgcccgacctgcccaccgccaccgtgccccccgtgccccccccccagtacttcagccccgccgtgatcctgcccagcctggccgcctag

SEQ ID NO: 105313 - DNA, 6654 bp, Artificial Sequence
  Description of Artificial Sequence: Synthetic coding sequence
atggacggcgacggcggcagaagagacgtgcccggcaccctgatggagcccggcagaggcgccggccccgccggcatggccgagcccagagccaaggccgccagacccggcccccagagattcctgagaagaagcgtggtggagagcgaccaggaggagccccccggcctggaggccgccgaggcccccggcccccagcccccccagcccctgcagagaagagtgctgctgctgtgcaagaccagaagactgatcgccgagagagccagaggcagacccgccgcccccgcccccgccgccctggtggcccagcccggcgcccccggcgcccccgccgacgccggccccgagcccgtgggcacccaggagcccggccccgaccccatcgccgccgccgtggagaccgcccccgcccccgacggcggccccagagaggaggccgccgccaccgtgagaaaggaggacgagggcgccgccgaggccaagcccgagcccggcagaaccagaagagacgagcccgaggaggaggaggacgacgaggacgacctgaaggccgtggccaccagcctggacggcagattcctgaagttcgacatcgagctgggcagaggcagcttcaagaccgtgtacaagggcctggacaccgagacctgggtggaggtggcctggtgcgagctgcaggacagaaagctgaccaagctggagagacagagattcaaggaggaggccgagatgctgaagggcctgcagcaccccaacatcgtgagattctacgacttctgggagagcagcgccaagggcaagagatgcatcgtgctggtgaccgagctgatgaccagcggcaccctgaagacctacctgaagagattcaaggtgatgaagcccaaggtgctgagaagctggtgcagacagatcctgaagggcctgctgttcctgcacaccagaaccccccccatcatccacagagacctgaagtgcgacaacatcttcatcaccggccccaccggcagcgtgaagatcggcgacctgggcctggccaccctgaagagagccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgacctgcggcatcaagcccgccagcttcgagaaggtgcacgaccccgagatcaaggagatcatcggcgagtgcatctgcaagaacaaggaggagagatacgagatcaaggacctgctgagccacgccttcttcgccgaggacaccggcgtgagagtggagctggccgaggaggaccacggcagaaagagcaccatcgccctgagactgtgggtggaggaccccaagaagctgaagggcaagcccaaggacaacggcgccatcgagttcaccttcgacctggagaaggagacccccgacgaggtggcccaggagatgatcgagagcggcttcttccacgagagcgacgtgaagatcgtggccaagagcatcagagacagagtggccctgatccagtggagaagagagagaatctggcccgccctgcagcccaaggagcagcaggacgtgggcagccccgacaaggccagaggcccccccgtgcccctgcaggtgcaggtgacctaccacgcccaggccggccagcccggcccccccgagcccgaggagcccgaggccgaccagcacctgctgccccccaccctgcccaccagcgccaccagcctggccagcgacagcaccttcgacagcggccagggcagcaccgtgtacagcgacagccagagcagccagcagagcgtgatgctgggcagcctggccgacgccgcccccagccccgcccagtgcgtgtgcagcccccccgtgagcgagggccccgtgctgccccagagcctgcccagcctgggcgcctaccagcagcccaccgccgcccccggcctgcccgtgggcagcgtgcccgcccccgcctgcccccccagcctgcagcagcacttccccgaccccgccatgagcttcgcccccgtgctgcccccccccagcacccccatgcccaccggccccggccagcccgccccccccggccagcagcccccccccctggcccagcccacccccctgccccaggtgctggccccccagcccgtggtgcccctgcagcccgtgcccccccacctgcccccctacctggcccccgccagccaggtgggcgcccccgcccagctgaagcccctgcagatgccccaggcccccctgcagcccctggcccaggtgcccccccagatgccccccatccccgtggtgccccccatcacccccctggccggcatcgacggcctgccccccgccctgcccgacctgcccaccgccaccgtgccccccgtgccccccccccagtacttcagccccgccgtgatcctgcccagcctggccgcccccctgccccccgccagccccgccctgcccctgcaggccgtgaagctgccccacccccccggcgcccccctggccatgccctgcagaaccatcgtgcccaacgcccccgccaccatccccctgctggccgtggccccccccggcgtggccgccctgagcatccacagcgccgtggcccagctgcccggccagcccgtgtaccccgccgccttcccccagatggcccccaccgacgtgccccccagcccccaccacaccgtgcagaacatgagagccacccccccccagcccgccctgcccccccagcccaccctgcccccccagcccgtgctgcccccccagcccaccctgcccccccagcccgtgctgcccccccagcccaccagacccccccagcccgtgctgcccccccagcccatgctgcccccccagcccgtgctgcccccccagcccgccctgcccgtgagacccgagcccctgcagccccacctgcccgagcaggccgcccccgccgccacccccggcagccagatcctgctgggccaccccgccccctacgccgtggacgtggccgcccaggtgcccaccgtgcccgtgccccccgccgccgtgctgagcccccccctgcccgaggtgctgctgcccgccgcccccgagctgctgccccagttccccagcagcctggccaccgtgagcgccagcgtgcagagcgtgcccacccagaccgccaccctgctgccccccgccaacccccccctgcccggcggccccggcatcgccagcccctgccccaccgtgcagctgaccgtggagcccgtgcaggaggagcaggccagccaggacaagccccccggcctgccccagagctgcgagagctacggcggcagcgacgtgaccagcggcaaggagctgagcgacagctgcgagggcgccttcggcggcggcagactggagggcagagccgccagaaagcaccacagaagaagcaccagagccagaagcagacaggagagagccagcagacccagactgaccatcctgaacgtgtgcaacaccggcgacaagatggtggagtgccagctggagacccacaaccacaagatggtgaccttcaagttcgacctggacggcgacgcccccgacgagatcgccacctacatggtggagcacgacttcatcctgcaggccgagagagagaccttcatcgagcagatgaaggacgtgatggacaaggccgaggacatgctgagcgaggacaccgacgccgacagaggcagcgaccccggcaccagccccccccacctgagcacctgcggcctgggcaccggcgaggagagcagacagagccaggccaacgcccccgtgtaccagcagaacgtgctgcacaccggcaagagatggttcatcatctgccccgtggccgagcaccccgcccccgaggcccccgagagcagcccccccctgcccctgagcagcctgccccccgaggccagccaggacagcgccccctacaaggaccagctgagcagcaaggagcagcccagcttcctggccagccagcagctgctgagccaggccggccccagcaacccccccggcgccccccccgcccccctggcccccagcagcccccccgtgaccgccctgccccaggacggcgccgcccccgccaccagcaccatgcccgagcccgccagcggcaccgccagccaggccggcggccccggcaccccccagggcctgaccagcgagctggagaccagccagcccctggccgagacccacgaggcccccctggccgtgcagcccctggtggtgggcctggccccctgcacccccgcccccgaggccgccagcaccagagacgccagcgcccccagagagcccctgcccccccccgcccccgagcccagcccccacagcggcaccccccagcccgccctgggccagcccgcccccctgctgcccgccgccgtgggcgccgtgagcctggccaccagccagctgcccagcccccccctgggccccaccgtgcccccccagccccccagcgccctggagagcgacggcgagggccccccccccagagtgggcttcgtggacagcaccatcaagagcctggacgagaagctgagaaccctgctgtaccaggagcacgtgcccaccagcagcgccagcgccggcacccccgtggaggtgggcgacagagacttcaccctggagcccctgagaggcgaccagcccagaagcgaggtgtgcggcggcgacctggccctgccccccgtgcccaaggaggccgtgagcggcagagtgcagctgccccagcccctggtggagaagagcgagctggcccccaccagaggcgccgtgatggagcagggcaccagcagcagcatgaccgccgagagcagccccagaagcatgctgggctacgacagagacggcagacaggtggccagcgacagccacgtggtgcccagcgtgccccaggacgtgcccgccttcgtgagacccgccagagtggagcccaccgacagagacggcggcgaggccggcgagagcagcgccgagcccccccccagcgacatgggcaccgtgggcggccaggccagccacccccagaccctgggcgccagagccctgggcagccccagaaagagacccgagcagcaggacgtgagcagccccgccaagaccgtgggcagattcagcgtggtgagcacccaggacgagtggaccctggccagcccccacagcctgagatacagcgccccccccgacgtgtacctggacgaggcccccagcagccccgacgtgaagctggccgtgagaagagcccagaccgccagcagcatcgaggtgggcgtgggcgagcccgtgagcagcgacagcggcgacgagggccccagagccagaccccccgtgcagaagcaggccagcctgcccgtgagcggcagcgtggccggcgacttcgtgaagaaggccaccgccttcctgcagagacccagcagagccggcagcctgggccccgagacccccagcagagtgggcatgaaggtgcccaccatcagcgtgaccagcttccacagccagagcagctacatcagcagcgacaacgacagcgagctggaggacgccgacatcaagaaggagctgcagagcctgagagagaagcacctgaaggagatcagcgagctgcagagccagcagaagcaggagatcgaggccctgtacagaagactgggcaagcccctgccccccaacgtgggcttcttccacaccgccccccccaccggcagaagaagaaagaccagcaagagcaagctgaaggccggcaagctgctgaaccccctggtgagacagctgaaggtggtggccagcagcaccggccacctggccgacagcagcagaggcccccccgccaaggaccccgcccaggccagcgtgggcctgaccgccgacagcaccggcctgagcggcaaggccgtgcagacccagcagccctgcagcgtgagagccagcctgagcagcgacatctgcagcggcctggccagcgacggcggcggcgccagaggccagggctggaccgtgtaccaccccaccagcgagagagtgacctacaagagcagcagcaagcccagagccagattcctgagcggccccgtgagcgtgagcatctggagcgccctgaagagactgtgcctgggcaaggagcacagcagcagaagcagcaccagcagcctggcccccggccccgagcccggcccccagcccgccctgcacgtgcaggcccaggtgaacaacagcaacaacaagaagggcaccttcaccgacgacctgcacaagctggtggacgagtggaccagcaagaccgtgggcgccgcccagctgaagcccaccctgaaccagctgaagcagacccagaagctgcaggacatggaggcccaggccggctgggccgcccccggcgaggccagagccatgaccgcccccagagccggcgtgggcatgcccagactgccccccgcccccggccccctgagcaccaccgtgatccccggcgccgcccccaccctgagcgtgcccacccccgaccccgagagcgagaagcccgactag

SEQ ID NO: 105314 - DNA, 5511 bp, Artificial Sequence
  Description of Artificial Sequence: Synthetic coding sequence
atggccaccagcgagtacccctacagcgagtgccagaacgccgcccagatctacagaaaggtgacctgcggcatcaagcccgccagcttcgagaaggtgcacgaccccgagatcaaggagatcatcggcgagtgcatctgcaagaacaaggaggagagatacgagatcaaggacctgctgagccacgccttcttcgccgaggacaccggcgtgagagtggagctggccgaggaggaccacggcagaaagagcaccatcgccctgagactgtgggtggaggaccccaagaagctgaagggcaagcccaaggacaacggcgccatcgagttcaccttcgacctggagaaggagacccccgacgaggtggcccaggagatgatcgagagcggcttcttccacgagagcgacgtgaagatcgtggccaagagcatcagagacagagtggccctgatccagtggagaagagagagaatctggcccgccctgcagcccaaggagcagcaggacgtgggcagccccgacaaggccagaggcccccccgtgcccctgcaggtgcaggtgacctaccacgcccaggccggccagcccggcccccccgagcccgaggagcccgaggccgaccagcacctgctgccccccaccctgcccaccagcgccaccagcctggccagcgacagcaccttcgacagcggccagggcagcaccgtgtacagcgacagccagagcagccagcagagcgtgatgctgggcagcctggccgacgccgcccccagccccgcccagtgcgtgtgcagcccccccgtgagcgagggccccgtgctgccccagagcctgcccagcctgggcgcctaccagcagcccaccgccgcccccggcctgcccgtgggcagcgtgcccgcccccgcctgcccccccagcctgcagcagcacttccccgaccccgccatgagcttcgcccccgtgctgcccccccccagcacccccatgcccaccggccccggccagcccgccccccccggccagcagcccccccccctggcccagcccacccccctgccccaggtgctggccccccagcccgtggtgcccctgcagcccgtgcccccccacctgcccccctacctggcccccgccagccaggtgggcgcccccgcccagctgaagcccctgcagatgccccaggcccccctgcagcccctggcccaggtgcccccccagatgccccccatccccgtggtgccccccatcacccccctggccggcatcgacggcctgccccccgccctgcccgacctgcccaccgccaccgtgccccccgtgccccccccccagtacttcagccccgccgtgatcctgcccagcctggccgcccccctgccccccgccagccccgccctgcccctgcaggccgtgaagctgccccacccccccggcgcccccctggccatgccctgcagaaccatcgtgcccaacgcccccgccaccatccccctgctggccgtggccccccccggcgtggccgccctgagcatccacagcgccgtggcccagctgcccggccagcccgtgtaccccgccgccttcccccagatggcccccaccgacgtgccccccagcccccaccacaccgtgcagaacatgagagccacccccccccagcccgccctgcccccccagcccaccctgcccccccagcccgtgctgcccccccagcccaccctgcccccccagcccgtgctgcccccccagcccaccagacccccccagcccgtgctgcccccccagcccatgctgcccccccagcccgtgctgcccccccagcccgccctgcccgtgagacccgagcccctgcagccccacctgcccgagcaggccgcccccgccgccacccccggcagccagatcctgctgggccaccccgccccctacgccgtggacgtggccgcccaggtgcccaccgtgcccgtgccccccgccgccgtgctgagcccccccctgcccgaggtgctgctgcccgccgcccccgagctgctgccccagttccccagcagcctggccaccgtgagcgccagcgtgcagagcgtgcccacccagaccgccaccctgctgccccccgccaacccccccctgcccggcggccccggcatcgccagcccctgccccaccgtgcagctgaccgtggagcccgtgcaggaggagcaggccagccaggacaagccccccggcctgccccagagctgcgagagctacggcggcagcgacgtgaccagcggcaaggagctgagcgacagctgcgagggcgccttcggcggcggcagactggagggcagagccgccagaaagcaccacagaagaagcaccagagccagaagcagacaggagagagccagcagacccagactgaccatcctgaacgtgtgcaacaccggcgacaagatggtggagtgccagctggagacccacaaccacaagatggtgaccttcaagttcgacctggacggcgacgcccccgacgagatcgccacctacatggtggagcacgacttcatcctgcaggccgagagagagaccttcatcgagcagatgaaggacgtgatggacaaggccgaggacatgctgagcgaggacaccgacgccgacagaggcagcgaccccggcaccagccccccccacctgagcacctgcggcctgggcaccggcgaggagagcagacagagccaggccaacgcccccgtgtaccagcagaacgtgctgcacaccggcaagagatggttcatcatctgccccgtggccgagcaccccgcccccgaggcccccgagagcagcccccccctgcccctgagcagcctgccccccgaggccagccaggacagcgccccctacaaggaccagctgagcagcaaggagcagcccagcttcctggccagccagcagctgctgagccaggccggccccagcaacccccccggcgccccccccgcccccctggcccccagcagcccccccgtgaccgccctgccccaggacggcgccgcccccgccaccagcaccatgcccgagcccgccagcggcaccgccagccaggccggcggccccggcaccccccagggcctgaccagcgagctggagaccagccagcccctggccgagacccacgaggcccccctggccgtgcagcccctggtggtgggcctggccccctgcacccccgcccccgaggccgccagcaccagagacgccagcgcccccagagagcccctgcccccccccgcccccgagcccagcccccacagcggcaccccccagcccgccctgggccagcccgcccccctgctgcccgccgccgtgggcgccgtgagcctggccaccagccagctgcccagcccccccctgggccccaccgtgcccccccagccccccagcgccctggagagcgacggcgagggccccccccccagagtgggcttcgtggacagcaccatcaagagcctggacgagaagctgagaaccctgctgtaccaggagcacgtgcccaccagcagcgccagcgccggcacccccgtggaggtgggcgacagagacttcaccctggagcccctgagaggcgaccagcccagaagcgaggtgtgcggcggcgacctggccctgccccccgtgcccaaggaggccgtgagcggcagagtgcagctgccccagcccctggtggagaagagcgagctggcccccaccagaggcgccgtgatggagcagggcaccagcagcagcatgaccgccgagagcagccccagaagcatgctgggctacgacagagacggcagacaggtggccagcgacagccacgtggtgcccagcgtgccccaggacgtgcccgccttcgtgagacccgccagagtggagcccaccgacagagacggcggcgaggccggcgagagcagcgccgagcccccccccagcgacatgggcaccgtgggcggccaggccagccacccccagaccctgggcgccagagccctgggcagccccagaaagagacccgagcagcaggacgtgagcagccccgccaagaccgtgggcagattcagcgtggtgagcacccaggacgagtggaccctggccagcccccacagcctgagatacagcgccccccccgacgtgtacctggacgaggcccccagcagccccgacgtgaagctggccgtgagaagagcccagaccgccagcagcatcgaggtgggcgtgggcgagcccgtgagcagcgacagcggcgacgagggccccagagccagaccccccgtgcagaagcaggccagcctgcccgtgagcggcagcgtggccggcgacttcgtgaagaaggccaccgccttcctgcagagacccagcagagccggcagcctgggccccgagacccccagcagagtgggcatgaaggtgcccaccatcagcgtgaccagcttccacagccagagcagctacatcagcagcgacaacgacagcgagctggaggacgccgacatcaagaaggagctgcagagcctgagagagaagcacctgaaggagatcagcgagctgcagagccagcagaagcaggagatcgaggccctgtacagaagactgggcaagcccctgccccccaacgtgggcttcttccacaccgccccccccaccggcagaagaagaaagaccagcaagagcaagctgaaggccggcaagctgctgaaccccctggtgagacagctgaaggtggtggccagcagcaccggccacctggccgacagcagcagaggcccccccgccaaggaccccgcccaggccagcgtgggcctgaccgccgacagcaccggcctgagcggcaaggccgtgcagacccagcagccctgcagcgtgagagccagcctgagcagcgacatctgcagcggcctggccagcgacggcggcggcgccagaggccagggctggaccgtgtaccaccccaccagcgagagagtgacctacaagagcagcagcaagcccagagccagattcctgagcggccccgtgagcgtgagcatctggagcgccctgaagagactgtgcctgggcaaggagcacagcagcagaagcagcaccagcagcctggcccccggccccgagcccggcccccagcccgccctgcacgtgcaggcccaggtgaacaacagcaacaacaagaagggcaccttcaccgacgacctgcacaagctggtggacgagtggaccagcaagaccgtgggcgccgcccagctgaagcccaccctgaaccagctgaagcagacccagaagctgcaggacatggaggcccaggccggctgggccgcccccggcgaggccagagccatgaccgcccccagagccggcgtgggcatgcccagactgccccccgcccccggccccctgagcaccaccgtgatccccggcgccgcccccaccctgagcgtgcccacccccggcagctgcggccccagagccgtgagcacccccaccagctacacctag

SEQ ID NO: 105315 - DNA, 5403 bp, Artificial Sequence
  Description of Artificial Sequence: Synthetic coding sequence
atggccaccgacagcggcgaccccgccagcaccgaggacagcgagaagcccgacggcatcagcttcgagaacagagtgccccaggtggccgccaccctgaccgtggaggccagactgaaggagaagaacagcaccttcagcgccagcggcgagaccgtggagagaaagagattcttcagaaagagcgtggagatgaccgaggacgacaaggtggccgagagcagccccaaggacgagagaatcaaggccgccatgaacatccccagagtggacaagctgcccagcaacgtgctgagaggcggccaggaggtgaagtacgagcagtgcagcaagagcaccagcgagatcagcaaggactgcttcaaggagaagaacgagaaggagatggaggaggaggccgagatgaaggccgtggccaccagccccagcggcagattcctgaagttcgacatcgagctgggcagaggcgccttcaagaccgtgtacaagggcctggacaccgagacctgggtggaggtggcctggtgcgagctgcaggacagaaagctgaccaaggccgagcagcagagattcaaggaggaggccgagatgctgaagggcctgcagcaccccaacatcgtgagattctacgacagctgggagagcatcctgaagggcaagaagtgcatcgtgctggtgaccgagctgatgaccagcggcaccctgaagacctacctgaagagattcaaggtgatgaagcccaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgatgagaaccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgaccagcggcatcaagcccgccagcttcaacaaggtgaccgaccccgaggtgaaggagatcatcgagggctgcatcagacagaacaagagcgagagactgagcatcagagacctgctgaaccacgccttcttcgccgaggacaccggcctgagagtggagctggccgaggaggacgactgcagcaacagcagcctggccctgagactgtgggtggaggaccccaagaagctgaagggcaagcacaaggacaacgaggccatcgagttcagcttcaacctggagaccgacacccccgaggaggtggcctacgagatggtgaagagcggcttcttccacgagagcgacagcaaggccgtggccaagagcatcagagacagagtgacccccatcaagaagaccagagagaagaagcccgccggctgcctggaggagagaagagacagccagtgcaagagcatgggcaacgtgttcccccagccccagaacaccaccctgcccctggcccccgcccagcagaccggcgccgagtgcgaggagaccgaggtggaccagcacgtgagacagcagctgctgcagagaaagccccagcagcactgcagcagcgtgaccggcgacaacctgagcgaggccggcgccgccagcgtgatccacagcgacaccagcagccagcccagcgtggcctacagcagcaaccagaccatgggcagccagatggtgagcaacatcccccaggccgaggtgaacgtgcccggccagatctacagcagccagcagctggtgggccactaccagcaggtgagcggcctgcagaagcacagcaagctgacccagccccagatcctgcccctggtgcagggccagagcaccgtgctgcccgtgcacgtgctgggccccaccgtggtgagccagccccaggtgagccccctgaccgtgcagaaggtgccccagatcaagcccgtgagccagcccgtgggcgccgagcagcaggccgccctgctgaagcccgacctggtgagaagcctgaaccaggacgtggccaccaccaaggagaacgtgagcagccccgacaaccccagcggcaacggcaagcaggacagaatcaagcagagaagagccagctgccccagacccgagaagggcaccaagttccagctgaccgtgctgcaggtgagcaccagcggcgacaacatggtggagtgccagctggagacccacaacaacaagatggtgaccttcaagttcgacgtggacggcgacgcccccgaggacatcgccgactacatggtggaggacaacttcgtgctggagagcgagaaggagaagttcgtggaggagctgagagccatcgtgggccaggcccaggagatcctgcacgtgcacttcgccaccgagagagccaccggcgtggacagcatcaccgtggacagcaacagcagccagaccggcagcagcgagcaggtgcagatcaacagcaccagcacccagaccagcaacgagagcgccccccagagcagccccgtgggcagatggagattctgcatcaaccagaccatcagaaacagagagacccagagcccccccagcctgcagcacagcatgagcgccgtgcccggcagacaccccctgcccagccccaagaacaccagcaacaaggagatcagcagagacaccctgctgaccatcgagaacaacccctgccacagagccctgttcaccagcaagagcgagcacaaggacgtggtggacggcaagatcagcgagtgcgccagcgtggagaccaagcagcccgccatcctgtaccaggtggaggacaacagacagatcatggcccccgtgaccaacagcagcagctacagcaccaccagcgtgagagccgtgcccgccgagtgcgagggcctgaccaagcaggccagcatcttcatccccgtgtacccctgccaccagaccgccagccaggccgacgccctgatgagccaccccggcgagagcacccagaccagcggcaacagcctgaccaccctggccttcgaccagaagccccagaccctgagcgtgcagcagcccgccatggacgccgagttcatcagccaggagggcgagaccaccgtgaacaccgaggccagcagccccaagaccgtgatccccacccagacccccggcctggagcccaccaccctgcagcccaccaccgtgctggagagcgacggcgagagaccccccaagctggagttcgccgacaacagaatcaagaccctggacgagaagctgagaaacctgctgtaccaggagcacagcatcagcagcatctaccccgagagccagaaggacacccagagcatcgacagccccttcagcagcagcgccgaggacaccctgagctgccccgtgaccgaggtgatcgccatcagccactgcggcatcaaggacagccccgtgcagagccccaacttccagcagaccggcagcaagctgctgagcaacgtggccgccagccagcccgccaacatcagcgtgttcaagagagacctgaacgtgatcaccagcgtgcccagcgagctgtgcctgcacgagatgagcagcgacgccagcctgcccggcgaccccgaggcctaccccgccgccgtgagcagcggcggcgccatccacctgcagaccggcggcggctacttcggcctgagcttcacctgccccagcctgaagaaccccatcagcaagaagagctggaccagaaagctgaagagctgggcctacagactgagacagagcaccagcttcttcaagagaagcaaggtgagacaggtggagaccgaggagatgagaagcgccatcgcccccgaccccatccccctgaccagagagagcaccgccgacaccagagccctgaacagatgcaaggccatgagcggcagcttccagagaggcagattccaggtgatcaccatcccccagcagcagagcgccaagatgaccagcttcggcatcgagcacatcagcgtgttcagcgagaccaaccacagcagcgaggaggccttcatcaagaccgccaagagccagctggtggagatcgagcccgccacccagaaccccaagaccagcttcagctacgagaagctgcaggccctgcaggagacctgcaaggagaacaagggcgtgcccaagcagggcgacaacttcctgagcttcagcgccgcctgcgagaccgacgtgagcagcgtgacccccgagaaggagttcgaggagaccagcgccaccggcagcagcatgcagagcggcagcgagctgctgctgaaggagagagagatcctgaccgccggcaagcagcccagcagcgacagcgagttcagcgccagcctggccggcagcggcaagagcgtggccaagaccggccccgagagcaaccagtgcctgccccaccacgaggagcaggcctacgcccagacccagagcagcctgttctacagccccagcagccccatgagcagcgacgacgagagcgagatcgaggacgaggacctgaaggtggagctgcagagactgagagagaagcacatccaggaggtggtgaacctgcagacccagcagaacaaggagctgcaggagctgtacgagagactgagaagcatcaaggacagcaagacccagagcaccgagatccccctgccccccgccagccccagaagacccagaagcttcaagagcaagctgagaagcagaccccagagcctgacccacgtggacaacggcatcgtggccaccggcaagagctgcctgatcaacgagctggagaaccccctgtgcgtggagagcaacgccgccagctgccagcagagccccgccagcaagaagggcatgttcaccgacgacctgcacaagctggtggacgactggaccaaggaggccgtgggcaacagcctgatcaagcccagcctgaaccagctgaagcagagccagcacaagctggagaccgagaactggaacaaggtgagcgagaacacccccagcaccatgggctacaccagcacctggatcagcagcctgagccagatcagaggcgccgtgcccaccagcctgccccagggcctgagcctgcccagcttccccggccccctgagcagctacggcatgccccacgtgtgccagtacaacgccgtggccggcgccggctaccccgtgcagtgggtgggcatcagcggcaccacccagcagagcgtggtgatccccgcccagagcggcggccccttccagcccggcatgaacatgcaggccttccccaccagcagcgtgcagaaccccgccaccatcccccccggccccaagtag

SEQ ID NO: 105316 - DNA, 5403 bp, Artificial Sequence; identical to SEQ ID NO: 105315
  Description of Artificial Sequence: Synthetic coding sequence

SEQ ID NO: 105317 - DNA, 5232 bp, Artificial Sequence
  Description of Artificial Sequence: Synthetic coding sequence
atggccaccgacagcggcgaccccgccagcaccgaggacagcgagaagcccgacggcatcagcttcgagaacagagtgccccaggtggccgccaccctgaccgtggaggccagactgaaggagaagaacagcaccttcagcgccagcggcgagaccgtggagagaaagagattcttcagaaagagcgtggagatgaccgaggacgacaaggtggccgagagcagccccaaggacgagagaatcaaggccgccatgaacatccccagagtggacaagctgcccagcaacgtgctgagaggcggccaggaggtgaagtacgagcagtgcagcaagagcaccagcgagatcagcaaggactgcttcaaggagaagaacgagaaggagatggaggaggaggccgagatgaaggccgtggccaccagccccagcggcagattcctgaagttcgacatcgagctgggcagaggcgccttcaagaccgtgtacaagggcctggacaccgagacctgggtggaggtggcctggtgcgagctgcaggacagaaagctgaccaaggccgagcagcagagattcaaggaggaggccgagatgctgaagggcctgcagcaccccaacatcgtgagattctacgacagctgggagagcatcctgaagggcaagaagtgcatcgtgctggtgaccgagctgatgaccagcggcaccctgaagacctacctgaagagattcaaggtgatgaagcccaaggtgctgagaagctggtgcagacagatcctgaagggcctgcagttcctgcacaccagaaccccccccatcatccacagagacctgaagtgcgacaacatcttcatcaccggccccaccggcagcgtgaagatcggcgacctgggcctggccaccctgatgagaaccagcttcgccaagagcgtgatcggcacccccgagttcatggcccccgagatgtacgaggagcactacgacgagagcgtggacgtgtacgccttcggcatgtgcatgctggagatggccaccagcgagtacccctacagcgagtgccagaacgccgcccagatctacagaaaggtgaccagcggcatcaagcccgccagcttcaacaaggtgaccgaccccgaggtgaaggagatcatcgagggctgcatcagacagaacaagagcgagagactgagcatcagagacctgctgaaccacgccttcttcgccgaggacaccggcctgagagtggagctggccgaggaggacgactgcagcaacagcagcctggccctgagactgtgggtggaggaccccaagaagctgaagggcaagcacaaggacaacgaggccatcgagttcagcttcaacctggagaccgacacccccgaggaggtggcctacgagatggtgaagagcggcttcttccacgagagcgacagcaaggccgtggccaagagcatcagagacagagtgacccccatcaagaagaccagagagaagaagcccgccggctgcctggaggagagaagagacagccagtgcaagagcatgggcaacgtgttcccccagccccagaacaccaccctgcccctggcccccgcccagcagaccggcgccgagtgcgaggagaccgaggtggaccagcacgtgagacagcagctgctgcagagaaagccccagcagcactgcagcagcgtgaccggcgacaacctgagcgaggccggcgccgccagcgtgatccacagcgacaccagcagccagcccagcgtggcctacagcagcaaccagaccatgggcagccagatggtgagcaacatcccccaggccgaggtgaacgtgcccggccagatctacagcagccagcagctggtgggccactaccagcaggtgagcggcctgcagaagcacagcaagctgacccagccccagatcctgcccctggtgcagggccagagcaccgtgctgcccgtgcacgtgctgggccccaccgtggtgagccagccccaggtgagccccctgaccgtgcagaaggtgccccagatcaagcccgtgagccagcccgtgggcgccgagcagcaggccgccctgctgaagcccgacctggtgagaagcctgaaccaggacgtggccaccaccaaggagaacgtgagcagccccgacaaccccagcggcaacggcaagcaggacagaatcaagcagagaagagccagctgccccagacccgagaagggcaccaagttccagctgaccgtgctgcaggtgagcaccagcggcgacaacatggtggagtgccagctggagacccacaacaacaagatggtgaccttcaagttcgacgtggacggcgacgcccccgaggacatcgccgactacatggtggaggacaacttcgtgctggagagcgagaaggagaagttcgtggaggagctgagagccatcgtgggccaggcccaggagatcctgcacgtgcacttcgccaccgagagagccaccggcgtggacagcatcaccgtggacagcaacagcagccagaccggcagcagcgagcaggtgcagatcaacagcaccagcacccagaccagcaacgagagcgccccccagagcagccccgtgggcagatggagattctgcatcaaccagaccatcagaaacagagagacccagagcccccccagcctgcagcacagcatgagcgccgtgcccggcagacaccccctgcccagccccaagaacaccagcaacaaggagatcagcagagacaccctgctgaccatcgagaacaacccctgccacagagccctgttcaccagcaagagcgagcacaaggacgtggtggacggcaagatcagcgagtgcgccagcgtggagaccaagcagcccgccatcctgtaccaggtggaggacaacagacagatcatggcccccgtgaccaacagcagcagctacagcaccaccagcgtgagagccgtgcccgccgagtgcgagggcctgaccaagcaggccagcatcttcatccccgtgtacccctgccaccagaccgccagccaggccgacgccctgatgagccaccccggcgagagcacccagaccagcggcaacagcctgaccaccctggccttcgaccagaagccccagaccctgagcgtgcagcagcccgccatggacgccgagttcatcagccaggagggcgagaccaccgtgaacaccgaggccagcagccccaagaccgtgatccccacccagacccccggcctggagcccaccaccctgcagcccaccaccgtgctggagagcgacggcgagagaccccccaagctggagttcgccgacaacagaatcaagaccctggacgagaagctgagaaacctgctgtaccaggagcacagcatcagcagcatctaccccgagagccagaaggacacccagagcatcgacagccccttcagcagcagcgccgaggacaccctgagctgccccgtgaccgaggtgatcgccatcagccactgcggcatcaaggacagccccgtgcagagccccaacttccagcagaccggcagcaagctgctgagcaacgtggccgccagccagcccgccaacatcagcgtgttcaagagagacctgaacgtgatcaccagcgtgcccagcgagctgtgcctgcacgagatgagcagcgacgccagcctgcccggcgaccccgaggcctaccccgccgccgtgagcagcggcggcgccatccacctgcagaccggcgtggagaccgaggagatgagaagcgccatcgcccccgaccccatccccctgaccagagagagcaccgccgacaccagagccctgaacagatgcaaggccatgagcggcagcttccagagaggcagattccaggtgatcaccatcccccagcagcagagcgccaagatgaccagcttcggcatcgagcacatcagcgtgttcagcgagaccaaccacagcagcgaggaggccttcatcaagaccgccaagagccagctggtggagatcgagcccgccacccagaaccccaagaccagcttcagctacgagaagctgcaggccctgcaggagacctgcaaggagaacaagggcgtgcccaagcagggcgacaacttcctgagcttcagcgccgcctgcgagaccgacgtgagcagcgtgacccccgagaaggagttcgaggagaccagcgccaccggcagcagcatgcagagcggcagcgagctgctgctgaaggagagagagatcctgaccgccggcaagcagcccagcagcgacagcgagttcagcgccagcctggccggcagcggcaagagcgtggccaagaccggccccgagagcaaccagtgcctgccccaccacgaggagcaggcctacgcccagacccagagcagcctgttctacagccccagcagccccatgagcagcgacgacgagagcgagatcgaggacgaggacctgaaggtggagctgcagagactgagagagaagcacatccaggaggtggtgaacctgcagacccagcagaacaaggagctgcaggagctgtacgagagactgagaagcatcaaggacagcaagacccagagcaccgagatccccctgccccccgccagccccagaagacccagaagcttcaagagcaagctgagaagcagaccccagagcctgacccacgtggacaacggcatcgtggccaccgaccccctgtgcgtggagagcaacgccgccagctgccagcagagccccgccagcaagaagggcatgttcaccgacgacctgcacaagctggtggacgactggaccaaggaggccgtgggcaacagcctgatcaagcccagcctgaaccagctgaagcagagccagcacaagctggagaccgagaactggaacaaggtgagcgagaacacccccagcaccatgggctacaccagcacctggatcagcagcctgagccagatcagaggcgccgtgcccaccagcctgccccagggcctgagcctgcccagcttccccggccccctgagcagctacggcatgccccacgtgtgccagtacaacgccgtggccggcgccggctaccccgtgcagtgggtgggcatcagcggcaccacccagcagagcgtggtgatccccgcccagagcggcggccccttccagcccggcatgaacatgcaggccttccccaccagcagcgtgcagaaccccgccaccatcccccccggccccaagtag

SEQ ID NO: 105318 - DNA, 498 bp, Artificial Sequence
  Description of Artificial Sequence: Synthetic coding sequence
atggccaccgacagcggcgaccccgccagcaccgaggacagcgagaagcccgacggcatcagcttcgagaacagagtgccccaggtggccgccaccctgaccgtggaggccagactgaaggagaagaacagcaccttcagcgccagcggcgagaccgtggagagaaagagattcttcagaaagagcgtggagatgaccgaggacgacaaggtggccgagagcagccccaaggacgagagaatcaaggccgccatgaacatccccagagtggacaagctgcccagcaacgtgctgagaggcggccaggaggtgaagtacgagcagtgcagcaagagcaccagcgagatcagcaaggactgcttcaaggagaagaacgagaaggagatggaggaggaggccgagatgaaggccgtggccaccagccccagcggcagattcctgaagttcgacatcgagctgggcagaggcgccttcaagaccgtgtacaagggcctgtag

SEQ ID NO: 105319 - DNA, 3732 bp, Artificial Sequence
  Description of Artificial Sequence: Synthetic coding sequence
atgctggccagccccgccaccgagaccaccgtgctgatgagccagaccgaggccgacctggccctgagaccccccccccccctgggcaccgccggccagcccagactgggccccccccccagaagagccagaagattcagcggcaaggccgagcccagacccagaagcagcagactgagcagaagaagcagcgtggacctgggcctgctgagcagctggagcctgcccgccagccccgcccccgacccccccgacccccccgacagcgccggccccggccccgccagaagccccccccccagcagcaaggagccccccgagggcacctggaccgagggcgcccccgtgaaggccgccgaggacagcgccagacccgagctgcccgacagcgccgtgggccccggcagcagagagcccctgagagtgcccgaggccgtggccctggagagaagaagagagcaggaggagaaggaggacatggagacccaggccgtggccaccagccccgacggcagatacctgaagttcgacatcgagatcggcagaggcagcttcaagaccgtgtacagaggcctggacaccgacaccaccgtggaggtggcctggtgcgagctgcagaccagaaagctgagcagagccgagagacagagattcagcgaggaggtggagatgctgaagggcctgcagcaccccaacatcgtgagattctacgacagctggaagagcgtgctgagaggccaggtgtgcatcgtgctggtgaccgagctgatgaccagcggcaccctgaagacctacctgagaagattcagagagatgaagcccagagtgctgcagagatggagcagacagatcctgagaggcctgcacttcctgcacagcagagtgccccccatcctgcacagagacctgaagtgcgacaacgtgttcatcaccggccccaccggcagcgtgaagatcggcgacctgggcctggccaccctgaagagagccagcttcgccaagagcgtgatcggcacccccgagttcatggcccccgagatgtacgaggagaagtacgacgaggccgtggacgtgtacgccttcggcatgtgcatgctggagatggccaccagcgagtacccctacagcgagtgccagaacgccgcccagatctacagaaaggtgaccagcggcagaaagcccaacagcttccacaaggtgaagatccccgaggtgaaggagatcatcgagggctgcatcagaaccgacaagaacgagagattcaccatccaggacctgctggcccacgccttcttcagagaggagagaggcgtgcacgtggagctggccgaggaggacgacggcgagaagcccggcctgaagctgtggctgagaatggaggacgccagaagaggcggcagacccagagacaaccaggccatcgagttcctgttccagctgggcagagacgccgccgaggaggtggcccaggagatggtggccctgggcctggtgtgcgaggccgactaccagcccgtggccagagccgtgagagagagagtggccgccatccagagaaagagagagaagctgagaaaggccagagagctggaggccctgccccccgagcccggccccccccccgccaccgtgcccatggcccccggcccccccagcgtgttcccccccgagcccgaggagcccgaggccgaccagcaccagcccttcctgttcagacacgccagctacagcagcaccaccagcgactgcgagaccgacggctacctgagcagcagcggcttcctggacgccagcgaccccgccctgcagccccccggcggcgtgcccagcagcctggccgagagccacctgtgcctgcccagcgccttcgccctgagcatccccagaagcggccccggcagcgacttcagccccggcgacagctacgccagcgacgccgccagcggcctgagcgacgtgggcgagggcatgggccagatgagaagaccccccggcagaaacctgagaagaagacccagaagcagactgagagtgaccagcgtgagcgaccagaacgacagagtggtggagtgccagctgcagacccacaacagcaagatggtgaccttcagattcgacctggacggcgacagccccgaggagatcgccgccgccatggtgtacaacgagttcatcctgcccagcgagagagacggcttcctgagaagaatcagagagatcatccagagagtggagaccctgctgaagagagacaccggccccatggaggccgccgaggacaccctgagcccccaggaggagcccgcccccctgcccgccctgcccgtgcccctgcccgaccccagcaacgaggagctgcagagcagcaccagcctggagcacagaagctggaccgccttcagcaccagcagcagcagccccggcacccccctgagccccggcaaccccttcagccccggcacccccatcagccccggccccatcttccccatcaccagccccccctgccaccccagccccagccccttcagccccatcagcagccaggtgagcagcaaccccagcccccaccccaccagcagccccctgcccttcagcagcagcacccccgagttccccgtgcccctgagccagtgcccctggagcagcctgcccaccaccagcccccccaccttcagccccacctgcagccaggtgaccctgagcagccccttcttccccccctgccccagcaccagcagcttccccagcaccaccgccgcccccctgctgagcctggccagcgccttcagcctggccgtgatgaccgtggcccagagcctgctgagccccagccccggcctgctgagccagagcccccccgccccccccagccccctgcccagcctgcccctgcccccccccgtggcccccggcggccaggagagccccagcccccacaccgccgaggtggagagcgaggccagccccccccccgccagacccctgcccggcgaggccagactggcccccatcagcgaggagggcaagccccagctggtgggcagattccaggtgaccagcagcaaggagcccgccgagcccctgcccctgcagcccaccagccccaccctgagcggcagccccaagcccagcaccccccagctgaccagcgagagcagcgacaccgaggacagcgccggcggcggccccgagaccagagaggccctggccgagagcgacagagccgccgagggcctgggcgccggcgtggaggaggagggcgacgacggcaaggagccccaggtgggcggcagcccccagcccctgagccaccccagccccgtgtggatgaactacagctacagcagcctgtgcctgagcagcgaggagagcgagagcagcggcgaggacgaggagttctgggccgagctgcagagcctgagacagaagcacctgagcgaggtggagaccctgcagaccctgcagaagaaggagatcgaggacctgtacagcagactgggcaagcagcccccccccggcatcgtggcccccgccgccatgctgagcagcagacagagaagactgagcaagggcagcttccccaccagcagaagaaacagcctgcagagaagcgagccccccggccccggcatcatgagaagaaacagcctgagcggcagcagcaccggcagccaggagcagagagccagcaagggcgtgaccttcgccggcgacgtgggcagaatgtag

SEQ ID NO: 105320 - DNA, 1992 bp, Artificial Sequence
  Description of Artificial Sequence: Synthetic coding sequence
atgagaagaagacagcagggcgccgccggcggcaacttccccgtgggcggcagcttccccgaggacgtgagcccccaccaggacagcggctacgcccccagccccagatacctgagaagattcagagagatgaagcccagagtgctgcagagatggagcagacagatcctgagaggcctgcacttcctgcacagcagagtgccccccatcctgcacagagacctgaagtgcgacaacgtgttcatcaccggccccaccggcagcgtgaagatcggcgacctgggcctggccaccctgaagagagccagcttcgccaagagcgtgatcggcacccccgagttcatggcccccgagatgtacgaggagaagtacgacgaggccgtggacgtgtacgccttcggcatgtgcatgctggagatggccaccagcgagtacccctacagcgagtgccagaacgccgcccagatctacagaaaggtgaccagcggcagaaagcccaacagcttccacaaggtgaagatccccgaggtgaaggagatcatcgagggctgcatcagaaccgacaagaacgagagattcaccatccaggacctgctggcccacgccttcttcagagaggagagaggcgtgcacgtggagctggccgaggaggacgacggcgagaagcccggcctgaagctgtggctgagaatggaggacgccagaagaggcggcagacccagagacaaccaggccatcgagttcctgttccagctgggcagagacgccgccgaggaggtggcccaggagatggtggccctgggcctggtgtgcgaggccgactaccagcccgtggccagagccgtgagagagagagtggccgccatccagagaaagagagagaagctgagaaaggccagagagctggaggccctgccccccgagcccggccccccccccgccaccgtgcccatggcccccggcccccccagcgtgttcccccccgagcccgaggagcccgaggccgaccagcaccagcccttcctgttcagacacgccagctacagcagcaccaccagcgactgcgagaccgacggctacctgagcagcagcggcttcctggacgccagcgaccccgccctgcagccccccggcggcgtgcccagcagcctggccgagagccacctgtgcctgcccagcgccttcgccctgagcatccccagaagcggccccggcagcgacttcagccccggcgacagctacgccagcgacgccgccagcggcctgagcgacgtgggcgagggcatgggccagatgagaagaccccccggcagaaacctgagaagaagacccagaagcagactgagagtgaccagcgtgagcgaccagaacgacagagtggtggagtgccagctgcagacccacaacagcaagatggtgaccttcagattcgacctggacggcgacagccccgaggagatcgccgccgccatggtgtacaacgagttcatcctgcccagcgagagagacggcttcctgagaagaatcagagagatcatccagagagtggagaccctgctgaagagagacaccggccccatggaggccgccgaggacaccctgagcccccaggaggagcccgcccccctgcccgccctgcccgtgcccctgcccgaccccagcaacgaggagctgcagagcagcaccagcctggagcacagaagctggaccgccttcagcaccagcagcagcagccccggcacccccctgagccccggcaaccccttcagccccggcacccccatcagccccggccccatcgccctgcagagagagagcagaagcttcagcctgcagagagcccagatccagagaaccgtgctggaggccggccagagacccggcaagctgtggctgagagccaccgtgcagctgagagtgtggggcctggagctgagaagaaaggagatgatgggcagaaaccccaagctgggcgccgcccccaacccctag

SEQ ID NO: 105321 - DNA, 471 bp, Artificial Sequence
  Description of Artificial Sequence: Synthetic coding sequence
atgggccagatgagaagaccccccggcagaaacctgagaagaagacccagaagcagactgagagtgaccagcgtgagcgaccagaacgacagagtggtggagtgccagctgcagacccacaacagcaagatggtgaccttcagattcgacctggacggcgacagccccgaggagatcgccgccgccatggtgtacaacgagttcatcctgcccagcgagagagacggcttcctgagaagaatcagagagatcatccagagagtggagaccctgctgaagagagacaccggccccatggaggccgccgaggacaccctgagcccccaggtgagacccctgggcggccacttccagggcaagtggaccctgtgcagcagagtgtactacagcctgcccagcgccgtgcccctggacctgacccccctgcacctgtgggaccccaagaccgtggccctgttcttcttcttctag

SEQ ID NO: 105322 - DNA, 894 bp, Artificial Sequence
  Description of Artificial Sequence: Synthetic coding sequence
atggccaaggtgagcgagctgtacgacgtgacctgggaggagatgagagacaagatgagaaagtggagagaggagaacagcagaaacagcgagcagatcgtggaggtgggcgaggagctgatcaacgagtacgccagcaagctgggcgacgacatctggatcatctacgagcaggtgatgatcgccgccctggactacggcagagacgacctggccctgttctgcctgcaggagctgagaagacagttccccggcagccacagagtgaagagactgaccggcatgagattcgaggccatggagagatacgacgacgccatccagctgtacgacagaatcctgcaggaggaccccaccaacaccgccgccagaaagagaaagatcgccatcagaaaggcccagggcaagaacgtggaggccatcagagagctgaacgagtacctggagcagttcgtgggcgaccaggaggcctggcacgagctggccgagctgtacatcaacgagcacgactacgccaaggccgccttctgcctggaggagctgatgatgaccaacccccacaaccacctgtactgccagcagtacgccgaggtgaagtacacccagggcggcctggagaacctggagctgagcagaaagtacttcgcccaggccctgaagctgaacaacagaaacatgagagccctgttcggcctgtacatgagcgccagccacatcgccagcaaccccaaggccagcgccaagaccaagaaggacaacatgaagtacgccagctgggccgccagccagatcaacagagcctaccagttcgccggcagaagcaagaaggagaccaagtacagcctgaaggccgtggaggacatgctggagaccctgcagatcacccagagctag

SEQ ID NO: 105323 - DNA, 1104 bp, Artificial Sequence
  Description of Artificial Sequence: Synthetic coding sequence
atgagatggttcctgccctggaccctggccgccgtgaccgccgccgccgccagcaccgtgctggccaccgccctgagccccgcccccaccaccatggacttcacccccgcccccctggaggacaccagcagcagaccccagttctgcaagtggccctgcgagtgcccccccagcccccccagatgccccctgggcgtgagcctgatcaccgacggctgcgagtgctgcaagatgtgcgcccagcagctgggcgacaactgcaccgaggccgccatctgcgacccccacagaggcctgtactgcgactacagcggcgacagacccagatacgccatcggcgtgtgcgcccaggtggtgggcgtgggctgcgtgctggacggcgtgagatacaacaacggccagagcttccagcccaactgcaagtacaactgcacctgcatcgacggcgccgtgggctgcacccccctgtgcctgagagtgagaccccccagactgtggtgcccccaccccagaagagtgagcatccccggccactgctgcgagcagtgggtgtgcgaggacgacgccaagagacccagaaagaccgcccccagagacaccggcgccttcgacgccgtgggcgaggtggaggcctggcacagaaactgcatcgcctacaccagcccctggagcccctgcagcaccagctgcggcctgggcgtgagcaccagaatcagcaacgtgaacgcccagtgctggcccgagcaggagagcagactgtgcaacctgagaccctgcgacgtggacatccacaccctgatcaaggccggcaagaagtgcctggccgtgtaccagcccgaggccagcatgaacttcaccctggccggctgcatcagcaccagaagctaccagcccaagtactgcggcgtgtgcatggacaacagatgctgcatcccctacaagagcaagaccatcgacgtgagcttccagtgccccgacggcctgggcttcagcagacaggtgctgtggatcaacgcctgcttctgcaacctgagctgcagaaaccccaacgacatcttcgccgacctggagagctaccccgacttcagcgagatcgccaactag

SEQ ID NO: 105324 - DNA, 588 bp, Artificial Sequence
  Description of Artificial Sequence: Synthetic coding sequence
atgcccgtgcccctgaccagcagacacgaggtggtgcccgccctggacgccggcagcagcgacagcagcagcagacagcacagacccggccacgacgccgtgggcgaggtggaggcctggcacagaaactgcatcgcctacaccagcccctggagcccctgcagcaccagctgcggcctgggcgtgagcaccagaatcagcaacgtgaacgcccagtgctggcccgagcaggagagcagactgtgcaacctgagaccctgcgacgtggacatccacaccctgatcaaggccggcaagaagtgcctggccgtgtaccagcccgaggccagcatgaacttcaccctggccggctgcatcagcaccagaagctaccagcccaagtactgcggcgtgtgcatggacaacagatgctgcatcccctacaagagcaagaccatcgacgtgagcttccagtgccccgacggcctgggcttcagcagacaggtgctgtggatcaacgcctgcttctgcaacctgagctgcagaaaccccaacgacatcttcgccgacctggagagctaccccgacttcagcgagatcgccaactag

SEQ ID NO: 105325 - DNA, 468 bp, Artificial Sequence
  Description of Artificial Sequence: Synthetic coding sequence
atgagatggttcctgccctggaccctggccgccgtgaccgccgccgccgccagcaccgtgctggccaccgccctgagccccgcccccaccaccatggacttcacccccgcccccctggaggacaccagcagcagaccccagttctgcaagtggccctgcgagtgcccccccagcccccccagatgccccctgggcgtgagcctgatcaccgacggctgcgagtgctgcaagatgtgcgcccagcagctgggcgacaactgcaccgaggccgccatctgcgacccccacagaggcctgtactgcgactacagcggcgacagacccagatacgccatcggcgtgtgcgccagaagagaggaggtgagcggctgcgtgcccgccagaggcatccacgagctgcacacctgcggcctgcaccagcacaccctgctgagcacccaggtgctgtggagcctgcacggccagtag

SEQ ID NO: 105326 - DNA, 369 bp, Artificial Sequence
  Description of Artificial Sequence: Synthetic coding sequence
atgagatggttcctgccctggaccctggccgccgtgaccgccgccgccgccagcaccgtgctggccaccgccggcaagaagtgcctggccgtgtaccagcccgaggccagcatgaacttcaccctggccggctgcatcagcaccagaagctaccagcccaagtactgcggcgtgtgcatggacaacagatgctgcatcccctacaagagcaagaccatcgacgtgagcttccagtgccccgacggcctgggcttcagcagacaggtgctgtggatcaacgcctgcttctgcaacctgagctgcagaaaccccaacgacatcttcgccgacctggagagctaccccgacttcagcgagatcgccaactag

SEQ ID NO: 105327 - DNA, 753 bp, Artificial Sequence
  Description of Artificial Sequence: Synthetic coding sequence
atgagaggcacccccaagacccacctgctggccttcagcctgctgtgcctgctgagcaaggtgagaacccagctgtgccccaccccctgcacctgcccctggcccccccccagatgccccctgggcgtgcccctggtgctggacggctgcggctgctgcagagtgtgcgccagaagactgggcgagccctgcgaccagctgcacgtgtgcgacgccagccagggcctggtgtgccagcccggcgccggccccggcggcagaggcgccctgtgcctgctggccgaggacgacagcagctgcgaggtgaacggcagactgtacagagagggcgagaccttccagccccactgcagcatcagatgcagatgcgaggacggcggcttcacctgcgtgcccctgtgcagcgaggacgtgagactgcccagctgggactgcccccaccccagaagagtggaggtgctgggcaagtgctgccccgagtgggtgtgcggccagggcggcggcctgggcacccagcccctgcccgcccagggcccccagttcagcggcctggtgagcagcctgccccccggcgtgccctgccccgagtggagcaccgcctggggcccctgcagcaccacctgcggcctgggcatggccaccagagtgagcaaccagaacagattctgcagactggagacccagagaagactgtgcctgagcagaccctgcccccccagcagaggcagaagcccccagaacagcgccttctag

SEQ ID NO: 105328 - DNA, 657 bp, Artificial Sequence
  Description of Artificial Sequence: Synthetic coding sequence
atgagaggcacccccaagacccacctgctggccttcagcctgctgtgcctgctgagcaaggtgagaacccagctgtgccccaccccctgcacctgcccctggcccccccccagatgccccctgggcgtgcccctggtgctggacggctgcggctgctgcagagtgtgcgccagaagactgggcgagccctgcgaccagctgcacgtgtgcgacgccagccagggcctggtgtgccagcccggcgccggccccggcggcagaggcgccctgtgcctgtgcaagcaggaccccagcttcctggccctgagcctgccctgccccctggtgagccccgcccagaacggcgccagacccggcgaccccgccagaccccccgtgggctgggcctggccccccggctgccccaccagaaccgccagcgccgactggagacccagcgccgcctgcgcctgccccggccccgcccacccccccggcgtggccgtgcacaagaccgtgcccagcagagccggcctgggcatgggcaccagatgcccccccagccccgccggcggccccgtgcccggcccctgggccgacggcagatggagcgtgcccagacccctggccgccggcaacaccctggcctgggtgcaccacgccgagcaccagtactag

SEQ ID NO: 105329 - DNA, 753 bp, Artificial Sequence; identical to SEQ ID NO: 105327
  Description of Artificial Sequence: Synthetic coding sequence

SEQ ID NO: 105330 - DNA, 2571 bp, Artificial Sequence
  Description of Artificial Sequence: Synthetic coding sequence
atggagagcgaggacctgagcggcagagagctgaccatcgacagcatcatgaacaaggtgagagacatcaagaacaagttcaagaacgaggacctgaccgacgagctgagcctgaacaagatcagcgccgacaccaccgacaacagcggcaccgtgaaccagatcatgatgatggccaacaaccccgaggactggctgagcctgctgctgaagctggagaagaacagcgtgcccctgagcgacgccctgctgaacaagctgatcggcagatacagccaggccatcgaggccctgccccccgacaagtacggccagaacgagagcttcgccagaatccaggtgagattcgccgagctgaaggccatccaggagcccgacgacgccagagactacttccagatggccagagccaactgcaagaagttcgccttcgtgcacatcagcttcgcccagttcgagctgagccagggcaacgtgaagaagagcaagcagctgctgcagaaggccgtggagagaggcgccgtgcccctggagatgctggagatcgccctgagaaacctgaacctgcagaagaagcagctgctgagcgaggaggagaagaagaacctgagcgccagcaccgtgctgaccgcccaggagagcttcagcggcagcctgggccacctgcagaacagaaacaacagctgcgacagcagaggccagaccaccaaggccagattcctgtacggcgagaacatgcccccccaggacgccgagatcggctacagaaacagcctgagacagaccaacaagaccaagcagagctgccccttcggcagagtgcccgtgaacctgctgaacagccccgactgcgacgtgaagaccgacgacagcgtggtgccctgcttcatgaagagacagaccagcagaagcgagtgcagagacctggtggtgcccggcagcaagcccagcggcaacgacagctgcgagctgagaaacctgaagagcgtgcagaacagccacttcaaggagcccctggtgagcgacgagaagagcagcgagctgatcatcaccgacagcatcaccctgaagaacaagaccgagagcagcctgctggccaagctggaggagaccaaggagtaccaggagcccgaggtgcccgagagcaaccagaagcagtggcagagcaagagaaagagcgagtgcatcaaccagaaccccgccgccagcagcaaccactggcagatccccgagctggccagaaaggtgaacaccgagaagcacaccaccttcgagcagcccgtgttcagcgtgagcaagcagagcccccccatcagcaccagcaagtggttcgaccccaagagcatctgcaagacccccagcagcaacaccctggacgactacatgagctgcttcagaacccccgtggtgaagaacgacttcccccccgcctgccagctgagcaccccctacggccagcccgcctgcttccagcagcagcagcaccagatcctggccacccccctgcagaacctgcaggtgctggccagcagcagcgccaacgagtgcatcagcgtgaagggcagaatctacagcatcctgaagcagatcggcagcggcggcagcagcaaggtgttccaggtgctgaacgagaagaagcagatctacgccatcaagtacgtgaacctggaggaggccgacaaccagaccctggacagctacagaaacgagatcgcctacctgaacaagctgcagcagcacagcgacaagatcatcagactgtacgactacgagatcaccgaccagtacatctacatggtgatggagtgcggcaacatcgacctgaacagctggctgaagaagaagaagagcatcgacccctgggagagaaagagctactggaagaacatgctggaggccgtgcacaccatccaccagcacggcatcgtgcacagcgacctgaagcccgccaacttcctgatcgtggacggcatgctgaagctgatcgacttcggcatcgccaaccagatgcagcccgacaccaccagcgtggtgaaggacagccaggtgggcaccgtgaactacatgccccccgaggccatcaaggacatgagcagcagcagagagaacggcaagagcaagagcaagatcagccccaagagcgacgtgtggagcctgggctgcatcctgtactacatgacctacggcaagacccccttccagcagatcatcaaccagatcagcaagctgcacgccatcatcgaccccaaccacgagatcgagttccccgacatccccgagaaggacctgcaggacgtgctgaagtgctgcctgaagagagaccccaagcagagaatcagcatccccgagctgctggcccacccctacgtgcagatccagacccaccccgtgaaccagatggccaagggcaccaccgaggagatgaagtacgtgctgggccagctggtgggcctgaacagccccaacagcatcctgaaggccgccaagaccctgtacgagcactacagcggcggcgagagccacaacagcagcagcagcaagaccttcgagaagaagagaggcaagaagtag

SEQ ID NO: 105331 - DNA, 1119 bp, Artificial Sequence
  Description of Artificial Sequence: Synthetic coding sequence
atgaacaagagaagactgctgtaccccagcggctggctgcacggccccagcgacatgcagggcctgctgttcagcaccctgctgctggccggcctggcccagttctgctgcagagtgcagggcaccggccccctggacaccacccccgagggcagacccggcgaggtgagcgacgccccccagagaaagcagttctgccactggccctgcaagtgcccccagcagaagcccagatgcccccccggcgtgagcctggtgagagacggctgcggctgctgcaagatctgcgccaagcagcccggcgagatctgcaacgaggccgacctgtgcgacccccacaagggcctgtactgcgactacagcgtggacagacccagatacgagaccggcgtgtgcgcctacctggtggccgtgggctgcgagttcaaccaggtgcactaccacaacggccaggtgttccagcccaaccccctgttcagctgcctgtgcgtgagcggcgccatcggctgcacccccctgttcatccccaagctggccggcagccactgcagcggcgccaagggcggcaagaagagcgaccagagcaactgcagcctggagcccctgctgcagcagctgagcaccagctacaagaccatgcccgcctacagaaacctgcccctgatctggaagaagaagtgcctggtgcaggccaccaagtggaccccctgcagcagaacctgcggcatgggcatcagcaacagagtgaccaacgagaacagcaactgcgagatgagaaaggagaagagactgtgctacatccagccctgcgacagcaacatcctgaagaccatcaagatccccaagggcaagacctgccagcccaccttccagctgagcaaggccgagaagttcgtgttcagcggctgcagcagcacccagagctacaagcccaccttctgcggcatctgcctggacaagagatgctgcatccccaacaagagcaagatgatcaccatccagttcgactgccccaacgagggcagcttcaagtggaagatgctgtggatcaccagctgcgtgtgccagagaaactgcagagagcccggcgacatcttcagcgagctgaagatcctgtag

SEQ ID NO: 105332 - DNA, 996 bp, Artificial Sequence
  Description of Artificial Sequence: Synthetic coding sequence
atgaagatcagcagaggcagagtgtgcctggagagcgagaacaaggacgccggcgtggccggcagaaagcagttctgccactggccctgcaagtgcccccagcagaagcccagatgcccccccggcgtgagcctggtgagagacggctgcggctgctgcaagatctgcgccaagcagcccggcgagatctgcaacgaggccgacctgtgcgacccccacaagggcctgtactgcgactacagcgtggacagacccagatacgagaccggcgtgtgcgcctgcaagagcgtgggctgcgagttcaaccaggtgcactaccacaacggccaggtgttccagcccaaccccctgttcagctgcctgtgcgtgagcggcgccatcggctgcacccccctgttcatccccaagctggccggcagccactgcagcggcgccaagggcggcaagaagagcgaccagagcaactgcagcctggagcccctgctgcagcagctgagcaccagctacaagaccatgcccgcctacagaaacctgcccctgatctggaagaagaagtgcctggtgcaggccaccaagtggaccccctgcagcagaacctgcggcatgggcatcagcaacagagtgaccaacgagaacagcaactgcgagatgagaaaggagaagagactgtgctacatccagccctgcgacagcaacatcctgaagaccatcaagatccccaagggcaagacctgccagcccaccttccagctgagcaaggccgagaagttcgtgttcagcggctgcagcagcacccagagctacaagcccaccttctgcggcatctgcctggacaagagatgctgcatccccaacaagagcaagatgatcaccatccagttcgactgccccaacgagggcagcttcaagtggaagatgctgtggatcaccagctgcgtgtgccagagaaactgcagagagcccggcgacatcttcagcgagctgaagatcctgtag

SEQ ID NO: 105333 - DNA, 1065 bp, Artificial Sequence; identical to SEQ ID NO: 86490
  Description of Artificial Sequence: Synthetic coding sequence

SEQ ID NO: 105334 - DNA, 693 bp, Artificial Sequence
  Description of Artificial Sequence: Synthetic coding sequence
atgcagggcctgctgttcagcaccctgctgctggccggcctggcccagttctgctgcagagtgcagggcaccggccccctggacaccacccccgagggcagacccggcgaggtgagcgacgccccccagagaaagcagttctgccactggccctgcaagtgcccccagcagaagcccagatgcccccccggcgtgagcctggtgagagacggctgcggctgctgcaagatctgcgccaagcagcccggcgagatctgcaacgaggccgacctgtgcgacccccacaagggcctgtactgcgactacagcgtggacagacccagatacgagaccggcgtgtgcgcctacctggtggccgtgggctgcgagttcaaccaggtgcactaccacaacggccaggtgttccagcccaaccccctgttcagctgcctgtgcgtgagcggcgccatcggctgcacccccctgttcatccccaagctggccggcagccactgcagcggcgccaagggcggcaagaagagcgaccagagcaactgcagcctggagcccctgctgcagcagctgagcaccagctacaagaccatgcccgcctacagaaacctgcccctgatctggaagaagaacgtgctgtgcaagcagcagaacggcctgcccgcccccgagcacgtgggctgggagtacctgaccggctag

SEQ ID NO: 105335 - DNA, 393 bp, Artificial Sequence
  Description of Artificial Sequence: Synthetic coding sequence
atgggcatcagcaacagagtgaccaacgagaacagcaactgcgagatgagaaaggagaagagactgtgctacatccagccctgcgacagcaacatcctgaagaccatcaagatccccaagggcaagacctgccagcccaccttccagctgagcaaggccgagaagttcgtgttcagcggctgcagcagcacccagagctacaagcccaccttctgcggcatctgcctggacaagagatgctgcatccccaacaagagcaagatgatcaccatccagttcgactgccccaacgagggcagcttcaagtggaagatgctgtggatcaccagctgcgtgtgccagagaaactgcagagagcccggcgacatcttcagcgagctgaagatcctgtag

SEQ ID NO: 105336 - DNA, 1626 bp, Artificial Sequence
  Description of Artificial Sequence: Synthetic coding sequence
atggccggcgccatcatcgagaacatgagcaccaagaagctgtgcatcgtgggcggcatcctgctggtgttccagatcatcgccttcctggtgggcggcctgatcgcccccggccccaccaccgccgtgagctacatgagcgtgaagtgcgtggacgccagaaagaaccaccacaagaccaagtggttcgtgccctggggccccaaccactgcgacaagatcagagacatcgaggaggccatccccagagagatcgaggccaacgacatcgtgttcagcgtgcacatccccctgccccacatggagatgagcccctggttccagttcatgctgttcatcctgcagctggacatcgccttcaagctgaacaaccagatcagagagaacgccgaggtgagcatggacgtgagcctggcctacagagacgacgccttcgccgagtggaccgagatggcccacgagagagtgcccagaaagctgaagtgcaccttcaccagccccaagacccccgagcacgagggcagatactacgagtgcgacgtgctgcccttcatggagatcggcagcgtggcccacaagttctacctgctgaacatcagactgcccgtgaacgagaagaagaagatcaacgtgggcatcggcgagatcaaggacatcagactggtgggcatccaccagaacggcggcttcaccaaggtgtggttcgccatgaagaccttcctgacccccagcatcttcatcatcatggtgtggtactggagaagaatcaccatgatgagcagaccccccgtgctgctggagaaggtgatcttcgccctgggcatcagcatgaccttcatcaacatccccgtggagtggttcagcatcggcttcgactggacctggatgctgctgttcggcgacatcagacagggcatcttctacgccatgctgctgagcttctggatcatcttctgcggcgagcacatgatggaccagcacgagagaaaccacatcgccggctactggaagcaggtgggccccatcgccgtgggcagcttctgcctgttcatcttcgacatgtgcgagagaggcgtgcagctgaccaaccccttctacagcatctggaccaccgacatcggcaccgagctggccatggccttcatcatcgtggccggcatctgcctgtgcctgtacttcctgttcctgtgcttcatggtgttccaggtgttcagaaacatcagcggcaagcagagcagcctgcccgccatgagcaaggtgagaagactgcactacgagggcctgatcttcagattcaagttcctgatgctgatcaccctggcctgcgccgccatgaccgtgatcttcttcatcgtgagccaggtgaccgagggccactggaagtggggcggcgtgaccgtgcaggtgaacagcgccttcttcaccggcatctacggcatgtggaacctgtacgtgttcgccctgatgttcctgtacgcccccagccacaagaactacggcgaggaccagagcaacggcgacctgggcgtgcacagcggcgaggagctgcagctgaccaccaccatcacccacgtggacggccccaccgagatctacaagctgaccagaaaggaggcccaggagtag

SEQ ID NO: 105337 - DNA, 1632 bp, Artificial Sequence
  Description of Artificial Sequence: Synthetic coding sequence
atggccggcgccatcatcgagaacatgagcaccaagaagctgtgcatcgtgggcggcatcctgctggtgttccagatcatcgccttcctggtgggcggcctgatcggccccaccaccgccgtgagctacatgagcgtgaagtgcgtggacgccagaaagaaccaccacaagaccaagtggttcgtgccctggggccccaaccactgcgacaagatcagagacatcgaggaggccatccccagagagatcgaggccaacgacatcgtgttcagcgtgcacatccccctgccccacatggagatgagcccctggttccagttcatgctgttcatcctgcagctggacatcgccttcaagctgaacaaccagatcagagagaacgccgaggtgagcatggacgtgagcctggcctacagagacgacgccttcgccgagtggaccgagatggcccacgagagagtgcccagaaagctgaagtgcaccttcaccagccccaagacccccgagcacgagggcagatactacgagtgcgacgtgctgcccttcatggagatcggcagcgtggcccacaagttctacctgctgaacatcagactgcccgtgaacgagaagaagaagatcaacgtgggcatcggcgagatcaaggacatcagactggtgggcatccaccagaacggcggcttcaccaaggtgtggttcgccatgaagaccttcctgacccccagcatcttcatcatcatggtgtggtactggagaagaatcaccatgatgagcagaccccccgtgctgctggagaaggtgatcttcgccctgggcatcagcatgaccttcatcaacatccccgtggagtggttcagcatcggcttcgactggacctggatgctgctgttcggcgacatcagacagggcatcttctacgccatgctgctgagcttctggatcatcttctgcggcgagcacatgatggaccagcacgagagaaaccacatcgccggctactggaagcaggtgggccccatcgccgtgggcagcttctgcctgttcatcttcgacatgtgcgagagaggcgtgcagctgaccaaccccttctacagcatctggaccaccgacatcggcaccgagctggccatggccttcatcatcgtggccggcatctgcctgtgcctgtacttcctgttcctgtgcttcatggtgttccaggtgttcagaaacatcagcggcaagcagagcagcctgcccgccatgagcaaggtgagaagactgcactacgagggcctgatcttcagattcaagttcctgatgctgatcaccctggcctgcgccgccatgaccgtgatcttcttcatcgtgagccaggtgaccgagggccactggaagtggggcggcgtgaccgtgcaggtgaacagcgccttcttcaccggcatctacggcatgtggaacctgtacgtgttcgccctgatgttcctgtacgcccccagccacaagaactacggcgaggaccagagcaacggcatgcagctgccctgcaagagcagagaggactgcgccctgttcgtgagcgagctgtaccaggagctgttcagcgccagcaagtacagcttcatcaacgacaacgccgccagcggcatctag

SEQ ID NO: 105338 - DNA, 1353 bp, Artificial Sequence
  Description of Artificial Sequence: Synthetic coding sequence
atggccggcgccatcatcgagaacatgagcaccaagaagctgtgcatcgtgggcggcatcctgctggtgttccagatcatcgccttcctggtgggcggcctgatcggcgagaacgccgaggtgagcatggacgtgagcctggcctacagagacgacgccttcgccgagtggaccgagatggcccacgagagagtgcccagaaagctgaagtgcaccttcaccagccccaagacccccgagcacgagggcagatactacgagtgcgacgtgctgcccttcatggagatcggcagcgtggcccacaagttctacctgctgaacatcagactgcccgtgaacgagaagaagaagatcaacgtgggcatcggcgagatcaaggacatcagactggtgggcatccaccagaacggcggcttcaccaaggtgtggttcgccatgaagaccttcctgacccccagcatcttcatcatcatggtgtggtactggagaagaatcaccatgatgagcagaccccccgtgctgctggagaaggtgatcttcgccctgggcatcagcatgaccttcatcaacatccccgtggagtggttcagcatcggcttcgactggacctggatgctgctgttcggcgacatcagacagggcatcttctacgccatgctgctgagcttctggatcatcttctgcggcgagcacatgatggaccagcacgagagaaaccacatcgccggctactggaagcaggtgggccccatcgccgtgggcagcttctgcctgttcatcttcgacatgtgcgagagaggcgtgcagctgaccaaccccttctacagcatctggaccaccgacatcggcaccgagctggccatggccttcatcatcgtggccggcatctgcctgtgcctgtacttcctgttcctgtgcttcatggtgttccaggtgttcagaaacatcagcggcaagcagagcagcctgcccgccatgagcaaggtgagaagactgcactacgagggcctgatcttcagattcaagttcctgatgctgatcaccctggcctgcgccgccatgaccgtgatcttcttcatcgtgagccaggtgaccgagggccactggaagtggggcggcgtgaccgtgcaggtgaacagcgccttcttcaccggcatctacggcatgtggaacctgtacgtgttcgccctgatgttcctgtacgcccccagccacaagaactacggcgaggaccagagcaacggcgacctgggcgtgcacagcggcgaggagctgcagctgaccaccaccatcacccacgtggacggccccaccgagatctacaagctgaccagaaaggaggcccaggagtag

SEQ ID NO: 105339 - DNA, 1638 bp, Artificial Sequence
  Description of Artificial Sequence: Synthetic coding sequence
atggccggcgccatcatcgagaacatgagcaccaagaagctgtgcatcgtgggcggcatcctgctggtgttccagatcatcgccttcctggtgggcggcctgatcgcccccggccccaccaccgccgtgagctacatgagcgtgaagtgcgtggacgccagaaagaaccaccacaagaccaagtggttcgtgccctggggccccaaccactgcgacaagatcagagacatcgaggaggccatccccagagagatcgaggccaacgacatcgtgttcagcgtgcacatccccctgccccacatggagatgagcccctggttccagttcatgctgttcatcctgcagctggacatcgccttcaagctgaacaaccagatcagagagaacgccgaggtgagcatggacgtgagcctggcctacagagacgacgccttcgccgagtggaccgagatggcccacgagagagtgcccagaaagctgaagtgcaccttcaccagccccaagacccccgagcacgagggcagatactacgagtgcgacgtgctgcccttcatggagatcggcagcgtggcccacaagttctacctgctgaacatcagactgcccgtgaacgagaagaagaagatcaacgtgggcatcggcgagatcaaggacatcagactggtgggcatccaccagaacggcggcttcaccaaggtgtggttcgccatgaagaccttcctgacccccagcatcttcatcatcatggtgtggtactggagaagaatcaccatgatgagcagaccccccgtgctgctggagaaggtgatcttcgccctgggcatcagcatgaccttcatcaacatccccgtggagtggttcagcatcggcttcgactggacctggatgctgctgttcggcgacatcagacagggcatcttctacgccatgctgctgagcttctggatcatcttctgcggcgagcacatgatggaccagcacgagagaaaccacatcgccggctactggaagcaggtgggccccatcgccgtgggcagcttctgcctgttcatcttcgacatgtgcgagagaggcgtgcagctgaccaaccccttctacagcatctggaccaccgacatcggcaccgagctggccatggccttcatcatcgtggccggcatctgcctgtgcctgtacttcctgttcctgtgcttcatggtgttccaggtgttcagaaacatcagcggcaagcagagcagcctgcccgccatgagcaaggtgagaagactgcactacgagggcctgatcttcagattcaagttcctgatgctgatcaccctggcctgcgccgccatgaccgtgatcttcttcatcgtgagccaggtgaccgagggccactggaagtggggcggcgtgaccgtgcaggtgaacagcgccttcttcaccggcatctacggcatgtggaacctgtacgtgttcgccctgatgttcctgtacgcccccagccacaagaactacggcgaggaccagagcaacggcatgcagctgccctgcaagagcagagaggactgcgccctgttcgtgagcgagctgtaccaggagctgttcagcgccagcaagtacagcttcatcaacgacaacgccgccagcggcatctag

SEQ ID NO: 105340 - DNA, 2142 bp, Artificial Sequence
  Description of Artificial Sequence: Synthetic coding sequence
atggccggcagcttctgctggagaatgctgggcctggtgagcaaggtgggcaacagagccagatgcttcagcagcatggccgccagcgaggaggagctgctggacttcagcggcagcgagctgcagttcaacagctgcagcctgcacctgagcctgcaccccttcttcaacttcctgctgggcatccacagctgcttcgtgtgcaaggagagcaagaccgacgtgaagagatgcgtggtgacccagtgcggcaagttctaccacgaggcctgcgtgaagaagtaccccctgaccgtgttcgagagcagaggcttcagatgccccctgcacagctgcgtgagctgccacgccagcaaccccagcaaccccagacccagcaagggcaagatgatgagatgcgtgagatgccccgtggcctaccacagcggcgacgcctgcctggccgccggctgcagcgtgatcgccagcaacagcatcatctgcaccgcccacttcaccgccagaaagggcaagagacaccacgcccacgtgaacgtgagctggtgcttcgtgtgcagcaagggcggcagcctgctgtgctgcgagagctgccccgccgccttccaccccgactgcctgaacatcgagatgcccgacggcagctggttctgcaacgactgcagagccggcaagaagctgcacttccaggacatcatctgggtgaagctgggcaactacagatggtggcccgccgaggtgtgccaccccaagaacgtgccccccaacatccagaagatgaagcacgagatcggcgagttccccgtgttcttcttcggcagcaaggactactactggacccaccaggccagagtgttcccctacatggagggcgacagaggcagcagataccagggcgtgagaggcatcggcagagtgttcaagaacgccctgcaggaggccgaggccagattcagagagatcaagctgcagagagaggccagagagacccaggagagcgagagaaagccccccccctacaagcacatcaaggtgaacaagccctacggcaaggtgcagatctacaccgccgacatcagcgagatccccaagtgcaactgcaagcccaccgacgagaacccctgcggcttcgacagcgagtgcctgaacagaatgctgatgttcgagtgccacccccaggtgtgccccgccggcgagttctgccagaaccagtgcttcaccaagagacagtaccccgagaccaagatcatcaagaccgacggcaagggctggggcctggtggccaagagagacatcagaaagggcgagttcgtgaacgagtacgtgggcgagctgatcgacgaggaggagtgcatggccagaatcaagcacgcccacgagaacgacatcacccacttctacatgctgaccatcgacaaggacagaatcatcgacgccggccccaagggcaactacagcagattcatgaaccacagctgccagcccaactgcgagaccctgaagtggaccgtgaacggcgacaccagagtgggcctgttcgccgtgtgcgacatccccgccggcaccgagctgaccttcaactacaacctggactgcctgggcaacgagaagaccgtgtgcagatgcggcgccagcaactgcagcggcttcctgggcgacagacccaagaccagcaccaccctgagcagcgaggagaagggcaagaagaccaagaagaagaccagaagaagaagagccaagggcgagggcaagagacagagcgaggacgagtgcttcagatgcggcgacggcggccagctggtgctgtgcgacagaaagttctgcaccaaggcctaccacctgagctgcctgggcctgggcaagagacccttcggcaagtgggagtgcccctggcaccactgcgacgtgtgcggcaagcccagcaccagcttctgccacctgtgccccaacagcttctgcaaggagcaccaggacggcaccgccttcagctgcacccccgacggcagaagctactgctgcgagcacgacctgggcgccgccagcgtgagaagcaccaagaccgagaagcccccccccgagcccggcaagcccaagggcaagagaagaagaagaagaggctggagaagagtgaccgagggcaagtag

SEQ ID NO: 105341 - DNA, 4098 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagatccccgccaagaaggagagctgccccaacaccggcagagacaaggaccacctgctgaagtacaacgtgggcgacctggtgtggagcaaggtgagcggctacccctggtggccctgcatggtgagcgccgaccccctgctgcacagctacaccaagctgaagggccagaagaagagcgccagacagtaccacgtgcagttcttcggcgacgcccccgagagagcctggatcttcgagaagagcctggtggccttcgagggcgagggccagttcgagaagctgtgccaggagagcgccaagcaggcccccaccaaggccgagaagatcaagctgctgaagcccatcagcggcaagctgagagcccagtgggagatgggcatcgtgcaggccgaggaggccgccagcatgagcgtggaggagagaaaggccaagttcaccttcctgtacgtgggcgaccagctgcacctgaacccccaggtggccaaggaggccggcatcgccgccgagagcctgggcgagatggccgagagcagcggcgtgagcgaggaggccgccgagaaccccaagagcgtgagagaggagtgcatccccatgaagagaagaagaagagccaagctgtgcagcagcgccgagaccctggagagccaccccgacatcggcaagagcaccccccagaagaccgccgaggccgaccccagaagaggcgtgggcagcccccccggcagaaagaagaccaccgtgagcatgcccagaagcagaaagggcgacgccgccagccagttcctggtgttctgccagaagcacagagacgaggtggtggccgagcaccccgacgccagcggcgaggagatcgaggagctgctgagaagccagtggagcctgctgagcgagaagcagagagccagatacaacaccaagttcgccctggtggcccccgtgcaggccgaggaggacagcggcaacgtgaacggcaagaagagaaaccacaccaagagaatccaggaccccaccgaggacgccgaggccgaggacacccccagaaagagactgagaaccgacaagcacagcctgagaaagagagacaccatcaccgacaagaccgccagaaccagcagctacaaggccatggaggccgccagcagcctgaagagccaggccgccaccaagaacctgagcgacgcctgcaagcccctgaagaagagaaacagagccagcaccgccgccagcagcgccctgggcttcagcaagagcagcagccccagcgccagcctgaccgagaacgaggtgagcgacagccccggcgacgagcccagcgagagcccctacgagagcgccgacgagacccagaccgaggtgagcgtgagcagcaagaagagcgagagaggcgtgaccgccaagaaggagtacgtgtgccagctgtgcgagaagcccggcagcctgctgctgtgcgagggcccctgctgcggcgccttccacctggcctgcctgggcctgagcagaagacccgagggcagattcacctgcagcgagtgcgccagcggcatccacagctgcttcgtgtgcaaggagagcaagaccgacgtgaagagatgcgtggtgacccagtgcggcaagttctaccacgaggcctgcgtgaagaagtaccccctgaccgtgttcgagagcagaggcttcagatgccccctgcacagctgcgtgagctgccacgccagcaaccccagcaaccccagacccagcaagggcaagatgatgagatgcgtgagatgccccgtggcctaccacagcggcgacgcctgcctggccgccggctgcagcgtgatcgccagcaacagcatcatctgcaccgcccacttcaccgccagaaagggcaagagacaccacgcccacgtgaacgtgagctggtgcttcgtgtgcagcaagggcggcagcctgctgtgctgcgagagctgccccgccgccttccaccccgactgcctgaacatcgagatgcccgacggcagctggttctgcaacgactgcagagccggcaagaagctgcacttccaggacatcatctgggtgaagctgggcaactacagatggtggcccgccgaggtgtgccaccccaagaacgtgccccccaacatccagaagatgaagcacgagatcggcgagttccccgtgttcttcttcggcagcaaggactactactggacccaccaggccagagtgttcccctacatggagggcgacagaggcagcagataccagggcgtgagaggcatcggcagagtgttcaagaacgccctgcaggaggccgaggccagattcagagagatcaagctgcagagagaggccagagagacccaggagagcgagagaaagccccccccctacaagcacatcaaggtgaacaagccctacggcaaggtgcagatctacaccgccgacatcagcgagatccccaagtgcaactgcaagcccaccgacgagaacccctgcggcttcgacagcgagtgcctgaacagaatgctgatgttcgagtgccacccccaggtgtgccccgccggcgagttctgccagaaccagtgcttcaccaagagacagtaccccgagaccaagatcatcaagaccgacggcaagggctggggcctggtggccaagagagacatcagaaagggcgagttcgtgaacgagtacgtgggcgagctgatcgacgaggaggagtgcatggccagaatcaagcacgcccacgagaacgacatcacccacttctacatgctgaccatcgacaaggacagaatcatcgacgccggccccaagggcaactacagcagattcatgaaccacagctgccagcccaactgcgagaccctgaagtggaccgtgaacggcgacaccagagtgggcctgttcgccgtgtgcgacatccccgccggcaccgagctgaccttcaactacaacctggactgcctgggcaacgagaagaccgtgtgcagatgcggcgccagcaactgcagcggcttcctgggcgacagacccaagaccagcaccaccctgagcagcgaggagaagggcaagaagaccaagaagaagaccagaagaagaagagccaagggcgagggcaagagacagagcgaggacgagtgcttcagatgcggcgacggcggccagctggtgctgtgcgacagaaagttctgcaccaaggcctaccacctgagctgcctgggcctgggcaagagacccttcggcaagtgggagtgcccctggcaccactgcgacgtgtgcggcaagcccagcaccagcttctgccacctgtgccccaacagcttctgcaaggagcaccaggacggcaccgccttcagctgcacccccgacggcagaagctactgctgcgagcacgacctgggcgccgccagcgtgagaagcaccaagaccgagaagcccccccccgagcccggcaagcccaagggcaagagaagaagaagaagaggctggagaagagtgaccgagggcaagtag

SEQ ID NO: 105342 - DNA, 4098 bp, Artificial Sequence; identical to SEQ ID NO: 105341
  Description of Artificial Sequence: Synthetic coding sequence

SEQ ID NO: 105343 - DNA, 4098 bp, Artificial Sequence; identical to SEQ ID NO: 105341
  Description of Artificial Sequence: Synthetic coding sequence

SEQ ID NO: 105344 - DNA, 1944 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagatccccgccaagaaggagagctgccccaacaccggcagagacaaggaccacctgctgaagtacaacgtgggcgacctggtgtggagcaaggtgagcggctacccctggtggccctgcatggtgagcgccgaccccctgctgcacagctacaccaagctgaagggccagaagaagagcgccagacagtaccacgtgcagttcttcggcgacgcccccgagagagcctggatcttcgagaagagcctggtggccttcgagggcgagggccagttcgagaagctgtgccaggagagcgccaagcaggcccccaccaaggccgagaagatcaagctgctgaagcccatcagcggcaagctgagagcccagtgggagatgggcatcgtgcaggccgaggaggccgccagcatgagcgtggaggagagaaaggccaagttcaccttcctgtacgtgggcgaccagctgcacctgaacccccaggtggccaaggaggccggcatcgccgccgagagcctgggcgagatggccgagagcagcggcgtgagcgaggaggccgccgagaaccccaagagcgtgagagaggagtgcatccccatgaagagaagaagaagagccaagctgtgcagcagcgccgagaccctggagagccaccccgacatcggcaagagcaccccccagaagaccgccgaggccgaccccagaagaggcgtgggcagcccccccggcagaaagaagaccaccgtgagcatgcccagaagcagaaagggcgacgccgccagccagttcctggtgttctgccagaagcacagagacgaggtggtggccgagcaccccgacgccagcggcgaggagatcgaggagctgctgagaagccagtggagcctgctgagcgagaagcagagagccagatacaacaccaagttcgccctggtggcccccgtgcaggccgaggaggacagcggcaacgtgaacggcaagaagagaaaccacaccaagagaatccaggaccccaccgaggacgccgaggccgaggacacccccagaaagagactgagaaccgacaagcacagcctgagaaagagagacaccatcaccgacaagaccgccagaaccagcagctacaaggccatggaggccgccagcagcctgaagagccaggccgccaccaagaacctgagcgacgcctgcaagcccctgaagaagagaaacagagccagcaccgccgccagcagcgccctgggcttcagcaagagcagcagccccagcgccagcctgaccgagaacgagctgctgtgggagcccacccccgtgaagctggacctgaaccccgccgccctgtactgcacctag

SEQ ID NO: 105345 - DNA, 1890 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagatccccgccaagaaggagagctgccccaacaccggcagagacaaggaccacctgctgaagtacaacgtgggcgacctggtgtggagcaaggtgagcggctacccctggtggccctgcatggtgagcgccgaccccctgctgcacagctacaccaagctgaagggccagaagaagagcgccagacagtaccacgtgcagttcttcggcgacgcccccgagagagcctggatcttcgagaagagcctggtggccttcgagggcgagggccagttcgagaagctgtgccaggagagcgccaagcaggcccccaccaaggccgagaagatcaagctgctgaagcccatcagcggcaagctgagagcccagtgggagatgggcatcgtgcaggccgaggaggccgccagcatgagcgtggaggagagaaaggccaagttcaccttcctgtacgtgggcgaccagctgcacctgaacccccaggtggccaaggaggccggcatcgccgccgagagcctgggcgagatggccgagagcagcggcgtgagcgaggaggccgccgagaaccccaagagcgtgagagaggagtgcatccccatgaagagaagaagaagagccaagctgtgcagcagcgccgagaccctggagagccaccccgacatcggcaagagcaccccccagaagaccgccgaggccgaccccagaagaggcgtgggcagcccccccggcagaaagaagaccaccgtgagcatgcccagaagcagaaagggcgacgccgccagccagttcctggtgttctgccagaagcacagagacgaggtggtggccgagcaccccgacgccagcggcgaggagatcgaggagctgctgagaagccagtggagcctgctgagcgagaagcagagagccagatacaacaccaagttcgccctggtggcccccgtgcaggccgaggaggacagcggcaacgtgaacggcaagaagagaaaccacaccaagagaatccaggaccccaccgaggacgccgaggccgaggacacccccagaaagagactgagaaccgacaagcacagcctgagaaagagagacaccatcaccgacaagaccgccagaaccagcagctacaaggccatggaggccgccagcagcctgaagagccaggccgccaccaagaacctgagcgacgcctgcaagcccctgaagaagagaaacagagccagcaccgccgccagcagcgccctgggcttcagcaagagcagcagccccagcgccagcctgaccgagaacgaggtgaagtag

SEQ ID NO: 105346 - DNA, 822 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagatccccgccaagaaggagagctgccccaacaccggcagagacaaggaccacctgctgaagtacaacgtgggcgacctggtgtggagcaaggtgagcggctacccctggtggccctgcatggtgagcgccgaccccctgctgcacagctacaccaagctgaagggcatcttcaagagcaagaagttcgagcacctgaagaccagccagatcgtgctgaaggactag

SEQ ID NO: 105347 - DNA, 1944 bp, Artificial Sequence; identical to SEQ ID NO: 105344
  Description of Artificial Sequence: Synthetic coding sequence

SEQ ID NO: 105348 - DNA, 114 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctag

SEQ ID NO: 105349 - DNA, 4098 bp, Artificial Sequence; identical to SEQ ID NO: 105341
  Description of Artificial Sequence: Synthetic coding sequence

SEQ ID NO: 105350 - DNA, 1179 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagatccccgccaagaaggagagctgccccaacaccggcagagacaaggaccacctgctgaagtacaacgtgggcgacctggtgtggagcaaggtgagcggctacccctggtggccctgcatggtgagcgccgaccccctgctgcacagctacaccaagctgaagggccagaagaagagcgccagacagtaccacgtgcagttcttcggcgacgcccccgagagagcctggatcttcgagaagagcctggtggccttcgagggcgagggccagttcgagaagctgtgccaggagagcgccaagcaggcccccaccaaggccgagaagatcaagctgctgaagcccatcagcggcaagctgagagcccagtgggagatgggcatcgtgcaggccgaggaggccgccagcatgagcgtggaggagagaaaggccaagttcaccttcctgtacgtgggcgaccagctgcacctgaacccccaggtggccaaggaggccggcatcgccgccgagagcctgggcgagatggccgagagcagcggcgtgagcgaggaggccgccgagaaccccaagagcgtgagagagtag

SEQ ID NO: 105351 - DNA, 1890 bp, Artificial Sequence; identical to SEQ ID NO: 105345
  Description of Artificial Sequence: Synthetic coding sequence

SEQ ID NO: 105352 - DNA, 600 bp, Artificial Sequence
  Description of Artificial Sequence: Synthetic coding sequence
atggagttcagcatcaagcagagccccctgagcgtgcagagcgtggtgaagtgcatcaagatgaagcaggcccccgagatcctgggcagcgccaacggcaagacccccagctgcgaggtgaacagagagtgcagcgtgttcctgagcaaggcccagctgagcagcagcctgcaggagggcgtgatgcagaagttcaacggccacgacgccctgcccttcatccccgccgacaagctgaaggacctgaccagcagagtgttcaacggcgagcccggcgcccacgacgccaagctgagattcgagagccaggagatgaagggcatcggcaccccccccaacaccacccccatcaagaacggcagccccgagatcaagctgaagatcaccaagacctacatgaacggcaagcccctgttcgagagcagcatctgcggcgacagcgccgccgacgtgagccagagcgaggagaacggccagaagcccgagaacaaggccagaagaaacagaaagagaagcatcaagtacgacagcctgctggagcagggcctggtggaggccgccctggtgagcaagatcagcagccccagcgacaagaagtag

SEQ ID NO: 105353 - DNA, 1938 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgaccaacggctaccccagcagcatcagcgtgtacgagacccagaccaagtaccagagctacaaccagtaccccaacggcagcgccaacggcttcggcgccgtgagaaacttcagccccaccgactactaccacagcgagatccccaacaccagaccccacgagatcctggagaagcccagccccccccagcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctggtggccctgcatggtgagcagcgacccccagctggaggtgcacaccaagatcaacaccagaggcgccagagagtaccacgtgcagttcttcagcaaccagcccgagagagcctgggtgcacgagaagagagtgagagagtacaagggccacaagcagtacgaggagctgctggccgaggccaccaagcaggccagcaaccacagcgagaagcagaagatcagaaagcccagaccccagagagagagagcccagtgggacatcggcatcgcccacgccgagaaggccctgaagatgaccagagaggagagaatcgagcagtacaccttcatctacatcgacaagcagcccgaggaggccctgagccaggccaagaagagcgtggccagcaagaccgaggtgaagaagaccagaagacccagaagcgtgctgaacacccagcccgagcagaccaacgccggcgaggtggccagcagcctgagcagcaccgagatcagaagacacagccagagaagacacaccagcgccgaggaggaggagcccccccccgtgaagatcgcctggaagaccgccgccgccagaaagagcctgcccgccagcatcaccatgcacaagggcagcctggacctgcagaagtgcaacatgagccccgtggtgaagatcgagcaggtgttcgccctgcagaacgccaccggcgacggcaagttcatcgaccagttcgtgtacagcaccaagggcatcggcaacaagaccgagatcagcgtgagaggccaggacagactgatcatcagcacccccaaccagagaaacgagaagcccacccagagcgtgagcagccccgaggccaccagcggcagcaccggcagcgtggagaagaagcagcagagaagaagcatcagaaccagaagcgagagcgagaagagcaccgaggtggtgcccaagaagaagatcaagaaggagcaggtggagaccgtgccccaggccaccgtgaagaccggcctgcagaagggcagcgccgacagaggcgtgcagggcagcgtgagattcagcgacagcagcgtgagcgccgccatcgaggagaccgtggactag

SEQ ID NO: 105354 - DNA, 4314 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgaccaacggctaccccagcagcatcagcgtgtacgagacccagaccaagtaccagagctacaaccagtaccccaacggcagcgccaacggcttcggcgccgtgagaaacttcagccccaccgactactaccacagcgagatccccaacaccagaccccacgagatcctggagaagcccagccccccccagcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctggtggccctgcatggtgagcagcgacccccagctggaggtgcacaccaagatcaacaccagaggcgccagagagtaccacgtgcagttcttcagcaaccagcccgagagagcctgggtgcacgagaagagagtgagagagtacaagggccacaagcagtacgaggagctgctggccgaggccaccaagcaggccagcaaccacagcgagaagcagaagatcagaaagcccagaccccagagagagagagcccagtgggacatcggcatcgcccacgccgagaaggccctgaagatgaccagagaggagagaatcgagcagtacaccttcatctacatcgacaagcagcccgaggaggccctgagccaggccaagaagagcgtggccagcaagaccgaggtgaagaagaccagaagacccagaagcgtgctgaacacccagcccgagcagaccaacgccggcgaggtggccagcagcctgagcagcaccgagatcagaagacacagccagagaagacacaccagcgccgaggaggaggagcccccccccgtgaagatcgcctggaagaccgccgccgccagaaagagcctgcccgccagcatcaccatgcacaagggcagcctggacctgcagaagtgcaacatgagccccgtggtgaagatcgagcaggtgttcgccctgcagaacgccaccggcgacggcaagttcatcgaccagttcgtgtacagcaccaagggcatcggcaacaagaccgagatcagcgtgagaggccaggacagactgatcatcagcacccccaaccagagaaacgagaagcccacccagagcgtgagcagccccgaggccaccagcggcagcaccggcagcgtggagaagaagcagcagagaagaagcatcagaaccagaagcgagagcgagaagagcaccgaggtggtgcccaagaagaagatcaagaaggagcaggtggagaccgtgccccaggccaccgtgaagaccggcctgcagaagggcgccagcgagatcagcgacagctgcaagcccctgaagaagagaagcagagccagcaccgacgtggagatgaccagcagcgcctacagagacaccagcgacagcgacagcagaggcctgagcgacctgcaggtgggcttcggcaagcaggtggacagccccagcgccaccgccgacgccgacgtgagcgacgtgcagagcatggacagcagcctgagcagaagaggcaccggcatgagcaagaaggacaccgtgtgccagatctgcgagagcagcggcgacagcctgatcccctgcgagggcgagtgctgcaagcacttccacctggagtgcctgggcctggccagcctgcccgacagcaagttcatctgcatggagtgcaagaccggccagcacccctgcttcagctgcaaggtgagcggcaaggacgtgaagagatgcagcgtgggcgcctgcggcaagttctaccacgaggcctgcgtgagaaagttccccaccgccatcttcgagagcaagggcttcagatgcccccagcactgctgcagcgcctgcagcatggagaaggacatccacaaggccagcaagggcagaatgatgagatgcctgagatgccccgtggcctaccacagcggcgacgcctgcatcgccgccggcagcatgctggtgagcagctacatcctgatctgcagcaaccacagcaagagaagcagcaacagcagcgccgtgaacgtgggcttctgcttcgtgtgcgccagaggcctgatcgtgcaggaccacagcgaccccatgttcagcagctacgcctacaagagccactacctgctgaacgagagcaacagagccgagctgatgaagctgcccatgatccccagcagcagcgccagcaagaagaagtgcgagaagggcggcagactgctgtgctgcgagagctgccccgccagcttccaccccgagtgcctgagcatcgagatgcccgagggctgctggaactgcaacgactgcaaggccggcaagaagctgcactacaagcagatcgtgtgggtgaagctgggcaactacagatggtggcccgccgagatctgcaaccccagaagcgtgcccctgaacatccagggcctgaagcacgacctgggcgacttccccgtgttcttcttcggcagccacgactactactgggtgcaccagggcagagtgttcccctacgtggagggcgacaagagcttcgccgagggccagaccagcatcaacaagaccttcaagaaggccctggaggaggccgccaagagattccaggagctgaaggcccagagagagagcaaggaggccctggagatcgagaagaacagcagaaagccccccccctacaagcacatcaaggccaacaaggtgatcggcaaggtgcagatccaggtggccgacctgagcgagatccccagatgcaactgcaagcccgccgacgagaacccctgcggcctggagagcgagtgcctgaacagaatgctgcagtacgagtgccacccccaggtgtgccccgccggcgacagatgccagaaccagtgcttcaccaagagactgtaccccgacgccgagatcatcaagaccgagagaagaggctggggcctgagaaccaagagaagcatcaagaagggcgagttcgtgaacgagtacgtgggcgagctgatcgacgaggaggagtgcagactgagaatcaagagagcccacgagaacagcgtgaccaacttctacatgctgaccgtgaccaaggacagaatcatcgacgccggccccaagggcaactacagcagattcatgaaccacagctgcaaccccaactgcgagacccagaagtggaccgtgaacggcgacgtgagagtgggcctgttcgccctgtgcgacatccccgccggcatggagctgaccttcaactacaacctggactgcctgggcaacggcagaaccgagtgccactgcggcgccgacaactgcagcggcttcctgggcgtgagacccaagagcgcctgcgccagcaccaacgaggagaaggccaagaacgccaagctgaagcagaagagaagaaagatcaagaccgagcccaagcagatgcacgaggactactgcttccagtgcggcgacggcggcgagctggtgatgtgcgacaagaaggactgccccaaggcctaccacctgctgtgcctgaacctgacccagcccccctacggcaagtgggagtgcccctggcaccagtgcgacgagtgcagcagcgccgccgtgagcttctgcgagttctgcccccacagcttctgcaaggaccacgagaagggcgccctggtgcccagcgccctggagggcagactgtgctgcagcgagcacgaccccatggcccccgtgagccccgagtactggagcaagatcaagtgcaagtgggagagccaggaccacggcgaggaggtgaaggagtag

SEQ ID NO: 105355 - DNA, 4167 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgaccaacggctaccccagcagcatcagcgtgtacgagacccagaccaagtaccagagctacaaccagtaccccaacggcagcgccaacggcttcggcgccgtgagaaacttcagccccaccgactactaccacagcgagatccccaacaccagaccccacgagatcctggagaagcccagccccccccagcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctggtggccctgcatggtgagcagcgacccccagctggaggtgcacaccaagatcaacaccagaggcgccagagagtaccacgtgcagttcttcagcaaccagcccgagagagcctgggtgcacgagaagagagtgagagagtacaagggccacaagcagtacgaggagctgctggccgaggccaccaagcaggccagcaaccacagcgagaagcagaagatcagaaagcccagaccccagagagagagagcccagtgggacatcggcatcgcccacgccgagaaggccctgaagatgaccagagaggagagaatcgagcagtacaccttcatctacatcgacaagcagcccgaggaggccctgagccaggccaagaagagcgtggccagcaagaccgaggtgaagaagaccagaagacccagaagcgtgctgaacacccagcccgagcagaccaacgccggcgaggtggccagcagcctgagcagcaccgagatcagaagacacagccagagaagacacaccagcgccgaggaggaggagcccccccccgtgaagatcgcctggaagaccgccgccgccagaaagagcctgcccgccagcatcaccatgcacaagggcagcctggacctgcagaagtgcaacatgagccccgtggtgaagatcgagcaggtgttcgccctgcagaacgccaccggcgacggcaagttcatcgaccagttcgtgtacagcaccaagggcatcggcaacaagaccgagatcagcgtgagaggccaggacagactgatcatcagcacccccaaccagagaaacgagaagcccacccagagcgtgagcagccccgaggccaccagcggcagcaccggcagcgtggagaagaagcagcagagaagaagcatcagaaccagaagcgagagcgagaagagcaccgaggtggtgcccaagaagaagatcaagaaggagcaggtggagaccgtgccccaggccaccgtgaagaccggcctgcagaagggcgccagcgagatcagcgacagctgcaagcccctgaagaagagaagcagagccagcaccgacgtggagatgaccagcagcgcctacagagacaccagcgacagcgacagcagaggcctgagcgacctgcaggtgggcttcggcaagcaggtggacagccccagcgccaccgccgacgccgacgtgagcgacgtgcagagcatggacagcagcctgagcagaagaggcaccggcatgagcaagaaggacaccgtgtgccagatctgcgagagcagcggcgacagcctgatcccctgcgagggcgagtgctgcaagcacttccacctggagtgcctgggcctggccagcctgcccgacagcaagttcatctgcatggagtgcaagaccggccagcacccctgcttcagctgcaaggtgagcggcaaggacgtgaagagatgcagcgtgggcgcctgcggcaagttctaccacgaggcctgcgtgagaaagttccccaccgccatcttcgagagcaagggcttcagatgcccccagcactgctgcagcgcctgcagcatggagaaggacatccacaaggccagcaagggcagaatgatgagatgcctgagatgccccgtggcctaccacagcggcgacgcctgcatcgccgccggcagcatgctggtgagcagctacatcctgatctgcagcaaccacagcaagagaagcagcaacagcagcgccgtgaacgtgggcttctgcttcgtgtgcgccagaggcggcagactgctgtgctgcgagagctgccccgccagcttccaccccgagtgcctgagcatcgagatgcccgagggctgctggaactgcaacgactgcaaggccggcaagaagctgcactacaagcagatcgtgtgggtgaagctgggcaactacagatggtggcccgccgagatctgcaaccccagaagcgtgcccctgaacatccagggcctgaagcacgacctgggcgacttccccgtgttcttcttcggcagccacgactactactgggtgcaccagggcagagtgttcccctacgtggagggcgacaagagcttcgccgagggccagaccagcatcaacaagaccttcaagaaggccctggaggaggccgccaagagattccaggagctgaaggcccagagagagagcaaggaggccctggagatcgagaagaacagcagaaagccccccccctacaagcacatcaaggccaacaaggtgatcggcaaggtgcagatccaggtggccgacctgagcgagatccccagatgcaactgcaagcccgccgacgagaacccctgcggcctggagagcgagtgcctgaacagaatgctgcagtacgagtgccacccccaggtgtgccccgccggcgacagatgccagaaccagtgcttcaccaagagactgtaccccgacgccgagatcatcaagaccgagagaagaggctggggcctgagaaccaagagaagcatcaagaagggcgagttcgtgaacgagtacgtgggcgagctgatcgacgaggaggagtgcagactgagaatcaagagagcccacgagaacagcgtgaccaacttctacatgctgaccgtgaccaaggacagaatcatcgacgccggccccaagggcaactacagcagattcatgaaccacagctgcaaccccaactgcgagacccagaagtggaccgtgaacggcgacgtgagagtgggcctgttcgccctgtgcgacatccccgccggcatggagctgaccttcaactacaacctggactgcctgggcaacggcagaaccgagtgccactgcggcgccgacaactgcagcggcttcctgggcgtgagacccaagagcgcctgcgccagcaccaacgaggagaaggccaagaacgccaagctgaagcagaagagaagaaagatcaagaccgagcccaagcagatgcacgaggactactgcttccagtgcggcgacggcggcgagctggtgatgtgcgacaagaaggactgccccaaggcctaccacctgctgtgcctgaacctgacccagcccccctacggcaagtgggagtgcccctggcaccagtgcgacgagtgcagcagcgccgccgtgagcttctgcgagttctgcccccacagcttctgcaaggaccacgagaagggcgccctggtgcccagcgccctggagggcagactgtgctgcagcgagcacgaccccatggcccccgtgagccccgagtactggagcaagatcaagtgcaagtgggagagccaggaccacggcgaggaggtgaaggagtag

SEQ ID NO: 105356 - DNA, 4125 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctggtggccctgcatggtgagcagcgacccccagctggaggtgcacaccaagatcaacaccagaggcgccagagagtaccacgtgcagttcttcagcaaccagcccgagagagcctgggtgcacgagaagagagtgagagagtacaagggccacaagcagtacgaggagctgctggccgaggccaccaagcaggccagcaaccacagcgagaagcagaagatcagaaagcccagaccccagagagagagagcccagtgggacatcggcatcgcccacgccgagaaggccctgaagatgaccagagaggagagaatcgagcagtacaccttcatctacatcgacaagcagcccgaggaggccctgagccaggccaagaagagcgtggccagcaagaccgaggtgaagaagaccagaagacccagaagcgtgctgaacacccagcccgagcagaccaacgccggcgaggtggccagcagcctgagcagcaccgagatcagaagacacagccagagaagacacaccagcgccgaggaggaggagcccccccccgtgaagatcgcctggaagaccgccgccgccagaaagagcctgcccgccagcatcaccatgcacaagggcagcctggacctgcagaagtgcaacatgagccccgtggtgaagatcgagcaggtgttcgccctgcagaacgccaccggcgacggcaagttcatcgaccagttcgtgtacagcaccaagggcatcggcaacaagaccgagatcagcgtgagaggccaggacagactgatcatcagcacccccaaccagagaaacgagaagcccacccagagcgtgagcagccccgaggccaccagcggcagcaccggcagcgtggagaagaagcagcagagaagaagcatcagaaccagaagcgagagcgagaagagcaccgaggtggtgcccaagaagaagatcaagaaggagcaggtggagaccgtgccccaggccaccgtgaagaccggcctgcagaagggcgccagcgagatcagcgacagctgcaagcccctgaagaagagaagcagagccagcaccgacgtggagatgaccagcagcgcctacagagacaccagcgacagcgacagcagaggcctgagcgacctgcaggtgggcttcggcaagcaggtggacagccccagcgccaccgccgacgccgacgtgagcgacgtgcagagcatggacagcagcctgagcagaagaggcaccggcatgagcaagaaggacaccgtgtgccagatctgcgagagcagcggcgacagcctgatcccctgcgagggcgagtgctgcaagcacttccacctggagtgcctgggcctggccagcctgcccgacagcaagttcatctgcatggagtgcaagaccggccagcacccctgcttcagctgcaaggtgagcggcaaggacgtgaagagatgcagcgtgggcgcctgcggcaagttctaccacgaggcctgcgtgagaaagttccccaccgccatcttcgagagcaagggcttcagatgcccccagcactgctgcagcgcctgcagcatggagaaggacatccacaaggccagcaagggcagaatgatgagatgcctgagatgccccgtggcctaccacagcggcgacgcctgcatcgccgccggcagcatgctggtgagcagctacatcctgatctgcagcaaccacagcaagagaagcagcaacagcagcgccgtgaacgtgggcttctgcttcgtgtgcgccagaggcctgatcgtgcaggaccacagcgaccccatgttcagcagctacgcctacaagagccactacctgctgaacgagagcaacagagccgagctgatgaagctgcccatgatccccagcagcagcgccagcaagaagaagtgcgagaagggcggcagactgctgtgctgcgagagctgccccgccagcttccaccccgagtgcctgagcatcgagatgcccgagggctgctggaactgcaacgactgcaaggccggcaagaagctgcactacaagcagatcgtgtgggtgaagctgggcaactacagatggtggcccgccgagatctgcaaccccagaagcgtgcccctgaacatccagggcctgaagcacgacctgggcgacttccccgtgttcttcttcggcagccacgactactactgggtgcaccagggcagagtgttcccctacgtggagggcgacaagagcttcgccgagggccagaccagcatcaacaagaccttcaagaaggccctggaggaggccgccaagagattccaggagctgaaggcccagagagagagcaaggaggccctggagatcgagaagaacagcagaaagccccccccctacaagcacatcaaggccaacaaggtgatcggcaaggtgcagatccaggtggccgacctgagcgagatccccagatgcaactgcaagcccgccgacgagaacccctgcggcctggagagcgagtgcctgaacagaatgctgcagtacgagtgccacccccaggtgtgccccgccggcgacagatgccagaaccagtgcttcaccaagagactgtaccccgacgccgagatcatcaagaccgagagaagaggctggggcctgagaaccaagagaagcatcaagaagggcgagttcgtgaacgagtacgtgggcgagctgatcgacgaggaggagtgcagactgagaatcaagagagcccacgagaacagcgtgaccaacttctacatgctgaccgtgaccaaggacagaatcatcgacgccggccccaagggcaactacagcagattcatgaaccacagctgcaaccccaactgcgagacccagaagtggaccgtgaacggcgacgtgagagtgggcctgttcgccctgtgcgacatccccgccggcatggagctgaccttcaactacaacctggactgcctgggcaacggcagaaccgagtgccactgcggcgccgacaactgcagcggcttcctgggcgtgagacccaagagcgcctgcgccagcaccaacgaggagaaggccaagaacgccaagctgaagcagaagagaagaaagatcaagaccgagcccaagcagatgcacgaggactactgcttccagtgcggcgacggcggcgagctggtgatgtgcgacaagaaggactgccccaaggcctaccacctgctgtgcctgaacctgacccagcccccctacggcaagtgggagtgcccctggcaccagtgcgacgagtgcagcagcgccgccgtgagcttctgcgagttctgcccccacagcttctgcaaggaccacgagaagggcgccctggtgcccagcgccctggagggcagactgtgctgcagcgagcacgaccccatggcccccgtgagccccgagtactggagcaagatcaagtgcaagtgggagagccaggaccacggcgaggaggtgaaggagtag

SEQ ID NO: 105357 - DNA, 4281 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgaccaacggctaccccagcagcatcagcgtgtacgagacccagaccaagtaccagagctacaaccagtaccccaacggcagcgccaacggcttcggcgccgtgagaaacttcagccccaccgactactaccacagcgagatccccaacaccagaccccacgagatcctggagaagcccagccccccccagcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctggtggccctgcatggtgagcagcgacccccagctggaggtgcacaccaagatcaacaccagaggcgccagagagtaccacgtgcagttcttcagcaaccagcccgagagagcctgggtgcacgagaagagagtgagagagtacaagggccacaagcagtacgaggagctgctggccgaggccaccaagcaggccagcaaccacagcgagaagcagaagatcagaaagcccagaccccagagagagagagcccagtgggacatcggcatcgcccacgccgagaaggccctgaagatgaccagagaggagagaatcgagcagtacaccttcatctacatcgacaagcagcccgaggaggccctgagccaggccaagaagagcgtggccagcaagaccgaggtgaagaagaccagaagacccagaagcgtgctgaacacccagcccgagcagaccaacgccggcgaggtggccagcagcctgagcagcaccgagatcagaagacacagccagagaagacacaccagcgccgaggaggaggagcccccccccgtgaagatcgcctggaagaccgccgccgccagaaagagcctgcccgccagcatcaccatgcacaagggcagcctggacctgcagaagtgcaacatgagccccgtggtgaagatcgagcaggtgttcgccctgcagaacgccaccggcgacggcaagttcatcgaccagttcgtgtacagcaccaagggcatcggcaacaagaccgagatcagcgtgagaggccaggacagactgatcatcagcacccccaaccagagaaacgagaagcccacccagagcgtgagcagccccgaggccaccagcggcagcaccggcagcgtggagaagaagcagcagagaagaagcatcagaaccagaagcgagagcgagaagagcaccgaggtggtgcccaagaagaagatcaagaaggagcaggtggagaccgtgccccaggccaccgtgaagaccggcctgcagaagggcgccagcgagatcagcgacagctgcaagcccctgaagaagagaagcagagccagcaccgacgtggagatgaccagcagcgcctacagagacaccagcgacagcgacagcagaggcctgagcgacctgcaggtgggcttcggcaagcaggtggacagccccagcgccaccgccgacgccgacgtgagcgacgtgcagagcatggacagcagcctgagcagaagaggcaccggcatgagcaagaaggacaccgtgtgccagatctgcgagagcagcggcgacagcctgatcccctgcgagggcgagtgctgcaagcacttccacctggagtgcctgggcctggccagcctgcccgacagcaagttcatctgcatggagtgcaagaccggccagcacccctgcttcagctgcaaggtgagcggcaaggacgtgaagagatgcagcgtgggcgcctgcggcaagttctaccacgaggcctgcgtgagaaagttccccaccgccatcttcgagagcaagggcttcagatgcccccagcactgctgcagcgcctgcagcatggagaaggacatccacaaggccagcaagggcagaatgatgagatgcctgagatgccccgtggcctaccacagcggcgacgcctgcatcgccgccggcagcatgctggtgagcagctacatcctgatctgcagcaaccacagcaagagaagcagcaacagcagcgccgtgaacgtgggcttctgcttcgtgtgcgccagaggcctgatcgtgcaggaccacagcgaccccatgttcagcagctacgcctacaagagccactacctgctgaacgagagcaacagagccgagctgatgaagctgcccatgatccccagcagcagcgccagcaagaagaagtgcgagaagggcggcagactgctgtgctgcgagagctgccccgccagcttccaccccgagtgcctgagcatcgagatgcccgagggctgctggaactgcaacgactgcaaggccggcaagaagctgcactacaagcagatcgtgtgggtgaagctgggcaactacagatggtggcccgccgagatctgcaaccccagaagcgtgcccctgaacatccagggcctgaagcacgacctgggcgacttccccgtgttcttcttcggcagccacgactactactgggtgcaccagggcagagtgttcccctacgtggagggcgacaagagcttcgccgagggccagaccagcatcaacaagaccttcaagaaggccctggaggaggccgccaagagattccaggagctgaaggcccagagagagagcaaggaggccctggagatcgagaagaacagcagaaagccccccccctacaagcacatcaaggccaacaaggtgatcggcaaggtgcagatccaggtggccgacctgagcgagatccccagatgcaactgcaagcccgccgacgagaacccctgcggcctggagagcgagtgcctgaacagaatgctgcagtacgagtgccacccccaggtgtgccccgccggcgacagatgccagaaccagtgcttcaccaagagactgtaccccgacgccgagatcatcaagaccgagagaagaggctggggcctgagaaccaagagaagcatcaagaagggcgagttcgtgaacgagtacgtgggcgagctgatcgacgaggaggagtgcagactgagaatcaagagagcccacgagaacagcgacagaatcatcgacgccggccccaagggcaactacagcagattcatgaaccacagctgcaaccccaactgcgagacccagaagtggaccgtgaacggcgacgtgagagtgggcctgttcgccctgtgcgacatccccgccggcatggagctgaccttcaactacaacctggactgcctgggcaacggcagaaccgagtgccactgcggcgccgacaactgcagcggcttcctgggcgtgagacccaagagcgcctgcgccagcaccaacgaggagaaggccaagaacgccaagctgaagcagaagagaagaaagatcaagaccgagcccaagcagatgcacgaggactactgcttccagtgcggcgacggcggcgagctggtgatgtgcgacaagaaggactgccccaaggcctaccacctgctgtgcctgaacctgacccagcccccctacggcaagtgggagtgcccctggcaccagtgcgacgagtgcagcagcgccgccgtgagcttctgcgagttctgcccccacagcttctgcaaggaccacgagaagggcgccctggtgcccagcgccctggagggcagactgtgctgcagcgagcacgaccccatggcccccgtgagccccgagtactggagcaagatcaagtgcaagtgggagagccaggaccacggcgaggaggtgaaggagtag

SEQ ID NO: 105358 - DNA, 849 bp, Artificial Sequence
  Description of Artificial Sequence: Synthetic coding sequence
atggacttcagcttcagcttcatgcagggcatcatgggcaacaccatccagcagcccccccagctgatcgacagcgccaacatcagacaggaggacgccttcgacaacaacagcgacatcgccgaggacggcggccagaccccctacgaggccaccctgcagcagggcttccagtaccccgccaccaccgaggacctgccccccctgaccaacggctaccccagcagcatcagcgtgtacgagacccagaccaagtaccagagctacaaccagtaccccaacggcagcgccaacggcttcggcgccgtgagaaacttcagccccaccgactactaccacagcgagatccccaacaccagaccccacgagatcctggagaagcccagccccccccagcccccccccccccccagcgtgccccagaccgtgatccccaagaagaccggcagccccgagatcaagctgaagatcaccaagaccatccagaacggcagagagctgttcgagagcagcctgtgcggcgacctgctgaacgaggtgcaggccagcgagcacaccaagagcaagcacgagagcagaaaggagaagagaaagaagagcaacaagcacgacagcagcagaagcgaggagagaaagagccacaagatccccaagctggagcccgaggagcagaacagacccaacgagagagtggacaccgtgagcgagaagcccagagaggagcccgtgctgaaggaggaggcccccgtgcagcccatcctgagcagcgtgcccaccaccgaggtgagcaccggcgtgaagttccaggtgggcgacctggtgtggagcaaggtgggcacctacccctag

SEQ ID NO: 105359 - DNA, 78 bp, Artificial Sequence
  Description of Artificial Sequence: Synthetic coding sequence
atggacttcagcttcagcttcatgcagggcatcatgggcaacaccatccagcagcccccccagctgatcgacagctag

SEQ ID NO: 105360 - DNA, 48 bp, Artificial Sequence
  Description of Artificial Sequence: Synthetic coding sequence
atggacttcagcttcagcttcatgcagggcatcatgggcaacacctag

SEQ ID NO: 105361 - DNA, 1620 bp, Artificial Sequence
  Description of Artificial Sequence: Synthetic coding sequence
atgcccggccagagaagagccctgagccccaagatggccagcatgagagagagcgacaccggcctgtggctgcacaacaagctgggcgccaccgacgagctgtgggccccccccagcatcgccagcctgctgaccgccgccgtgatcgacaacatcagactgtgcttccacggcctgagcagcgccgtgaagctgaagctgctgctgggcaccctgcacctgcccagaagaaccgtggacgagatgaagggcgccctgatggagatcatccagctggccagcctggacagcgacccctgggtgctgatggtggccgacatcctgaagagcttccccgacaccggcagcctgaacctggagctggaggagcagaaccccaacgtgcaggacatcctgggcgagctgagagagaaggtgggcgagtgcgaggccagcgccatgctgcccctggagtgccagtacctgaacaagaacgccctgaccaccctggccggccccctgaccccccccgtgaagcacttccagctgaagagaaagcccaagagcgccaccctgagagccgagctgctgcagaagagcaccgagaccgcccagcagctgaagagaagcgccggcgtgcccttccacgccaagggcagaggcctgctgagaaagatggacaccaccacccccctgaagggcatccccaagcaggcccccttcagaagccccaccgcccccagcgtgttcagccccaccggcaacagaacccccatcccccccagcagaaccctgctgagaaaggagagaggcgtgaagctgctggacatcagcgagctggacatggtgggcgccggcagagaggccaagagaagaagaaagaccctggacgccgaggtggtggagaagcccgccaaggaggagaccgtggtggagaacgccacccccgactacgccgccggcctggtgagcacccagaagctgggcagcctgaacaacgagcccgccctgcccagcaccagctacctgcccagcacccccagcgtggtgcccgccagcagctacatccccagcagcgagaccccccccgcccccagcagcagagaggccagcagaccccccgaggagcccagcgcccccagccccaccctgcccgcccagttcaagcagagagcccccatgtacaacagcggcctgagccccgccacccccacccccgccgcccccaccagccccctgacccccaccaccccccccgccgtggcccccaccacccagaccccccccgtggccatggtggccccccagacccaggcccccgcccagcagcagcccaagaagaacctgagcctgaccagagagcagatgttcgccgcccaggagatgttcaagaccgccaacaaggtgaccagacccgagaaggccctgatcctgggcttcatggccggcagcagagagaacccctgccaggagcagggcgacgtgatccagatcaagctgagcgagcacaccgaggacctgcccaaggccgacggccagggcagcaccaccatgctggtggacaccgtgttcgagatgaactacgccaccggccagtggaccagattcaagaagtacaagcccatgaccaacgtgagctag

SEQ ID NO: 105362 - DNA, 1587 bp, Artificial Sequence
  Description of Artificial Sequence: Synthetic coding sequence
atggccagcatgagagagagcgacaccggcctgtggctgcacaacaagctgggcgccaccgacgagctgtgggccccccccagcatcgccagcctgctgaccgccgccgtgatcgacaacatcagactgtgcttccacggcctgagcagcgccgtgaagctgaagctgctgctgggcaccctgcacctgcccagaagaaccgtggacgagatgaagggcgccctgatggagatcatccagctggccagcctggacagcgacccctgggtgctgatggtggccgacatcctgaagagcttccccgacaccggcagcctgaacctggagctggaggagcagaaccccaacgtgcaggacatcctgggcgagctgagagagaaggtgggcgagtgcgaggccagcgccatgctgcccctggagtgccagtacctgaacaagaacgccctgaccaccctggccggccccctgaccccccccgtgaagcacttccagctgaagagaaagcccaagagcgccaccctgagagccgagctgctgcagaagagcaccgagaccgcccagcagctgaagagaagcgccggcgtgcccttccacgccaagggcagaggcctgctgagaaagatggacaccaccacccccctgaagggcatccccaagcaggcccccttcagaagccccaccgcccccagcgtgttcagccccaccggcaacagaacccccatcccccccagcagaaccctgctgagaaaggagagaggcgtgaagctgctggacatcagcgagctggacatggtgggcgccggcagagaggccaagagaagaagaaagaccctggacgccgaggtggtggagaagcccgccaaggaggagaccgtggtggagaacgccacccccgactacgccgccggcctggtgagcacccagaagctgggcagcctgaacaacgagcccgccctgcccagcaccagctacctgcccagcacccccagcgtggtgcccgccagcagctacatccccagcagcgagaccccccccgcccccagcagcagagaggccagcagaccccccgaggagcccagcgcccccagccccaccctgcccgcccagttcaagcagagagcccccatgtacaacagcggcctgagccccgccacccccacccccgccgcccccaccagccccctgacccccaccaccccccccgccgtggcccccaccacccagaccccccccgtggccatggtggccccccagacccaggcccccgcccagcagcagcccaagaagaacctgagcctgaccagagagcagatgttcgccgcccaggagatgttcaagaccgccaacaaggtgaccagacccgagaaggccctgatcctgggcttcatggccggcagcagagagaacccctgccaggagcagggcgacgtgatccagatcaagctgagcgagcacaccgaggacctgcccaaggccgacggccagggcagcaccaccatgctggtggacaccgtgttcgagatgaactacgccaccggccagtggaccagattcaagaagtacaagcccatgaccaacgtgagctag

SEQ ID NO: 105363 - DNA, 1182 bp, Artificial Sequence
  Description of Artificial Sequence: Synthetic coding sequence
atgctgcccctggagtgccagtacctgaacaagaacgccctgaccaccctggccggccccctgaccccccccgtgaagcacttccagctgaagagaaagcccaagagcgccaccctgagagccgagctgctgcagaagagcaccgagaccgcccagcagctgaagagaagcgccggcgtgcccttccacgccaagggcagaggcctgctgagaaagatggacaccaccacccccctgaagggcatccccaagcaggcccccttcagaagccccaccgcccccagcgtgttcagccccaccggcaacagaacccccatcccccccagcagaaccctgctgagaaaggagagaggcgtgaagctgctggacatcagcgagctggacatggtgggcgccggcagagaggccaagagaagaagaaagaccctggacgccgaggtggtggagaagcccgccaaggaggagaccgtggtggagaacgccacccccgactacgccgccggcctggtgagcacccagaagctgggcagcctgaacaacgagcccgccctgcccagcaccagctacctgcccagcacccccagcgtggtgcccgccagcagctacatccccagcagcgagaccccccccgcccccagcagcagagaggccagcagaccccccgaggagcccagcgcccccagccccaccctgcccgcccagttcaagcagagagcccccatgtacaacagcggcctgagccccgccacccccacccccgccgcccccaccagccccctgacccccaccaccccccccgccgtggcccccaccacccagaccccccccgtggccatggtggccccccagacccaggcccccgcccagcagcagcccaagaagaacctgagcctgaccagagagcagatgttcgccgcccaggagatgttcaagaccgccaacaaggtgaccagacccgagaaggccctgatcctgggcttcatggccggcagcagagagaacccctgccaggagcagggcgacgtgatccagatcaagctgagcgagcacaccgaggacctgcccaaggccgacggccagggcagcaccaccatgctggtggacaccgtgttcgagatgaactacgccaccggccagtggaccagattcaagaagtacaagcccatgaccaacgtgagctag

SEQ ID NO: 105364 - DNA, 462 bp, Artificial Sequence
  Description of Artificial Sequence: Synthetic coding sequence
atgtacagaatgcagctgctgagctgcatcgccctgagcctggccctggtgaccaacagcgcccccaccagcagcagcaccaagaagacccagctgcagctggagcacctgctgctggacctgcagatgatcctgaacggcatcaacaactacaagaaccccaagctgaccagaatgctgaccttcaagttctacatgcccaagaaggccaccgagctgaagcacctgcagtgcctggaggaggagctgaagcccctggaggaggtgctgaacctggcccagagcaagaacttccacctgagacccagagacctgatcagcaacatcaacgtgatcgtgctggagctgaagggcagcgagaccaccttcatgtgcgagtacgccgacgagaccgccaccatcgtggagttcctgaacagatggatcaccttctgccagagcatcatcagcaccctgacctag

SEQ ID NO: 105365 - DNA, 2673 bp, Artificial Sequence
  Description of Artificial Sequence: Synthetic coding sequence
atggacagcaacaccgcccccctgggccccagctgcccccagcccccccccgccccccagccccaggccagaagcagactgaacgccaccgccagcctggagcaggagagaagcgagagacccagagcccccggcccccaggccggccccggccccggcgtgagagacgccgccgcccccgccgagccccaggcccagcacaccagaagcagagagagagccgacggcaccggccccaccaagggcgacatggagatccccttcgaggaggtgctggagagagccaaggccggcgaccccaaggcccagaccgaggtgggcaagcactacctgcagctggccggcgacaccgacgaggagctgaacagctgcaccgccgtggactggctggtgctggccgccaagcagggcagaagagaggccgtgaagctgctgagaagatgcctggccgacagaagaggcatcaccagcgagaacgagagagaggtgagacagctgagcagcgagaccgacctggagagagccgtgagaaaggccgccctggtgatgtactggaagctgaaccccaagaagaagaagcaggtggccgtggccgagctgctggagaacgtgggccaggtgaacgagcacgacggcggcgcccagcccggccccgtgcccaagagcctgcagaagcagagaagaatgctggagagactggtgagcagcgagagcaagaactacatcgccctggacgacttcgtggagatcaccaagaagtacgccaagggcgtgatccccagcagcctgttcctgcaggacgacgaggacgacgacgagctggccggcaagagccccgaggacctgcccctgagactgaaggtggtgaagtaccccctgcacgccatcatggagatcaaggagtacctgatcgacatggccagcagagccggcatgcactggctgagcaccatcatccccacccaccacatcaacgccctgatcttcttcttcatcgtgagcaacctgaccatcgacttcttcgccttcttcatccccctggtgatcttctacctgagcttcatcagcatggtgatctgcaccctgaaggtgttccaggacagcaaggcctgggagaacttcagaaccctgaccgacctgctgctgagattcgagcccaacctggacgtggagcaggccgaggtgaacttcggctggaaccacctggagccctacgcccacttcctgctgagcgtgttcttcgtgatcttcagcttccccatcgccagcaaggactgcatcccctgcagcgagctggccgtgatcaccggcttcttcaccgtgaccagctacctgagcctgagcacccacgccgagccctacaccagaagagccctggccaccgaggtgaccgccggcctgctgagcctgctgcccagcatgcccctgaactggccctacctgaaggtgctgggccagaccttcatcaccgtgcccgtgggccacctggtggtgctgaacgtgagcgtgccctgcctgctgtacgtgtacctgctgtacctgttcttcagaatggcccagctgagaaacttcaagggcacctactgctacctggtgccctacctggtgtgcttcatgtggtgcgagctgagcgtggtgatcctgctggagagcaccggcctgggcctgctgagagccagcatcggctacttcctgttcctgttcgccctgcccatcctggtggccggcctggccctggtgggcgtgctgcagttcgccagatggttcaccagcctggagctgaccaagatcgccgtgaccgtggccgtgtgcagcgtgcccctgctgctgagatggtggaccaaggccagcttcagcgtggtgggcatggtgaagagcctgaccagaagcagcatggtgaagctgatcctggtgtggctgaccgccatcgtgctgttctgctggttctacgtgtacagaagcgagggcatgaaggtgtacaacagcaccctgacctggcagcagtacggcgccctgtgcggccccagagcctggaaggagaccaacatggccagaacccagatcctgtgcagccacctggagggccacagagtgacctggaccggcagattcaagtacgtgagagtgaccgacatcgacaacagcgccgagagcgccatcaacatgctgcccttcttcatcggcgactggatgagatgcctgtacggcgaggcctaccccgcctgcagccccggcaacaccagcaccgccgaggaggagctgtgcagactgaagctgctggccaagcacccctgccacatcaagaagttcgacagatacaagttcgagatcaccgtgggcatgcccttcagcagcggcgccgacggcagcagaagcagagaggaggacgacgtgaccaaggacatcgtgctgagagccagcagcgagttcaagagcgtgctgctgagcctgagacagggcagcctgatcgagttcagcaccatcctggagggcagactgggcagcaagtggcccgtgttcgagctgaaggccatcagctgcctgaactgcatggcccagctgagccccaccagaagacacgtgaagatcgagcacgactggagaagcaccgtgcacggcgccgtgaagttcgccttcgacttcttcttcttccccttcctgagcgccgcctag

SEQ ID NO: 105366 - DNA, 807 bp, Artificial Sequence
  Description of Artificial Sequence: Synthetic coding sequence
atggtgaagagcctgaccagaagcagcatggtgaagctgatcctggtgtggctgaccgccatcgtgctgttctgctggttctacgtgtacagaagcgagggcatgaaggtgtacaacagcaccctgacctggcagcagtacggcgccctgtgcggccccagagcctggaaggagaccaacatggccagaacccagatcctgtgcagccacctggagggccacagagtgacctggaccggcagattcaagtacgtgagagtgaccgacatcgacaacagcgccgagagcgccatcaacatgctgcccttcttcatcggcgactggatgagatgcctgtacggcgaggcctaccccgcctgcagccccggcaacaccagcaccgccgaggaggagctgtgcagactgaagctgctggccaagcacccctgccacatcaagaagttcgacagatacaagttcgagatcaccgtgggcatgcccttcagcagcggcgccgacggcagcagaagcagagaggaggacgacgtgaccaaggacatcgtgctgagagccagcagcgagttcaagagcgtgctgctgagcctgagacagggcagcctgatcgagttcagcaccatcctggagggcagactgggcagcaagtggcccgtgttcgagctgaaggccatcagctgcctgaactgcatggcccagctgagccccaccagaagacacgtgaagatcgagcacgactggagaagcaccgtgcacggcgccgtgaagttcgccttcgacttcttcttcttccccttcctgagcgccgcctag

SEQ ID NO: 105367 - DNA, 3342 bp, Artificial Sequence
  Description of Artificial Sequence: Synthetic coding sequence
atgcccagacccgagctgcccctgcccgagggctgggaggaggccagagacttcgacggcaaggtgtactacatcgaccacaccaacagaaccaccagctggatcgaccccagagacagatacaccaagcccctgaccttcgccgactgcatcagcgacgagctgcccctgggctgggaggaggcctacgacccccaggtgggcgactacttcatcgaccacaacaccaagaccacccagatcgaggaccccagagtgcagtggagaagagagcaggagcacatgctgaaggactacctggtggtggcccaggaggccctgagcgcccagaaggagatctaccaggtgaagcagcagagactggagctggcccagcaggagtaccagcagctgcacgccgtgtgggagcacaagctgggcagccaggtgagcctggtgagcggcagcagcagcagcagcaagtacgaccccgagatcctgaaggccgagatcgccaccgccaagagcagagtgaacaagctgaagagagagatggtgcacctgcagcacgagctgcagttcaaggagagaggcttccagaccctgaagaagatcgacaagaagatgagcgacgcccagggcagctacaagctggacgaggcccaggccgtgctgagagagaccaaggccatcaagaaggccatcacctgcggcgagaaggagaagcaggacctgatcaagagcctggccatgctgaaggacggcttcagaaccgacagaggcagccacagcgacctgtggagcagcagcagcagcctggagagcagcagcttccccctgcccaagcagtacctggacgtgagcagccagaccgacatcagcggcagcttcggcatcaacagcaacaaccagctggccgagaaggtgagactgagactgagatacgaggaggccaagagaagaatcgccaacctgaagatccagctggccaagctggacagcgaggcctggcccggcgtgctggacagcgagagagacagactgatcctgatcaacgagaaggaggagctgctgaaggagatgagattcatcagccccagaaagtggacccagggcgaggtggagcagctggagatggccagaaagagactggagaaggacctgcaggccgccagagacacccagagcaaggccctgaccgagagactgaagctgaacagcaagagaaaccagctggtgagagagctggaggaggccaccagacaggtggccaccctgcacagccagctgaagagcctgagcagcagcatgcagagcctgagcagcggcagcagccccggcagcctgaccagcagcagaggcagcctggtggccagcagcctggacagcagcaccagcgccagcttcaccgacctgtactacgaccccttcgagcagctggacagcgagctgcagagcaaggtggagttcctgctgctggagggcgccaccggcttcagacccagcggctgcatcaccaccatccacgaggacgaggtggccaagacccagaaggccgagggcggcggcagactgcaggccctgagaagcctgagcggcacccccaagagcatgaccagcctgagccccagaagcagcctgagcagccccagccccccctgcagccccctgatggccgaccccctgctggccggcgacgccttcctgaacagcctggagttcgaggaccccgagctgagcgccaccctgtgcgagctgagcctgggcaacagcgcccaggagagatacagactggaggagcccggcaccgagggcaagcagctgggccaggccgtgaacaccgcccagggctgcggcctgaaggtggcctgcgtgagcgccgccgtgagcgacgagagcgtggccggcgacagcggcgtgtacgaggccagcgtgcagagactgggcgccagcgaggccgccgccttcgacagcgacgagagcgaggccgtgggcgccaccagaatccagatcgccctgaagtacgacgagaagaacaagcagttcgccatcctgatcatccagctgagcaacctgagcgccctgctgcagcagcaggaccagaaggtgaacatcagagtggccgtgctgccctgcagcgagagcaccacctgcctgttcagaaccagacccctggacgccagcgacaccctggtgttcaacgaggtgttctgggtgagcatgagctaccccgccctgcaccagaagaccctgagagtggacgtgtgcaccaccgacagaagccacctggaggagtgcctgggcggcgcccagatcagcctggccgaggtgtgcagaagcggcgagagaagcaccagatggtacaacctgctgagctacaagtacctgaagaagcagagcagagagctgaagcccgtgggcgtgatggcccccgccagcggccccgccagcaccgacgccgtgagcgccctgctggagcagaccgccgtggagctggagaagagacaggagggcagaagcagcacccagaccctggaggacagctggagatacgaggagaccagcgagaacgaggccgtggccgaggaggaggaggaggaggtggaggaggaggagggcgaggaggacgtgttcaccgagaaggccagccccgacatggacggctaccccgccctgaaggtggacaaggagaccaacaccgagacccccgcccccagccccaccgtggtgagacccaaggacagaagagtgggcacccccagccagggccccttcctgagaggcagcaccatcatcagaagcaagaccttcagccccggcccccagagccagtacgtgtgcagactgaacagaagcgacagcgacagcagcaccctgagcaagaagccccccttcgtgagaaacagcctggagagaagaagcgtgagaatgaagagacccagcagcgtgaagagcctgagaagcgagagactgatcagaaccagcctggacctggagctggacctgcaggccaccagaacctggcacagccagctgacccaggagatcagcgtgctgaaggagctgaaggagcagctggagcaggccaagagccacggcgagaaggagctgccccagtggctgagagaggacgagagattcagactgctgctgagaatgctggagaagagacagatggacagagccgagcacaagggcgagctgcagaccgacaagatgatgagagccgccgccaaggacgtgcacagactgagaggccagagctgcaaggagccccccgaggtgcagagcttcagagagaagatggccttcttcaccagacccagaatgaacatccccgccctgagcgccgacgacgtgtag

SEQ ID NO: 105368 - DNA, 3360 bp, Artificial Sequence
  Description of Artificial Sequence: Synthetic coding sequence
atgcccagacccgagctgcccctgcccgagggctgggaggaggccagagacttcgacggcaaggtgtactacatcgaccacaccaacagaaccaccagctggatcgaccccagagacagatacaccaagcccctgaccttcgccgactgcatcagcgacgagctgcccctgggctgggaggaggcctacgacccccaggtgggcgactacttcatcgaccacaacaccaagaccacccagatcgaggaccccagagtgcagtggagaagagagcaggagcacatgctgaaggactacctggtggtggcccaggaggccctgagcgcccagaaggagatctaccaggtgaagcagcagagactggagctggcccagcaggagtaccagcagctgcacgccgtgtgggagcacaagctgggcagccaggtgagcctggtgagcggcagcagcagcagcagcaagtacgaccccgagatcctgaaggccgagatcgccaccgccaagagcagagtgaacaagctgaagagagagatggtgcacctgcagcacgagctgcagttcaaggagagaggcttccagaccctgaagaagatcgacaagaagatgagcgacgcccagggcagctacaagctggacgaggcccaggccgtgctgagagagaccaaggccatcaagaaggccatcacctgcggcgagaaggagaagcaggacctgatcaagagcctggccatgctgaaggacggcttcagaaccgacagaggcagccacagcgacctgtggagcagcagcagcagcctggagagcagcagcttccccctgcccaagcagtacctggacgtgagcagccagaccgacatcagcggcagcttcggcatcaacagcaacaaccagctggccgagaaggtgagactgagactgagatacgaggaggccaagagaagaatcgccaacctgaagatccagctggccaagctggacagcgaggcctggcccggcgtgctggacagcgagagagacagactgatcctgatcaacgagaaggaggagctgctgaaggagatgagattcatcagccccagaaagtggacccagggcgaggtggagcagctggagatggccagaaagagactggagaaggacctgcaggccgccagagacacccagagcaaggccctgaccgagagactgaagctgaacagcaagagaaaccagctggtgagagagctggaggaggccaccagacaggtggccaccctgcacagccagctgaagagcctgagcagcagcatgcagagcctgagcagcggcagcagccccggcagcctgaccagcagcagaggcagcctggtggccagcagcctggacagcagcaccagcgccagcttcaccgacctgtactacgaccccttcgagcagctggacagcgagctgcagagcaaggtggagttcctgctgctggagggcgccaccggcttcagacccagcggctgcatcaccaccatccacgaggacgaggtggccaagacccagaaggccgagggcggcggcagactgcaggccctgagaagcctgagcggcacccccaagagcatgaccagcctgagccccagaagcagcctgagcagccccagccccccctgcagccccctgatggccgaccccctgctggccggcgacgccttcctgaacagcctggagttcgaggaccccgagctgagcgccaccctgtgcgagctgagcctgggcaacagcgcccaggagagatacagactggaggagcccggcaccgagggcaagcagctgggccaggccgtgaacaccgcccagggctgcggcctgaaggtggcctgcgtgagcgccgccgtgagcgacgagagcgtggccggcgacagcggcgtgtacgaggccagcgtgcagagactgggcgccagcgaggccgccgccttcgacagcgacgagagcgaggccgtgggcgccaccagaatccagatcgccctgaagtacgacgagaagaacaagcagttcgccatcctgatcatccagctgagcaacctgagcgccctgctgcagcagcaggaccagaaggtgaacatcagagtggccgtgctgccctgcagcgagagcaccacctgcctgttcagaaccagacccctggacgccagcgacaccctggtgttcaacgaggtgttctgggtgagcatgagctaccccgccctgcaccagaagaccctgagagtggacgtgtgcaccaccgacagaagccacctggaggagtgcctgggcggcgcccagatcagcctggccgaggtgtgcagaagcggcgagagaagcaccagatggtacaacctgctgagctacaagtacctgaagaagcagagcagagagctgaagcccgtgggcgtgatggcccccgccagcggccccgccagcaccgacgccgtgagcgccctgctggagcagaccgccgtggagctggagaagagacaggagggcagaagcagcacccagaccctggaggacagctggagatacgaggagaccagcgagaacgaggccgtggccgaggaggaggaggaggaggtggaggaggaggagggcgaggaggacgtgttcaccgagaaggccagccccgacatggacggctaccccgccctgaaggtggacaaggagaccaacaccgagacccccgcccccagccccaccgtggtgagacccaaggacagaagagtgggcacccccagccagggccccttcctgagaggcagcaccatcatcagaagcaagaccttcagccccggcccccagagccagtacgtgtgcagactgaacagaagcgacagcgacagcagcaccctgagcaagaagccccccttcgtgagaaacagcctggagagaagaagcgtgagaatgaagagacccagcccccccccccagcccagcagcgtgaagagcctgagaagcgagagactgatcagaaccagcctggacctggagctggacctgcaggccaccagaacctggcacagccagctgacccaggagatcagcgtgctgaaggagctgaaggagcagctggagcaggccaagagccacggcgagaaggagctgccccagtggctgagagaggacgagagattcagactgctgctgagaatgctggagaagagacagatggacagagccgagcacaagggcgagctgcagaccgacaagatgatgagagccgccgccaaggacgtgcacagactgagaggccagagctgcaaggagccccccgaggtgcagagcttcagagagaagatggccttcttcaccagacccagaatgaacatccccgccctgagcgccgacgacgtgtag

SEQ ID NO: 105369 - DNA, 438 bp, Artificial Sequence; identical to SEQ ID NO: 97486
  Description of Artificial Sequence: Synthetic coding sequence

SEQ ID NO: 105370 - DNA, 786 bp, Artificial Sequence
  Description of Artificial Sequence: Synthetic coding sequence
atggccctgaacaagaaccacagcgagggcggcggcgtgatcgtgaacaacaccgagagcatcctgatgagctacgaccacgtggagctgaccttcaacgacatgaagaacgtgcccgaggccttcaagggcaccaagaagggcaccgtgtacctgaccccctacagagtgatcttcctgagcaagggcaaggacgccatgcagagcttcatgatgcccttctacctgatgaaggactgcgagatcaagcagcccgtgttcggcgccaactacatcaagggcaccgtgaaggccgaggccggcggcggctgggagggcagcgccagctacaagctgaccttcaccgccggcggcgccatcgagttcggccagagaatgctgcaggtggccagccaggccagcagaggcgaggtgcccagcggcgcctacggctacagctacatgcccagcggcgcctacgtgtaccccccccccgtggccaacggcatgtacccctgcccccccggctacccctaccccccccccccccccgagttctaccccggcccccccatgatggacggcgccatgggctacgtgcagccccccccccccccctaccccggccccatggagccccccgtgagcggccccgacgtgcccagcacccccgccgccgaggccaaggccgccgaggccgccgccagcgcctactacaaccccggcaacccccacaacgtgtacatgcccaccagccagccccccccccccccctactacccccccgaggacaagaagacccagtag

SEQ ID NO: 105371 - DNA, 720 bp, Artificial Sequence
  Description of Artificial Sequence: Synthetic coding sequence
atgagctacgaccacgtggagctgaccttcaacgacatgaagaacgtgcccgaggccttcaagggcaccaagaagggcaccgtgtacctgaccccctacagagtgatcttcctgagcaagggcaaggacgccatgcagagcttcatgatgcccttctacctgatgaaggactgcgagatcaagcagcccgtgttcggcgccaactacatcaagggcaccgtgaaggccgaggccggcggcggctgggagggcagcgccagctacaagctgaccttcaccgccggcggcgccatcgagttcggccagagaatgctgcaggtggccagccaggccagcagaggcgaggtgcccagcggcgcctacggctacagctacatgcccagcggcgcctacgtgtaccccccccccgtggccaacggcatgtacccctgcccccccggctacccctaccccccccccccccccgagttctaccccggcccccccatgatggacggcgccatgggctacgtgcagccccccccccccccctaccccggccccatggagccccccgtgagcggccccgacgtgcccagcacccccgccgccgaggccaaggccgccgaggccgccgccagcgcctactacaaccccggcaacccccacaacgtgtacatgcccaccagccagccccccccccccccctactacccccccgaggacaagaagacccagtag

SEQ ID NO: 105372 - DNA, 654 bp, Artificial Sequence
  Description of Artificial Sequence: Synthetic coding sequence
atggccctgaacaagaaccacagcgagggcggcggcgtgatcgtgaacaacaccgagagcatcctgatgagctacgaccacgtggagctgaccttcaacgacatgaagaacgtgcccgaggccttcaagggcaccaagaagggcaccgtgtacctgaccccctacagagtgatcttcctgagcaagggcaaggacgccatgcagagcttcatgatgcccttctacctgatgaaggactgcgagatcaagcagcccgtgttcggcgccaactacatcaagggcaccgtgaaggccgaggccggcgccagcagaggcgaggtgcccagcggcgcctacggctacagctacatgcccagcggcgcctacgtgtaccccccccccgtggccaacggcatgtacccctgcccccccggctacccctaccccccccccccccccgagttctaccccggcccccccatgatggacggcgccatgggctacgtgcagccccccccccccccctaccccggccccatggagccccccgtgagcggccccgacgtgcccagcacccccgccggcgagggcccctgggtgctggccgccctgagagaccagcccagcccccccagatgcagaaccgagagcctgagaatggccagagactgctag

SEQ ID NO: 105373 - DNA, 630 bp, Artificial Sequence
  Description of Artificial Sequence: Synthetic coding sequence
atggccctgaacaagaaccacagcgagggcggcggcgtgatcgtgaacaacaccgagagcatcctgatgagctacgaccacgtggagctgaccttcaacgacatgaagaacgtgcccgaggccttcaagggcaccaagaagggcaccgtgtacctgaccccctacagagtgatcttcctgagcaagggcaaggacgccatgcagagcttcatgatgcccttctacctgatgaaggactgcgagatcaagcagcccgtgttcggcgccaactacatcaagggcaccgtgaaggccgaggccggcggcggctgggagggcagcgccagctacaagctgaccttcaccgcccccatgagcccccccctgctgcagcccaagcccagaccccagaagcagccccccgcccccatcaccacccaggccatcgccagcagaagacacctgcccaccacccacagaaagatcgaggaccccgtgggcccccccgccagcctgccccccaccctgatcagcctgccctaccccagccacagaggctgcgccggcgcctggggcggcgagggcgccccctgcagccccagcagaagcgaccacaagcagctgcccggcaccagcatcgtgggccactag

SEQ ID NO: 105374 - DNA, 651 bp, Artificial Sequence
  Description of Artificial Sequence: Synthetic coding sequence
atggccctgaacaagaaccacagcgagggcggcggcgtgatcgtgaacaacaccgagagcatcctgatgagctacgaccacgtggagctgaccttcaacgacatgaagaacgtgcccgaggccttcaagggcaccaagaagggcaccgtgtacctgaccccctacagagtgatcttcctgagcaagggcaaggacgccatgcagagcttcatgatgcccttctacctgatgaaggactgcgagatcaagcagcccgtgttcggcgccaactacatcaagggcaccgtgaaggccgaggccggcggcggctgggagggcagcgccagctacaagctgaccttcaccgccggcggcgccatcgagttcggccagagaatgctgcaggtggccagccaggagttctaccccggcccccccatgatggacggcgccatgggctacgtgcagccccccccccccccctaccccggccccatggagccccccgtgagcggccccgacgtgcccagcacccccgccgccgaggccaaggccgccgaggccgccgccagcgcctactacaaccccggcaacccccacaacgtgtacatgcccaccagccagccccccccccccccctactacccccccgaggacaagaagacccagtag

SEQ ID NO: 105375 - DNA, 2769 bp, Artificial Sequence
  Description of Artificial Sequence: Synthetic coding sequence
atggccaccgccagccccagaagcgacaccagcaacaaccacagcggcagactgcagctgcaggtgaccgtgagcagcgccaagctgaagagaaagaagaactggttcggcaccgccatctacaccgaggtggtggtggacggcgagatcaccaagaccgccaagagcagcagcagcagcaaccccaagtgggacgagcagctgaccgtgaacgtgaccccccagaccaccctggagttccaggtgtggagccacagaaccctgaaggccgacgccctgctgggcaaggccaccatcgacctgaagcaggccctgctgatccacaacagaaagctggagagagtgaaggagcagctgaagctgagcctggagaacaagaacggcatcgcccagaccggcgagctgaccgtggtgctggacggcctggtgatcgagcaggagaacatcaccaactgcagcagcagccccaccatcgagatccaggagaacggcgacgccctgcacgagaacggcgagcccagcgccagaaccaccgccagactggccgtggagggcaccaacggcatcgacaaccacgtgcccaccagcaccctggtgcagaacagctgctgcagctacgtggtgaacggcgacaacacccccagcagccccagccaggtggccgccagacccaagaacacccccgcccccaagcccctggccagcgagcccgccgacgacaccgtgaacggcgagagcagcagcttcgcccccaccgacaacgccagcgtgaccggcacccccgtggtgagcgaggagaacgccctgagccccaactgcaccagcaccaccgtggaggacccccccgtgcaggagatcctgaccagcagcgagaacaacgagtgcatccccagcaccagcgccgagctggagagcgaggccagaagcatcctggagcccgacaccagcaacagcagaagcagcagcgccttcgaggccgccaagagcagacagcccgacggctgcatggaccccgtgagacagcagagcggcaacgccaacaccgagaccctgcccagcggctgggagcagagaaaggacccccacggcagaacctactacgtggaccacaacaccagaaccaccacctgggagagaccccagcccctgccccccggctgggagagaagagtggacgacagaagaagagtgtactacgtggaccacaacaccagaaccaccacctggcagagacccaccatggagagcgtgagaaacttcgagcagtggcagagccagagaaaccagctgcagggcgccatgcagcagttcaaccagagatacctgtacagcgccagcatgctggccgccgagaacgacccctacggccccctgccccccggctgggagaagagagtggacagcaccgacagagtgtacttcgtgaaccacaacaccaagaccacccagtgggaggaccccagaacccagggcctgcagaacgaggagcccctgcccgagggctgggagatcagatacaccagagagggcgtgagatacttcgtggaccacaacaccagaaccaccaccttcaaggaccccagaaacggcaagagcagcgtgaccaagggcggcccccagatcgcctacgagagaggcttcagatggaagctggcccacttcagatacctgtgccagagcaacgccctgcccagccacgtgaagatcaacgtgagcagacagaccctgttcgaggacagcttccagcagatcatggccctgaagccctacgacctgagaagaagactgtacgtgatcttcagaggcgaggagggcctggactacggcggcctggccagagagtggttcttcctgctgagccacgaggtgctgaaccccatgtactgcctgttcgagtacgccggcaagaacaactactgcctgcagatcaaccccgccagcaccatcaaccccgaccacctgagctacttctgcttcatcggcagattcatcgccatggccctgttccacggcaagttcatcgacaccggcttcagcctgcccttctacaagagaatgctgagcaagaagctgaccatcaaggacctggagagcatcgacaccgagttctacaacagcctgatctggatcagagacaacaacatcgaggagtgcggcctggagatgtacttcagcgtggacatggagatcctgggcaaggtgaccagccacgacctgaagctgggcggcagcaacatcctggtgaccgaggagaacaaggacgagtacatcggcctgatgaccgagtggagattcagcagaggcgtgcaggagcagaccaaggccttcctggacggcttcaacgaggtggtgcccctgcagtggctgcagtacttcgacgagaaggagctggaggtgatgctgtgcggcatgcaggaggtggacctggccgactggcagagaaacaccgtgtacagacactacaccagaaacagcaagcagatcatctggttctggcagttcgtgaaggagaccgacaacgaggtgagaatgagactgctgcagttcgtgaccggcacctgcagactgcccctgggcggcttcgccgagctgatgggcagcaacggcccccagaagttctgcatcgagaaggtgggcaaggacacctggctgcccagaagccacacctgcttcaacagactggacctgcccccctacaagagctacgagcagctgaaggagaagctgctgttcgccatcgaggagaccgagggcttcggccaggagtag

SEQ ID NO: 105376 - DNA, 2379 bp, Artificial Sequence
  Description of Artificial Sequence: Synthetic coding sequence
atggccaccgccagccccagaagcgacaccagcaacaaccacagcggcagactgcagctgcaggtgaccgtgagcagcgccaagctgaagagaaagaagaactggttcggcaccgccatctacaccgaggtggtggtggacggcgagatcaccaagaccgccaagagcagcagcagcagcaaccccaagtgggacgagcagctgaccgtgaacgtgaccccccagaccaccctggagttccaggtgtggagccacagaaccctgaaggccgacgccctgctgggcaaggccaccatcgacctgaagcaggccctgctgatccacaacagaaagttcaacggcgagagcagcagcttcgcccccaccgacaacgccagcgtgaccggcacccccgtggtgagcgaggagaacgccctgagccccaactgcaccagcaccaccgtggaggacccccccgtgcaggagatcctgaccagcagcgagaacaacgagtgcatccccagcaccagcgccgagctggagagcgaggccagaagcatcctggagcccgacaccagcaacagcagaagcagcagcgccttcgaggccgccaagagcagacagcccgacggctgcatggaccccgtgagacagcagagcggcaacgccaacaccgagaccctgcccagcggctgggagcagagaaaggacccccacggcagaacctactacgtggaccacaacaccagaaccaccacctgggagagaccccagcccctgccccccggctgggagagaagagtggacgacagaagaagagtgtactacgtggaccacaacaccagaaccaccacctggcagagacccaccatggagagcgtgagaaacttcgagcagtggcagagccagagaaaccagctgcagggcgccatgcagcagttcaaccagagatacctgtacagcgccagcatgctggccgccgagaacgacccctacggccccctgccccccggctgggagaagagagtggacagcaccgacagagtgtacttcgtgaaccacaacaccaagaccacccagtgggaggaccccagaacccagggcctgcagaacgaggagcccctgcccgagggctgggagatcagatacaccagagagggcgtgagatacttcgtggaccacaacaccagaaccaccaccttcaaggaccccagaaacggcaagagcagcgtgaccaagggcggcccccagatcgcctacgagagaggcttcagatggaagctggcccacttcagatacctgtgccagagcaacgccctgcccagccacgtgaagatcaacgtgagcagacagaccctgttcgaggacagcttccagcagatcatggccctgaagccctacgacctgagaagaagactgtacgtgatcttcagaggcgaggagggcctggactacggcggcctggccagagagtggttcttcctgctgagccacgaggtgctgaaccccatgtactgcctgttcgagtacgccggcaagaacaactactgcctgcagatcaaccccgccagcaccatcaaccccgaccacctgagctacttctgcttcatcggcagattcatcgccatggccctgttccacggcaagttcatcgacaccggcttcagcctgcccttctacaagagaatgctgagcaagaagctgaccatcaaggacctggagagcatcgacaccgagttctacaacagcctgatctggatcagagacaacaacatcgaggagtgcggcctggagatgtacttcagcgtggacatggagatcctgggcaaggtgaccagccacgacctgaagctgggcggcagcaacatcctggtgaccgaggagaacaaggacgagtacatcggcctgatgaccgagtggagattcagcagaggcgtgcaggagcagaccaaggccttcctggacggcttcaacgaggtggtgcccctgcagtggctgcagtacttcgacgagaaggagctggaggtgatgctgtgcggcatgcaggaggtggacctggccgactggcagagaaacaccgtgtacagacactacaccagaaacagcaagcagatcatctggttctggcagttcgtgaaggagaccgacaacgaggtgagaatgagactgctgcagttcgtgaccggcacctgcagactgcccctgggcggcttcgccgagctgatgggcagcaacggcccccagaagttctgcatcgagaaggtgggcaaggacacctggctgcccagaagccacacctgcttcaacagactggacctgcccccctacaagagctacgagcagctgaaggagaagctgctgttcgccatcgaggagaccgagggcttcggccaggagtag

SEQ ID NO: 105377 - DNA, 2115 bp, Artificial Sequence
  Description of Artificial Sequence: Synthetic coding sequence
atggccaccgccagccccagaagcgacaccagcaacaaccacagcggcagactgcagctgcaggtgaccgtgaacggcgagagcagcagcttcgcccccaccgacaacgccagcgtgaccggcacccccgtggtgagcgaggagaacgccctgagccccaactgcaccagcaccaccgtggaggacccccccgtgcaggagatcctgaccagcagcgagaacaacgagtgcatccccagcaccagcgccgagctggagagcgaggccagaagcatcctggagcccgacaccagcaacagcagaagcagcagcgccttcgaggccgccaagagcagacagcccgacggctgcatggaccccgtgagacagcagagcggcaacgccaacaccgagaccctgcccagcggctgggagcagagaaaggacccccacggcagaacctactacgtggaccacaacaccagaaccaccacctgggagagaccccagcccctgccccccggctgggagagaagagtggacgacagaagaagagtgtactacgtggaccacaacaccagaaccaccacctggcagagacccaccatggagagcgtgagaaacttcgagcagtggcagagccagagaaaccagctgcagggcgccatgcagcagttcaaccagagatacctgtacagcgccagcatgctggccgccgagaacgacccctacggccccctgccccccggctgggagaagagagtggacagcaccgacagagtgtacttcgtgaaccacaacaccaagaccacccagtgggaggaccccagaacccagggcctgcagaacgaggagcccctgcccgagggctgggagatcagatacaccagagagggcgtgagatacttcgtggaccacaacaccagaaccaccaccttcaaggaccccagaaacggcaagagcagcgtgaccaagggcggcccccagatcgcctacgagagaggcttcagatggaagctggcccacttcagatacctgtgccagagcaacgccctgcccagccacgtgaagatcaacgtgagcagacagaccctgttcgaggacagcttccagcagatcatggccctgaagccctacgacctgagaagaagactgtacgtgatcttcagaggcgaggagggcctggactacggcggcctggccagagagtggttcttcctgctgagccacgaggtgctgaaccccatgtactgcctgttcgagtacgccggcaagaacaactactgcctgcagatcaaccccgccagcaccatcaaccccgaccacctgagctacttctgcttcatcggcagattcatcgccatggccctgttccacggcaagttcatcgacaccggcttcagcctgcccttctacaagagaatgctgagcaagaagctgaccatcaaggacctggagagcatcgacaccgagttctacaacagcctgatctggatcagagacaacaacatcgaggagtgcggcctggagatgtacttcagcgtggacatggagatcctgggcaaggtgaccagccacgacctgaagctgggcggcagcaacatcctggtgaccgaggagaacaaggacgagtacatcggcctgatgaccgagtggagattcagcagaggcgtgcaggagcagaccaaggccttcctggacggcttcaacgaggtggtgcccctgcagtggctgcagtacttcgacgagaaggagctggaggtgatgctgtgcggcatgcaggaggtggacctggccgactggcagagaaacaccgtgtacagacactacaccagaaacagcaagcagatcatctggttctggcagttcgtgaaggagaccgacaacgaggtgagaatgagactgctgcagttcgtgaccggcacctgcagactgcccctgggcggcttcgccgagctgatgggcagcaacggcccccagaagttctgcatcgagaaggtgggcaaggacacctggctgcccagaagccacacctgcttcaacagactggacctgcccccctacaagagctacgagcagctgaaggagaagctgctgttcgccatcgaggagaccgagggcttcggccaggagtag

SEQ ID NO: 105378 - DNA, 336 bp, Artificial Sequence
  Description of Artificial Sequence: Synthetic coding sequence
atggccaccgccagccccagaagcgacaccagcaacaaccacagcggcagactgcagctgcaggtgaccgtgagcagcgccaagctgaagagaaagaagaactggttcggcaccgccatctacaccgaggtggtggtggacggcgagatcaccaagaccgccaagagcagcagcagcagcaaccccaagtgggacgagcagctgaccgtgaacgtgaccccccagaccaccctggagttccaggtgtggagccacagaaccctgaaggccgacgccctgctgggcaaggccaccatcgacctgaagcaggccctgctgatccacaacagaaagtag

SEQ ID NO: 105379 - DNA, 2769 bp, Artificial Sequence; identical to SEQ ID NO: 105375
  Description of Artificial Sequence: Synthetic coding sequence

SEQ ID NO: 105380 - DNA, 2613 bp, Artificial Sequence
  Description of Artificial Sequence: Synthetic coding sequence
atggccagcgccagcagcagcagagccggcgtggccctgcccttcgagaagagccagctgaccctgaaggtggtgagcgccaagcccaaggtgcacaacagacagcccagaatcaacagctacgtggaggtggccgtggacggcctgcccagcgagaccaagaagaccggcaagagaatcggcagcagcgagctgctgtggaacgagatcatcatcctgaacgtgaccgcccagagccacctggacctgaaggtgtggagctgccacaccctgagaaacgagctgctgggcaccgccagcgtgaacctgagcaacgtgctgaagaacaacggcggcaagatggagaacatgcagctgaccctgaacctgcagaccgagaacaagggcagcgtggtgagcggcggcgagctgaccatcttcctggacggccccaccgtggacctgggcaacgtgcccaacggcagcgccctgaccgacggcagccagctgcccagcagagacagcagcggcaccgccgtggcccccgagaacagacaccagccccccagcaccaactgcttcggcggcagaagcagaacccacagacacagcggcgccagcgccagaaccacccccgccaccggcgagcagagccccggcgccagaagcagacacagacagcccgtgaagaacagcggccacagcggcctggccaacggcaccgtgaacgacgagcccaccaccgccaccgaccccgaggagcccagcgtggtgggcgtgaccagcccccccgccgcccccctgagcgtgacccccaaccccaacaccaccagcctgcccgcccccgccacccccgccgagggcgaggagcccagcaccagcggcacccagcagctgcccgccgccgcccaggcccccgacgccctgcccgccggctgggagcagagagagctgcccaacggcagagtgtactacgtggaccacaacaccaagaccaccacctgggagagacccctgccccccggctgggagaagagaaccgaccccagaggcagattctactacgtggaccacaacaccagaaccaccacctggcagagacccaccgccgagtacgtgagaaactacgagcagtggcagagccagagaaaccagctgcagggcgccatgcagcacttcagccagagattcctgtaccagagcagcagcgccagcaccgaccacgaccccctgggccccctgccccccggctgggagaagagacaggacaacggcagagtgtactacgtgaaccacaacaccagaaccacccagtgggaggaccccagaacccagggcatgatccaggagcccgccctgccccccggctgggagatgaagtacaccagcgagggcgtgagatacttcgtggaccacaacaccagaaccaccaccttcaaggaccccagacccggcttcgagagcggcaccaagcagggcagccccggcgcctacgacagaagcttcagatggaagtaccaccagttcagattcctgtgccacagcaacgccctgcccagccacgtgaagatcagcgtgagcagacagaccctgttcgaggacagcttccagcagatcatgaacatgaagccctacgacctgagaagaagactgtacatcatcatgagaggcgaggagggcctggactacggcggcatcgccagagagtggttcttcctgctgagccacgaggtgctgaaccccatgtactgcctgttcgagtacgccggcaagaacaactactgcctgcagatcaaccccgccagcagcatcaaccccgaccacctgacctacttcagattcatcggcagattcatcgccatggccctgtaccacggcaagttcatcgacaccggcttcaccctgcccttctacaagagaatgctgaacaagagacccaccctgaaggacctggagagcatcgaccccgagttctacaacagcatcgtgtggatcaaggagaacaacctggaggagtgcggcctggagctgtacttcatccaggacatggagatcctgggcaaggtgaccacccacgagctgaaggagggcggcgagagcatcagagtgaccgaggagaacaaggaggagtacatcatgctgctgaccgactggagattcaccagaggcgtggaggagcagaccaaggccttcctggacggcttcaacgaggtggcccccctggagtggctgagatacttcgacgagaaggagctggagctgatgctgtgcggcatgcaggagatcgacatgagcgactggcagaagagcaccatctacagacactacaccaagaacagcaagcagatccagtggttctggcaggtggtgaaggagatggacaacgagaagagaatcagactgctgcagttcgtgaccggcacctgcagactgcccgtgggcggcttcgccgagctgatcggcagcaacggcccccagaagttctgcatcgacaaggtgggcaaggagacctggctgcccagaagccacacctgcttcaacagactggacctgcccccctacaagagctacgagcagctgagagagaagctgctgtacgccatcgaggagaccgagggcttcggccaggagtag

SEQ ID NO: 105381 - DNA, 2613 bp, Artificial Sequence; identical to SEQ ID NO: 105380
  Description of Artificial Sequence: Synthetic coding sequence

SEQ ID NO: 105382 - DNA, 2613 bp, Artificial Sequence; identical to SEQ ID NO: 105380
  Description of Artificial Sequence: Synthetic coding sequence

SEQ ID NO: 105383 - DNA, 2265 bp, Artificial Sequence
  Description of Artificial Sequence: Synthetic coding sequence
atgcagctgaccctgaacctgcagaccgagaacaagggcagcgtggtgagcggcggcgagctgaccatcttcctggacggccccaccgtggacctgggcaacgtgcccaacggcagcgccctgaccgacggcagccagctgcccagcagagacagcagcggcaccgccgtggcccccgagaacagacaccagccccccagcaccaactgcttcggcggcagaagcagaacccacagacacagcggcgccagcgccagaaccacccccgccaccggcgagcagagccccggcgccagaagcagacacagacagcccgtgaagaacagcggccacagcggcctggccaacggcaccgtgaacgacgagcccaccaccgccaccgaccccgaggagcccagcgtggtgggcgtgaccagcccccccgccgcccccctgagcgtgacccccaaccccaacaccaccagcctgcccgcccccgccacccccgccgagggcgaggagcccagcaccagcggcacccagcagctgcccgccgccgcccaggcccccgacgccctgcccgccggctgggagcagagagagctgcccaacggcagagtgtactacgtggaccacaacaccaagaccaccacctgggagagacccctgccccccggctgggagaagagaaccgaccccagaggcagattctactacgtggaccacaacaccagaaccaccacctggcagagacccaccgccgagtacgtgagaaactacgagcagtggcagagccagagaaaccagctgcagggcgccatgcagcacttcagccagagattcctgtaccagagcagcagcgccagcaccgaccacgaccccctgggccccctgccccccggctgggagaagagacaggacaacggcagagtgtactacgtgaaccacaacaccagaaccacccagtgggaggaccccagaacccagggcatgatccaggagcccgccctgccccccggctgggagatgaagtacaccagcgagggcgtgagatacttcgtggaccacaacaccagaaccaccaccttcaaggaccccagacccggcttcgagagcggcaccaagcagggcagccccggcgcctacgacagaagcttcagatggaagtaccaccagttcagattcctgtgccacagcaacgccctgcccagccacgtgaagatcagcgtgagcagacagaccctgttcgaggacagcttccagcagatcatgaacatgaagccctacgacctgagaagaagactgtacatcatcatgagaggcgaggagggcctggactacggcggcatcgccagagagtggttcttcctgctgagccacgaggtgctgaaccccatgtactgcctgttcgagtacgccggcaagaacaactactgcctgcagatcaaccccgccagcagcatcaaccccgaccacctgacctacttcagattcatcggcagattcatcgccatggccctgtaccacggcaagttcatcgacaccggcttcaccctgcccttctacaagagaatgctgaacaagagacccaccctgaaggacctggagagcatcgaccccgagttctacaacagcatcgtgtggatcaaggagaacaacctggaggagtgcggcctggagctgtacttcatccaggacatggagatcctgggcaaggtgaccacccacgagctgaaggagggcggcgagagcatcagagtgaccgaggagaacaaggaggagtacatcatgctgctgaccgactggagattcaccagaggcgtggaggagcagaccaaggccttcctggacggcttcaacgaggtggcccccctggagtggctgagatacttcgacgagaaggagctggagctgatgctgtgcggcatgcaggagatcgacatgagcgactggcagaagagcaccatctacagacactacaccaagaacagcaagcagatccagtggttctggcaggtggtgaaggagatggacaacgagaagagaatcagactgctgcagttcgtgaccggcacctgcagactgcccgtgggcggcttcgccgagctgatcggcagcaacggcccccagaagttctgcatcgacaaggtgggcaaggagacctggctgcccagaagccacacctgcttcaacagactggacctgcccccctacaagagctacgagcagctgagagagaagctgctgtacgccatcgaggagaccgagggcttcggccaggagtag

SEQ ID NO: 105384 - DNA, 2274 bp, Artificial Sequence
  Description of Artificial Sequence: Synthetic coding sequence
atggagaacatgcagctgaccctgaacctgcagaccgagaacaagggcagcgtggtgagcggcggcgagctgaccatcttcctggacggccccaccgtggacctgggcaacgtgcccaacggcagcgccctgaccgacggcagccagctgcccagcagagacagcagcggcaccgccgtggcccccgagaacagacaccagccccccagcaccaactgcttcggcggcagaagcagaacccacagacacagcggcgccagcgccagaaccacccccgccaccggcgagcagagccccggcgccagaagcagacacagacagcccgtgaagaacagcggccacagcggcctggccaacggcaccgtgaacgacgagcccaccaccgccaccgaccccgaggagcccagcgtggtgggcgtgaccagcccccccgccgcccccctgagcgtgacccccaaccccaacaccaccagcctgcccgcccccgccacccccgccgagggcgaggagcccagcaccagcggcacccagcagctgcccgccgccgcccaggcccccgacgccctgcccgccggctgggagcagagagagctgcccaacggcagagtgtactacgtggaccacaacaccaagaccaccacctgggagagacccctgccccccggctgggagaagagaaccgaccccagaggcagattctactacgtggaccacaacaccagaaccaccacctggcagagacccaccgccgagtacgtgagaaactacgagcagtggcagagccagagaaaccagctgcagggcgccatgcagcacttcagccagagattcctgtaccagagcagcagcgccagcaccgaccacgaccccctgggccccctgccccccggctgggagaagagacaggacaacggcagagtgtactacgtgaaccacaacaccagaaccacccagtgggaggaccccagaacccagggcatgatccaggagcccgccctgccccccggctgggagatgaagtacaccagcgagggcgtgagatacttcgtggaccacaacaccagaaccaccaccttcaaggaccccagacccggcttcgagagcggcaccaagcagggcagccccggcgcctacgacagaagcttcagatggaagtaccaccagttcagattcctgtgccacagcaacgccctgcccagccacgtgaagatcagcgtgagcagacagaccctgttcgaggacagcttccagcagatcatgaacatgaagccctacgacctgagaagaagactgtacatcatcatgagaggcgaggagggcctggactacggcggcatcgccagagagtggttcttcctgctgagccacgaggtgctgaaccccatgtactgcctgttcgagtacgccggcaagaacaactactgcctgcagatcaaccccgccagcagcatcaaccccgaccacctgacctacttcagattcatcggcagattcatcgccatggccctgtaccacggcaagttcatcgacaccggcttcaccctgcccttctacaagagaatgctgaacaagagacccaccctgaaggacctggagagcatcgaccccgagttctacaacagcatcgtgtggatcaaggagaacaacctggaggagtgcggcctggagctgtacttcatccaggacatggagatcctgggcaaggtgaccacccacgagctgaaggagggcggcgagagcatcagagtgaccgaggagaacaaggaggagtacatcatgctgctgaccgactggagattcaccagaggcgtggaggagcagaccaaggccttcctggacggcttcaacgaggtggcccccctggagtggctgagatacttcgacgagaaggagctggagctgatgctgtgcggcatgcaggagatcgacatgagcgactggcagaagagcaccatctacagacactacaccaagaacagcaagcagatccagtggttctggcaggtggtgaaggagatggacaacgagaagagaatcagactgctgcagttcgtgaccggcacctgcagactgcccgtgggcggcttcgccgagctgatcggcagcaacggcccccagaagttctgcatcgacaaggtgggcaaggagacctggctgcccagaagccacacctgcttcaacagactggacctgcccccctacaagagctacgagcagctgagagagaagctgctgtacgccatcgaggagaccgagggcttcggccaggagtag

SEQ ID NO: 105385 - DNA, 1029 bp, Artificial Sequence
  Description of Artificial Sequence: Synthetic coding sequence
atgatccaggagcccgccctgccccccggctgggagatgaagtacaccagcgagggcgtgagatacttcgtggaccacaacaccagaaccaccaccttcaaggaccccagacccggcttcgagagcggcaccaagcagggcagccccggcgcctacgacagaagcttcagatggaagtaccaccagttcagattcctgtgccacagcaacgccctgcccagccacgtgaagatcagcgtgagcagacagaccctgttcgaggacagcttccagcagatcatgaacatgaagccctacgacctgagaagaagactgtacatcatcatgagaggcgaggagggcctggactacggcggcatcgccagagagtggttcttcctgctgagccacgaggtgctgaaccccatgtactgcctgttcgagtacgccggcaagaacaactactgcctgcagatcaaccccgccagcagcatcaaccccgaccacctgacctacttcagattcatcggcagattcatcgccatggccctgtaccacggcaagttcatcgacaccggcttcaccctgcccttctacaagagaatgctgaacaagagacccaccctgaaggacctggagagcatcgaccccgagttctacaacagcatcgtgtggatcaaggagaacaacctggaggagtgcggcctggagctgtacttcatccaggacatggagatcctgggcaaggtgaccacccacgagctgaaggagggcggcgagagcatcagagtgaccgaggagaacaaggaggagtacatcatgctgctgaccgactggagattcaccagaggcgtggaggagcagaccaaggccttcctggacggcttcaacgaggtggcccccctggagtggctgagatacttcgacgagaaggagctggagctgatgctgtgcggcatgcaggagatcgacgccaccggcagaagagcccccagcaccggcaccacccccagaaccgccagcagaagcagcggcagcggcagatggtag

SEQ ID NO: 105386 - DNA, 1296 bp, Artificial Sequence
  Description of Artificial Sequence: Synthetic coding sequence
atgatccaggagcccgccctgccccccggctgggagatgaagtacaccagcgagggcgtgagatacttcgtggaccacaacaccagaaccaccaccttcaaggaccccagacccggcttcgagagcggcaccaagcagggcagccccggcgcctacgacagaagcttcagatggaagtaccaccagttcagattcctgtgccacagcaacgccctgcccagccacgtgaagatcagcgtgagcagacagaccctgttcgaggacagcttccagcagatcatgaacatgaagccctacgacctgagaagaagactgtacatcatcatgagaggcgaggagggcctggactacggcggcatcgccagagagtggttcttcctgctgagccacgaggtgctgaaccccatgtactgcctgttcgagtacgccggcaagaacaactactgcctgcagatcaaccccgccagcagcatcaaccccgaccacctgacctacttcagattcatcggcagattcatcgccatggccctgtaccacggcaagttcatcgacaccggcttcaccctgcccttctacaagagaatgctgaacaagagacccaccctgaaggacctggagagcatcgaccccgagttctacaacagcatcgtgtggatcaaggagaacaacctggaggagtgcggcctggagctgtacttcatccaggacatggagatcctgggcaaggtgaccacccacgagctgaaggagggcggcgagagcatcagagtgaccgaggagaacaaggaggagtacatcatgctgctgaccgactggagattcaccagaggcgtggaggagcagaccaaggccttcctggacggcttcaacgaggtggcccccctggagtggctgagatacttcgacgagaaggagctggagctgatgctgtgcggcatgcaggagatcgacatgagcgactggcagaagagcaccatctacagacactacaccaagaacagcaagcagatccagtggttctggcaggtggtgaaggagatggacaacgagaagagaatcagactgctgcagttcgtgaccggcacctgcagactgcccgtgggcggcttcgccgagctgatcggcagcaacggcccccagaagttctgcatcgacaaggtgggcaaggagacctggctgcccagaagccacacctgcttcaacagactggacctgcccccctacaagagctacgagcagctgagagagaagctgctgtacgccatcgaggagaccgagggcttcggccaggagtag

SEQ ID NO: 105387 - DNA, 1008 bp, Artificial Sequence
  Description of Artificial Sequence: Synthetic coding sequence
atggccagcgccagcagcagcagagccggcgtggccctgcccttcgagaagagccagctgaccctgaaggtggtgagcgccaagcccaaggtgcacaacagacagcccagaatcaacagctacgtggaggtggccgtggacggcctgcccagcgagaccaagaagaccggcaagagaatcggcagcagcgagctgctgtggaacgagatcatcatcctgaacgtgaccgcccagagccacctggacctgaaggtgtggagctgccacaccctgagaaacgagctgctgggcaccgccagcgtgaacctgagcaacgtgctgaagaacaacggcggcaagatggagaacatgcagctgaccctgaacctgcagaccgagaacaagggcagcgtggtgagcggcggcgagctgaccatcttcctggacggccccaccgtggacctgggcaacgtgcccaacggcagcgccctgaccgacggcagccagctgcccagcagagacagcagcggcaccgccgtggcccccgagaacagacaccagccccccagcaccaactgcttcggcggcagaagcagaacccacagacacagcggcgccagcgccagaaccacccccgccaccggcgagcagagccccggcgccagaagcagacacagacagcccgtgaagaacagcggccacagcggcctggccaacggcaccgtgaacgacgagcccaccaccgccaccgaccccgaggagcccagcgtggtgggcgtgaccagcccccccgccgcccccctgagcgtgacccccaaccccaacaccaccagcctgcccgcccccgccacccccgccgagggcgaggagcccagcaccagcggcacccagcagctgcccgccgccgcccaggcccccgacgccctgcccgccggctgggagcagagagagctgcccaacggcagagtgtactacgtggaccacaacaccaagaccaccacctgggagagacccctgccccccggctag

SEQ ID NO: 105388 - DNA, 210 bp, Artificial Sequence
  Description of Artificial Sequence: Synthetic coding sequence
atggagagccccaagaagaagaaccagcagctgaaggtgggcatcctgcacctgggcagcagacagaagaagatcagaatccagctgagaagccaggtgctgggcagagagatgagagacatggagggcgacctgcaggagctgcaccagagcaacaccggcgacaagagcggcttcggcttcagaagacagggcgaggacaacacctag

SEQ ID NO: 105389 - DNA, 246 bp, Artificial Sequence
  Description of Artificial Sequence: Synthetic coding sequence
atggagagccccaagaagaagaaccagcagctgaaggtgggcatcctgcacctgggcagcagacagaagaagatcagaatccagctgagaagccagtgcgccacctggaaggtgatctgcaagagctgcatcagccagacccccggcatcaacctggacctgggcagcggcgtgaaggtgaagatcatccccaaggaggagcactgcaagatgcccgaggccggcgaggagcagccccaggtgtag

SEQ ID NO: 105390 - DNA, 441 bp, Artificial Sequence
  Description of Artificial Sequence: Synthetic coding sequence
atgctgctgtggtgccccccccagtgcgcctgcagcctgggcgtgttccccagcgcccccagccccgtgtggggcaccagaagaagctgcgagcccgccaccagagtgcccgaggtgtggatcctgagccccctgctgagacacggcggccacacccagacccagaaccacaccgccagccccagaagccccgtgatggagagccccaagaagaagaaccagcagctgaaggtgggcatcctgcacctgggcagcagacagaagaagatcagaatccagctgagaagccagtgcgccacctggaaggtgatctgcaagagctgcatcagccagacccccggcatcaacctggacctgggcagcggcgtgaaggtgaagatcatccccaaggaggagcactgcaagatgcccgaggccggcgaggagcagccccaggtgtag

SEQ ID NO: 105391 - DNA, 210 bp, Artificial Sequence; identical to SEQ ID NO: 105388
  Description of Artificial Sequence: Synthetic coding sequence

SEQ ID NO: 105392 - DNA, 210 bp, Artificial Sequence; identical to SEQ ID NO: 105388
  Description of Artificial Sequence: Synthetic coding sequence

SEQ ID NO: 105393 - DNA, 246 bp, Artificial Sequence; identical to SEQ ID NO: 105389
  Description of Artificial Sequence: Synthetic coding sequence

SEQ ID NO: 105394 - DNA, 210 bp, Artificial Sequence; identical to SEQ ID NO: 105388
  Description of Artificial Sequence: Synthetic coding sequence

SEQ ID NO: 105395 - DNA, 441 bp, Artificial Sequence; identical to SEQ ID NO: 105390
  Description of Artificial Sequence: Synthetic coding sequence

SEQ ID NO: 105396 - DNA, 246 bp, Artificial Sequence; identical to SEQ ID NO: 105389
  Description of Artificial Sequence: Synthetic coding sequence

SEQ ID NO: 105397 - DNA, 210 bp, Artificial Sequence; identical to SEQ ID NO: 105388
  Description of Artificial Sequence: Synthetic coding sequence

SEQ ID NO: 105398 - DNA, 246 bp, Artificial Sequence; identical to SEQ ID NO: 105389
  Description of Artificial Sequence: Synthetic coding sequence

SEQ ID NO: 105399 - DNA, 441 bp, Artificial Sequence; identical to SEQ ID NO: 105390
  Description of Artificial Sequence: Synthetic coding sequence

SEQ ID NO: 105400 - DNA, 210 bp, Artificial Sequence; identical to SEQ ID NO: 105388
  Description of Artificial Sequence: Synthetic coding sequence

SEQ ID NO: 105401 - DNA, 210 bp, Artificial Sequence; identical to SEQ ID NO: 105388
  Description of Artificial Sequence: Synthetic coding sequence

SEQ ID NO: 105402 - DNA, 246 bp, Artificial Sequence; identical to SEQ ID NO: 105389
  Description of Artificial Sequence: Synthetic coding sequence

SEQ ID NO: 105403 - DNA, 441 bp, Artificial Sequence; identical to SEQ ID NO: 105390
  Description of Artificial Sequence: Synthetic coding sequence

SEQ ID NO: 105404 - DNA, 336 bp, Artificial Sequence
  Description of Artificial Sequence: Synthetic coding sequence
atgatctggagaggcagaagcacctacagacccagacccagaagaagcgtgcccccccccgagctgatcggccccatgctggagcccggcgacgaggagccccagcaggaggagccccccaccgagagcagagaccccgcccccggccaggagagagaggaggaccagggcgccgccgagacccaggtgcccgacctggaggccgacctgcaggagctgagccagagcaagaccggcggcgagtgcggcaacggccccgacgaccagggcaagatcctgcccaagagcgagcagttcaagatgcccgagggcggcgacagacagccccaggtgtag

SEQ ID NO: 105405 - DNA, 336 bp, Artificial Sequence; identical to SEQ ID NO: 105404
  Description of Artificial Sequence: Synthetic coding sequence

SEQ ID NO: 105406 - DNA, 4002 bp, Artificial Sequence
  Description of Artificial Sequence: Synthetic coding sequence
atgaccgccgacaagctggtgttcttcgtgaacggcagaaaggtggtggagaagaacgccgaccccgagaccaccctgctggcctacctgagaagaaagctgggcctgagcggcaccaagctgggctgcggcgagggcggctgcggcgcctgcaccgtgatgctgagcaagtacgacagactgcagaacaagatcgtgcacttcagcgccaacgcctgcctggcccccatctgcagcctgcaccacgtggccgtgaccaccgtggagggcatcggcagcaccaagaccagactgcaccccgtgcaggagagaatcgccaagagccacggcagccagtgcggcttctgcacccccggcatcgtgatgagcatgtacaccctgctgagaaaccagcccgagcccaccatggaggagatcgagaacgccttccagggcaacctgtgcagatgcaccggctacagacccatcctgcagggcttcagaaccttcgccagagacggcggctgctgcggcggcgacggcaacaaccccaactgctgcatgaaccagaagaaggaccacagcgtgagcctgagccccagcctgttcaagcccgaggagttcacccccctggaccccacccaggagcccatcttcccccccgagctgctgagactgaaggacacccccagaaagcagctgagattcgagggcgagagagtgacctggatccaggccagcaccctgaaggagctgctggacctgaaggcccagcaccccgacgccaagctggtggtgggcaacaccgagatcggcatcgagatgaagttcaagaacatgctgttccccatgatcgtgtgccccgcctggatccccgagctgaacagcgtggagcacggccccgacggcatcagcttcggcgccgcctgccccctgagcatcgtggagaagaccctggtggacgccgtggccaagctgcccgcccagaagaccgaggtgttcagaggcgtgctggagcagctgagatggttcgccggcaagcaggtgaagagcgtggccagcgtgggcggcaacatcatcaccgccagccccatcagcgacctgaaccccgtgttcatggccagcggcgccaagctgaccctggtgagcagaggcaccagaagaaccgtgcagatggaccacaccttcttccccggctacagaaagaccctgctgagccccgaggagatcctgctgagcatcgagatcccctacagcagagagggcgagtacttcagcgccttcaagcaggccagcagaagagaggacgacatcgccaaggtgaccagcggcatgagagtgctgttcaagcccggcaccaccgaggtgcaggagctggccctgtgctacggcggcatggccaacagaaccatcagcgccctgaagaccacccagagacagctgagcaagctgtggaaggaggagctgctgcaggacgtgtgcgccggcctggccgaggagctgcacctgccccccgacgcccccggcggcatggtggacttcagatgcaccctgaccctgagcttcttcttcaagttctacctgaccgtgctgcagaagctgggccaggagaacctggaggacaagtgcggcaagctggaccccaccttcgccagcgccaccctgctgttccagaaggacccccccgccgacgtgcagctgttccaggaggtgcccaagggccagagcgaggaggacatggtgggcagacccctgccccacctggccgccgacatgcaggccagcggcgaggccgtgtactgcgacgacatccccagatacgagaacgagctgagcctgagactggtgaccagcaccagagcccacgccaagatcaagagcatcgacaccagcgaggccaagaaggtgcccggcttcgtgtgcttcatcagcgccgacgacgtgcccggcagcaacatcaccggcatctgcaacgacgagaccgtgttcgccaaggacaaggtgacctgcgtgggccacatcatcggcgccgtggtggccgacacccccgagcacacccagagagccgcccagggcgtgaagatcacctacgaggagctgcccgccatcatcaccatcgaggacgccatcaagaacaacagcttctacggccccgagctgaagatcgagaagggcgacctgaagaagggcttcagcgaggccgacaacgtggtgagcggcgagatctacatcggcggccaggagcacttctacctggagacccactgcaccatcgccgtgcccaagggcgaggccggcgagatggagctgttcgtgagcacccagaacaccatgaagacccagagcttcgtggccaagatgctgggcgtgcccgccaacagaatcgtggtgagagtgaagagaatgggcggcggcttcggcggcaaggagaccagaagcaccgtggtgagcaccgccgtggccctggccgcctacaagaccggcagacccgtgagatgcatgctggacagagacgaggacatgctgatcaccggcggcagacaccccttcctggccagatacaaggtgggcttcatgaagaccggcaccgtggtggccctggaggtggaccacttcagcaacgtgggcaacacccaggacctgagccagagcatcatggagagagccctgttccacatggacaactgctacaagatccccaacatcagaggcaccggcagactgtgcaagaccaacctgcccagcaacaccgccttcagaggcttcggcggcccccagggcatgctgatcgccgagtgctggatgagcgaggtggccgtgacctgcggcatgcccgccgaggaggtgagaagaaagaacctgtacaaggagggcgacctgacccacttcaaccagaagctggagggcttcaccctgcccagatgctgggaggagtgcctggccagcagccagtaccacgccagaaagagcgaggtggacaagttcaacaaggagaactgctggaagaagagaggcctgtgcatcatccccaccaagttcggcatcagcttcaccgtgcccttcctgaaccaggccggcgccctgctgcacgtgtacaccgacggcagcgtgctgctgacccacggcggcaccgagatgggccagggcctgcacaccaagatggtgcaggtggccagcagagccctgaagatccccaccagcaagatctacatcagcgagaccagcaccaacaccgtgcccaacaccagccccaccgccgccagcgtgagcgccgacctgaacggccaggccgtgtacgccgcctgccagaccatcctgaagagactggagccctacaagaagaagaaccccagcggcagctgggaggactgggtgaccgccgcctacatggacaccgtgagcctgagcgccaccggcttctacagaacccccaacctgggctacagcttcgagaccaacagcggcaaccccttccactacttcagctacggcgtggcctgcagcgaggtggagatcgactgcctgaccggcgaccacaagaacctgagaaccgacatcgtgatggacgtgggcagcagcctgaaccccgccatcgacatcggccaggtggagggcgccttcgtgcagggcctgggcctgttcaccctggaggagctgcactacagccccgagggcagcctgcacaccagaggccccagcacctacaagatccccgccttcggcagcatccccatcgagttcagagtgagcctgctgagagactgccccaacaagaaggccatctacgccagcaaggccgtgggcgagccccccctgttcctggccgccagcatcttcttcgccatcaaggacgccatcagagccgccagagcccagcacaccggcaacaacgtgaaggagctgttcagactggacagccccgccacccccgagaagatcagaaacgcctgcgtggacaagttcaccaccctgtgcgtgaccggcgtgcccgagaactgcaagccctggagcgtgagagtgtag

SEQ ID NO: 105407 - DNA, 1896 bp, Artificial Sequence
  Description of Artificial Sequence: Synthetic coding sequence
atgaagttcgccgagcacctgagcgcccacatcacccccgagtggagaaagcagtacatccagtacgaggccttcaaggacatgctgtacagcgcccaggaccaggcccccagcgtggaggtgaccgacgaggacaccgtgaagagatacttcgccaagttcgaggagaagttcttccagacctgcgagaaggagctggccaagatcaacaccttctacagcgagaagctggccgaggcccagagaagattcgccaccctgcagaacgagctgcagagcagcctggacgcccagaaggagagcaccggcgtgaccaccctgagacagagaagaaagcccgtgttccacctgagccacgaggagagagtgcagcacagaaacatcaaggacctgaagctggccttcagcgagttctacctgagcctgatcctgctgcagaactaccagaacctgaacttcaccggcttcagaaagatcctgaagaagcacgacaagatcctggagaccagcagaggcgccgactggagagtggcccacgtggaggtggcccccttctacacctgcaagaagatcaaccagctgatcagcgagaccgaggccgtggtgaccaacgagctggaggacggcgacagacagaaggccatgaagagactgagagtgccccccctgggcgccgcccagcccgcccccgcctggaccaccttcagagtgggcctgttctgcggcatcttcatcgtgctgaacatcaccctggtgctggccgccgtgttcaagctggagaccgacagaagcatctggcccctgatcagaatctacagaggcggcttcctgctgatcgagttcctgttcctgctgggcatcaacacctacggctggagacaggccggcgtgaaccacgtgctgatcttcgagctgaaccccagaagcaacctgagccaccagcacctgttcgagatcgccggcttcctgggcatcctgtggtgcctgagcctgctggcctgcttcttcgcccccatcagcgtgatccccacctacgtgtaccccctggccctgtacggcttcatggtgttcttcctgatcaaccccaccaagaccttctactacaagagcagattctggctgctgaagctgctgttcagagtgttcaccgcccccttccacaaggtgggcttcgccgacttctggctggccgaccagctgaacagcctgagcgtgatcctgatggacctggagtacatgatctgcttctacagcctggagctgaagtgggacgagagcaagggcctgctgcccaacaacagcgaggagagaggccacagcgacaccatggtgttcttctacctgtggatcgtgttctacatcatcagcagctgctacaccctgatctgggacctgaagatggactggggcctgttcgacaagaacgccggcgagaacaccttcctgagagaggagatcgtgtacccccagaaggcctactactactgcgccatcatcgaggacgtgatcctgagattcgcctggaccatccagatcagcatcaccagcaccaccctgctgccccacagcggcgacatcatcgccaccgtgttcgcccccctggaggtgttcagaagattcgtgtggaacttcttcagactggagaacgagcacctgaacaactgcggcgagttcagagccgtgagagacatcagcgtggcccccctgaacgccgacgaccagaccctgctggagcagatgatggaccaggacgacggcgtgagaaacagacagaagaacagaagctggaagtacaaccagagcatcagcctgagaagacccagactggccagccagagcaaggccagagacaccaaggtgctgatcgaggacaccgacgacgaggccaacacctag

SEQ ID NO: 105408 - DNA, 2091 bp, Artificial Sequence
  Description of Artificial Sequence: Synthetic coding sequence
atgaagttcgccgagcacctgagcgcccacatcacccccgagtggagaaagcagtacatccagtacgaggccttcaaggacatgctgtacagcgcccaggaccaggcccccagcgtggaggtgaccgacgaggacaccgtgaagagatacttcgccaagttcgaggagaagttcttccagacctgcgagaaggagctggccaagatcaacaccttctacagcgagaagctggccgaggcccagagaagattcgccaccctgcagaacgagctgcagagcagcctggacgcccagaaggagagcaccggcgtgaccaccctgagacagagaagaaagcccgtgttccacctgagccacgaggagagagtgcagcacagaaacatcaaggacctgaagctggccttcagcgagttctacctgagcctgatcctgctgcagaactaccagaacctgaacttcaccggcttcagaaagatcctgaagaagcacgacaagatcctggagaccagcagaggcgccgactggagagtggcccacgtggaggtggcccccttctacacctgcaagaagatcaaccagctgatcagcgagaccgaggccgtggtgaccaacgagctggaggacggcgacagacagaaggccatgaagagactgagagtgccccccctgggcgccgcccagcccgcccccgcctggaccaccttcagagtgggcctgttctgcggcatcttcatcgtgctgaacatcaccctggtgctggccgccgtgttcaagctggagaccgacagaagcatctggcccctgatcagaatctacagaggcggcttcctgctgatcgagttcctgttcctgctgggcatcaacacctacggctggagacaggccggcgtgaaccacgtgctgatcttcgagctgaaccccagaagcaacctgagccaccagcacctgttcgagatcgccggcttcctgggcatcctgtggtgcctgagcctgctggcctgcttcttcgcccccatcagcgtgatccccacctacgtgtaccccctggccctgtacggcttcatggtgttcttcctgatcaaccccaccaagaccttctactacaagagcagattctggctgctgaagctgctgttcagagtgttcaccgcccccttccacaaggtgggcttcgccgacttctggctggccgaccagctgaacagcctgagcgtgatcctgatggacctggagtacatgatctgcttctacagcctggagctgaagtgggacgagagcaagggcctgctgcccaacaacagcgaggagagcggcatctgccacaagtacacctacggcgtgagagccatcgtgcagtgcatccccgcctggctgagattcatccagtgcctgagaagatacagagacaccaagagagccttcccccacctggtgaacgccggcaagtacagcaccaccttcttcatggtgaccttcgccgccctgtacagcacccacaaggagagaggccacagcgacaccatggtgttcttctacctgtggatcgtgttctacatcatcagcagctgctacaccctgatctgggacctgaagatggactggggcctgttcgacaagaacgccggcgagaacaccttcctgagagaggagatcgtgtacccccagaaggcctactactactgcgccatcatcgaggacgtgatcctgagattcgcctggaccatccagatcagcatcaccagcaccaccctgctgccccacagcggcgacatcatcgccaccgtgttcgcccccctggaggtgttcagaagattcgtgtggaacttcttcagactggagaacgagcacctgaacaactgcggcgagttcagagccgtgagagacatcagcgtggcccccctgaacgccgacgaccagaccctgctggagcagatgatggaccaggacgacggcgtgagaaacagacagaagaacagaagctggaagtacaaccagagcatcagcctgagaagacccagactggccagccagagcaaggccagagacaccaaggtgctgatcgaggacaccgacgacgaggccaacacctag

SEQ ID NO: 105409 - DNA, 543 bp, Artificial Sequence
  Description of Artificial Sequence: Synthetic coding sequence
atggagagctggtggggcctgccctgcctggccttcctgtgcttcctgatgcacgccagaggccagagagacttcgacctggccgacgccctggacgaccccgagcccaccaagaagcccaacagcgacatctaccccaagcccaagcccccctactacccccagcccgagaaccccgacagcggcggcaacatctaccccagacccaagcccagaccccagccccagcccggcaacagcggcaacagcggcggctacttcaacgacgtggacagagacgacggcagatacccccccagacccagacccagaccccccgccggcggcggcggcggcggctacagcagctacggcaacagcgacaacacccacggcggcgaccaccacagcacctacggcaaccccgagggcaacatggtggccaagatcgtgagccccatcgtgagcgtggtggtggtgaccctgctgggcgccgccgccagctacttcaagctgaacaacagaagaaactgcttcagaacccacgagcccgagaacgtgtag

SEQ ID NO: 105410 - DNA, 588 bp, Artificial Sequence
  Description of Artificial Sequence: Synthetic coding sequence
atggagagctggtggggcctgccctgcctggccttcctgtgcttcctgatgcacgccagaggccagagagacttcgacctggccgacgccctggacgaccccgagcccaccaagaagcccaacagcgacatctaccccaagcccaagcccccctactacccccagcccgagaaccccgacagcggcggcaacatctaccccagacccaagcccagaccccagccccagcccggcaacagcggcaacagcggcggctacttcaacgacgtggacagagacgacggcagatacccccccagacccagacccagaccccccgccggcggcggcggcggcggctacagcagctacggcaacagcgacaacacccacggcagaggcggctacagactgaacagcagatacggcaacacctacggcggcgaccaccacagcacctacggcaaccccgagggcaacatggtggccaagatcgtgagccccatcgtgagcgtggtggtggtgaccctgctgggcgccgccgccagctacttcaagctgaacaacagaagaaactgcttcagaacccacgagcccgagaacgtgtag

SEQ ID NO: 105411 - DNA, 546 bp, Artificial Sequence
  Description of Artificial Sequence: Synthetic coding sequence
atggagagctggtggggcctgccctgcctggccttcctgtgcttcctgatgcacgccagaggccagagagacttcgacctggccgacgccctggacgaccccgagcccaccaagaagcccaacagcgacatctaccccaagcccaagcccccctactacccccagcccgagaaccccgacagcggcggcaacatctaccccagacccaagcccagaccccagccccagcccggcaacagcggcaacagcggcggcagctacttcaacgacgtggacagagacgacggcagatacccccccagacccagacccagaccccccgccggcggcggcggcggcggctacagcagctacggcaacagcgacaacacccacggcggcgaccaccacagcacctacggcaaccccgagggcaacatggtggccaagatcgtgagccccatcgtgagcgtggtggtggtgaccctgctgggcgccgccgccagctacttcaagctgaacaacagaagaaactgcttcagaacccacgagcccgagaacgtgtag

SEQ ID NO: 105412 - DNA, 129 bp, Artificial Sequence
  Description of Artificial Sequence: Synthetic coding sequence
atggtggccaagatcgtgagccccatcgtgagcgtggtggtggtgaccctgctgggcgccgccgccagctacttcaagctgaacaacagaagaaactgcttcagaacccacgagcccgagaacgtgtag

SEQ ID NO: 105413 - DNA, 10650 bp, Artificial Sequence
  Description of Artificial Sequence: Synthetic coding sequence
atgttccccatgcagaagggcagcctgaacctgctgagacagaagtgggagagctgcgactaccagagaagcgagtgccaccccagagacagccactgcaccatcttccagccccaggagagcaagctgctggcccccgagggcgaggtggtgagcgccccccagagcctggaccccaccagcctgccctacagcaccggcgaggagatgtggagcagcaagcccgaggagaaggacagcgtggacaagagcaacaacaccagagagtacggcagacccgaggtgctgaaggaggacagcctgagcagcagaagaagaatcgagagattcagcatcgccctggacgagctgagaagcgtgttcgaggcccccaagagcggcaacaagcccgccgagtacggcggcaaggaggtggagatcgagagaagcctgtgcagccccgccttcaagagccaccccggcagccagctggaggacagcgtgaaggacagcgacaagaagggcaaggagaccagcttcgacaagatgagccccgagagcggccacagcagaatcttcgaggccaccgccggccccaacaagcccgagagcggcttcgccgaggacagcgccgccagaggcgagggcgtgagcgacctgcacgaggtggtgagcctgaaggagagaatggccagataccaggccgccgtgagcagaggcgactgcagaagcttcagcgccaacatgatggaggagagcgagatgtgcgccgtgcccggcggcctggccaaggtgaagaagcagttcgaggacgagatcaccagcagcagaaacaccttcgcccagtaccagtaccagcaccagaacagaagcgagcaggaggccatccacagcagccaggtgggcaccagcagaagcagccaggagatggccagaaacgagcaggagggcagcaaggtgcagaagatcgacgtgcacggcaccgagatggtgagccacctggagaagcacaccgaggaggtgaaccaggccagccagttccaccagtacgtgcaggagaccgtgatcgacacccccgaggacgaggagatccccaaggtgagcaccaagctgctgaaggagcagttcgagaagagcgcccaggagaagatcctgtacagcgacaaggagatgaccacccccgccaagcagatcaagaccgagagcgagtacgaggagaccttcaagcccagcagcgtggtgagcaccagcagcaccagctgcgtgagcaccagccagagaaaggagaccagcaccaccagatacagcgaccacagcgtgaccagcagcaccctggcccagatcaacgccaccagcagcggcatgaccgaggagttccccccccccccccccgacgtgctgcagaccagcgtggacgtgaccgccttcagccagagccccgagctgcccagcccccccagaagactgcccgtgcccaaggacgtgtacagcaagcagagaaacctgtacgagctgaacagactgtacaagcacatccaccccgagctgagaaagaacctggagaaggactacatcagcgaggtgagcgagatcgtgagcagccagatgaacagcggcagcagcgtgagcgccgacgtgcagcaggccagatacgtgttcgagaacaccaacgacagcagccagaaggacctgaacagcgagagagagtacctggagtgggacgagatcctgaagggcgaggtgcagagcatcagatggatcttcgagaaccagcccctggacagcatcaacaacggcagccccgacgagggcgacatcagcagaggcatcgccgaccaggagatcatcgccggcggcgacgtgaagtacaccacctggatgttcgagacccagcccatcgacaccctgggcgcctacagcagcgacaccgtggagaacgccgagaagatccccgagctggccagaggcgacgtgtgcaccgccagatggatgttcgagaccagacccctggacagcatgaacaagatgcaccagagccaggaggagagcgccgtgaccatcagcaaggacatcaccggcggcgacgtgaagaccgtgagatacatgttcgagacccagcacctggaccagctgggccagctgcacagcgtggacgaggtgcacctgctgcagctgagaagcgagctgaaggagatcaagggcaacgtgaagagaagcatcaagtgcttcgagacccagcccctgtacgtgatcagagacggcagcggccagatgctggagatcaagaccgtgcacagagaggacgtggagaagggcgacgtgagaaccgccagatggatgttcgagacccagcccctggacaccatcaacaaggacatcaccgagatcaaggtggtgagaggcatcagcatggaggagaacgtgaagggcggcgtgagcaaggccaagtggctgttcgagacccagcccctggagaagatcaaggagagcgaggaggtgatcatcgagaaggagaagatcatcggcaccgacgtgagcagaaagtgctggatgttcgagacccagcccctggacatcctgaaggaggtgcccgacgccgacagcctgcagagagaggagatcatcggcggcgacgtgcagaccaccaagcacctgttcgagaccctgcccatcgaggccctgaaggacagccccgacatcggcaagctgcagaagatcaccgccagcgaggaggagaagggcgacgtgagacaccagaagtggatcttcgagacccagcccctggaggacatcagaaaggacaagaaggagtacaccagaaccgtgaagctggaggaggtggacagaggcgacgtgaagaactacacccacatcttcgagagcaacaacctgatcaagttcgacgccagccacaagatcgaggtggagggcgtgaccagaggcgccgtggagctgaacaagagcctgttcgagaccacccccctgtacgccatccaggaccccctgggcaagtaccaccaggtgaagaccgtgcagcaggaggagatcgtgagaggcgacgtgagaagctgcagatggctgttcgagaccagacccatcgaccagttcgacgagagcatccacaagttccagatcatcagaggcatcagcgcccaggagatccagaccggcaacgtgaagagcgccaagtggctgttcgagacccagcccctggacagcatcaagtacttcagcgacgtggaggagaccgagagcaagaccgagcagaccagagacatcgtgaagggcgacgtgaagacctgcaagtggctgttcgagacccagcccatggagagcctgtacgagaaggtgagcctgatgaccagcagcgaggagatccacaagggcgacgtgaagacctgcacctggctgttcgagacccagcccctggacaccatcaaggacgacagcgagaccgccgtgaagctgcagaccgtgaagcaggaggagatccagggcggcgacgtgagaaccgcctgcttcctgttcgagaccgagaacctggacagcatccagggcgaggaggtgaaggagatcaagcccgtggagatggacatccaggccggcgacgtgagcagcatgagatacaagttcgagaaccagagcctggacagcatcagcagcagcagcgaggaggtgctgaagaagatcaagaccctgaagaccgaggacatccagaagggcaacgtgctgaactgcagatggctgttcgagaaccagcccatcgacaagatcaaggagagccaggagggcgacgagtgcgtgaagaccgtgaccgacatccagggcggcgacgtgagaaagggctgcttcatcttcgagaccttcagcctggacgagatcaaggaggagagcgactacatcagcaccaagaagaccatcaccgaggaggtgatccagggcgacgtgaagagctacagaatgctgttcgagacccagcccctgtacgccatccaggacagagagggcagctaccacgaggtgaccaccgtgaagaaggaggaggtgatccacggcgacgtgagaggcaccagatggctgttcgagaccaagcccctggacagcatcaacaagagcgagaccgtgtacgtgatcaagagcgtgacccaggaggacatccagaagggcgacgtgagcagcgtgagatacagattcgagacccagcccctggaccagatcagcgaggagagccacaacatcatgcccagcatcgaccacatccagggcggcaacgtgaagaccagcagacagttcttcgagagcgagaacttcgacaagaacaactacatcagaaccgtgagcgtgaacgagatccagaagggcaacgtgaagaccagcacctggctgttcgagacccacaccatggacgagctgagaggcgagggcctggagtacgagaacatcaagaccgtgacccaggaggacgtgcagaagggcgacgtgaagcaggccgtgtggctgttcgagaacagaaccttcgacagcatcatggaggcccacaagggcatcaccaagatgaccaaggaggagatcccccccagcgacgtgaagaccaccacctggctgttcgagaccacccccctgcacgagttcaacgagaccagagtggagaagatcgagatcatcggcaagagcatcaaggagaccctggaggacctgtacagccagaaggtgatccaggcccccggcatcatcatcgaggccgacgagatcggcgacgtgagaatggccaagtacaagctgatgaaccaggccagccccgagatccagaaggaggagatcatcagagccgacctgagaaacatcatggtgaacctgctgagcaagagagactgcaccgagagagagatcctgatcagcgaggaggagaagggcaacgtgaacctgaccaagacccagctgctgaacagaagcaccgagttccacgccgagaaggaggagatcgtgaagggcgacgtgcagcaggccatcaagaacctgttcagcgaggagagaagcgtgaagaagggcatcctgatccaggaggacgagaagggcgacatcaacatgaccatctactgcctgctgcacgagaacgacggcgacaccatcgagagagaggaggtgatcggcggcgacgtgaagagaaccatccacaacctgctgagcagcaccagcaacaacaagatcagcgagagagccaagatcgacgccagcgagagaggcaacgtgcagttcttcaccacctgcatcgaggccggcgccctggactacctgaagcagctgcacaccgagagcaacgagaccctgaccgccaagaagcaggagggcgagaaggagatcatcggcggcgacgtggagggcaccaagctgctgctgaagaagagacagagcctggtggagagaaccgtgagcgagaccgacatcatccccggcgacgtgcacaacaccgtgaaggtgttcatgaccgagccccagagcaccttcggcaagatccccaaggaggagatcatcaagggcgacctgaccagcaccctgaacagcctgagccaggccgtgaaccagaagaccgtgaccaagaccgaggagatcatcaagggcaacatgctggccaccctgaagagcctgaaggagagcagccacagatggaaggagagcaagcagcccgacgccatccccggcgacatcgagaaggccatcgagtgcctggagaaggccaccaacaccaagaccgagatcctgaagaaggagctgctgaaggacgacctggagaccagcctgagaagcctgaaggaggcccagagaagcttcaaggaggtgcacaaggagggcgtgatcaagaaggacgccaaggccgtgatggccggcagcagcggcgagcagaagaccgacatccaccaggtggccgtgcagagaaacaagaacagcctgctgcagcccaagcccggccccttcgagcccgccgccaagtggcagggcggcgccgacaccctgagccagaccatgggcaagagctgccacggcaacctggtggaggagagaaccgaggtgaacctgcccaaggcccccaagggcaccgtgaagatcgtgatcgacagagagcagaacaacgacgccctggagaagagcctgagaagactgagcaacagccaccacaagagcaacgtgctggagagcggcgacaagaccggcgtgtggaccgacaccaccggcgagcagcacctgagagacgagtacatgagcagacagctgaccagcaccgtgagcgtgaagaacaacctgaccaccaaggagagcgacagagccgtgagagagctgaagaaggacgacgtgttcaacagcatccagagcgccggcaagaccgtgggcaagcagcagacctacgagctgagaaacgaccaccagaagatggagggcttccacatcaagagccccaagaagaccaagaacatcaagatcctgaccgacacccagagcagcaagcccagccccacccagcaccccgtgagcatgcccgtgggcggcacctacgacctgagcggcgacttccagaagcagaccctgctgaagcaggagaccaagtacagcaacaaggacatcaagaagaagaacatcaacctgcagcccatgtggcagctgctgcccgtggagcaggacaccagcaacgtgaccgagatgaaggtgagcgagaagagccacaacaccttcaaggccaccaacaagaagagagagaccgacgtgcacctgaagagccaggacttcctgatgaagaccaacaccagcaccggcctgaagatggccatggagagaagcctgaaccccatcaacttcaaccccgagaacaacgtgaaggagagcgagtgccccctgcccccccccagcccccccccccccccccccagcaacgccagcagcgagatcgagttccccctgcccccccccccccccctgatgatgttccccgagaagaacggcttcctgcccagcctgagcaccgagaagatcaaggccgagttcgagagcttccccggcctgcccctgccccccccccccgtggacgagaagagcgagagagagagcagcagcatgttcctgccccccccccccccccccacccccagccagaagcccgcccacctgctgagcagcagcgcccccgagaagcacagcggcgacttcatgcagcagtacagccagaaggaggccagcaacagccagaacagccaggccaagatcatcaccggcaagaccggcgtgctgcccccccccaccctgcccaagcccaagctgcccaagcacatcaaggacaacaagaacgacttcagccccaaggtggagctggccaccagcctgagcgacatggagtgcaagatcaccaccagcaaggaccagaagaaggtgatggtgatgaccagcagcgagcacaccgagaccaagcagaacgtgatcagcaagagcctggacgagagaaagcagctgagcatcgacagcgccaactgcctgagccacaccgtgcccggcaccagcgcccccagaaagaagcagatcgcccccctgatcaagagccacagcttccccgagagcagcggccagcagaaccccaagccctacatgagaaagttcaagacccccctgatgatcgccgaggagaagtacagacagcagaaggaggagatcgagaagcagaagcaggagagcagctactacaacatcgtgaagacccagagccagaaccagcacatcaccgaggtggagaaggagatgcccctgcagaagaccaacgaggaggtgagcctgagcggcatcgacagcgagtgcaccgtggtgcagcccagccccggcagccagagcaacgccagaatcctgggcgtgtgcagcgacaaccagctgagcaccaccagccccgagaccgtggccgccaagagactgcaccacgtgctggccgccagcgaggacaaggacaagatgaagaaggaggtgctgcagagcagcagagacatcatgcagagcaagagcgcctgcgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaacgagaccgaccacagctacgagagccacaagcagcagagcgagatcgacgtgcagaccttcaccaagaagcagtacctgaagaccaagaagaccgaggccagcaccgagtgcagccacaagcagagcctggccgagagacactaccagctgcccaagaaggagaagagagtgaccgtgcagctgcccaccgagagcatccagaagaaccaggaggacaagctgaagatggtgcccagaaagcagagagagttcagcggcagcgacagaggcaagctgcccggcagcgaggagaagaaccagggccccagcatgatcggcagaaaggaggagagactgatcaccgagagaaagcacgagcacctgaagaacaagagcgcccccaaggtggtgaagcagaaggtgatcgacgcccacctggacagccagacccagaacttccagcagacccagatccagaccgccgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagcagcgtgaaggagagccagagagacgacggcaagggcgccctgaacatcgtggagttcctgagaaagagagaggagctgcagcagatcctgagcagagtgaagcagttcgaggccgagcccaacaagagcggcctgaagaccttccagaccctgctgaacaccatccccggctggctgatcagcgaggacaagagagagtacgccgtgcacatcgccatggagaacaacctggagaaggtgaaggaggagatcacccacatcaagacccaggccgaggacatgctggtgagctacgagaacatcatccagaccgccatgatgagcagcaagaccggcaagcccggcaacaagcccaccagcctggacgagaccagcagcaaggtgagcaacgtgcacgtgagcaacaacaagaacagcgagcagaaggagaacaagatcgccaaggagaagaccgtgcagcaccaggtggccgcccaccacgaggccaccgtgagaagccacgtgaagacccaccaggagatcaagctggacgacagcaacatccccccccccagcctgaagaccagaccccccagccccaccttcatcaccatcgagagcaccgccagaagaaccgagaaccccaccaagaacgagctgagccagagccccaagaaggacagctacgtggagcccccccccagaagacccatgagccagaagagcgagatccacagagccaacaccagccccagcccccccagaagcagaagcgagcagctggtgagactgaaggacaccaccgccaagctgagcaagggcgccatcccctgccccgccgccacccccgtgcccatcgtggagaagagaagcgagatcatcatgagccccgccaccctgagaagacagatcaagatcgagaccagaggcagagacagcccccccaccatcaccatccccgtgaacatcaaccacgccgccagcggcagcttcagagagagcgtggacgcccaggaggagatcagaaaggtggagaagagagccacctacgtgcacaaggacggcctgaacagcaccgaccacatggtgcccgacaccgagagctacgacgccgtggagatcatcagaaaggtggccgtgccccccagactgagcgagcacacccagagatacgaggccgccaacagaaccgtgcagatggccgagaacttcgtgaacgaccccgagaacgagatcaacagatggttcagagagttcgagcacggccccgtgagcgaggccaagagcaacagaagagtgtacgccaagggcgagaccaaccacaacatccagcaggagagcagaaccttctgcaaggaggagttcggcctgaccagcctgggcaacaccagcttcaccgacttcagctgcaagcaccccagagagctgagagagaagatccccgtgaagcagcccagaatctgcagcgagaccagaagcctgagcgagcacttcagcggcatggacgccttcgagagccagatcgtggagagcaagatgaagaccagcagcagccacagcagcgaggccggcaagagcggctgcgacttcaagcacgccccccccacctacgaggacgtgatcgccggccacatcctggacatcagcgacagccccaaggaggtgagaaagaacttccagaagacctggcaggagagcggcagagtgttcaagggcctgggctacgccaccgccgacgccagcgccaccgagatgagaaccaccttccaggaggagagcgccttcatcagcgaggccgccgcccccagacagggcaacatgtacaccctgagcaaggacagcctgagcaacggcgtgcccagcggcagacaggccgagttcagctag

SEQ ID NO: 105414 - DNA, 2817 bp, Artificial Sequence
  Description of Artificial Sequence: Synthetic coding sequence
atgttccccatgcagaagggcagcctgaacctgctgagacagaagtgggagagctgcgactaccagagaagcgagtgccaccccagagacagccactgcaccatcttccagccccaggagagcaagctgctggcccccgagggcgaggtggtgagcgccccccagagcctggaccccaccagcctgccctacagcaccggcgaggagatgtggagcagcaagcccgaggagaaggacagcgtggacaagagcaacaacaccagagagtacggcagacccgaggtgctgaaggaggacagcctgagcagcagaagaagaatcgagagattcagcatcgccctggacgagctgagaagcgtgttcgaggcccccaagagcggcaacaagcccgccgagtacggcggcaaggaggtggagatcgagagaagcctgtgcagccccgccttcaagagccaccccggcagccagctggaggacagcgtgaaggacagcgacaagaagggcaaggagaccagcttcgacaagatgagccccgagagcggccacagcagaatcttcgaggccaccgccggccccaacaagcccgagagcggcttcgccgaggacagcgccgccagaggcgagggcgtgagcgacctgcacgaggtggtgagcctgaaggagagaatggccagataccaggccgccgtgagcagaggcgactgcagaagcttcagcgccaacatgatggaggagagcgagatgtgcgccgtgcccggcggcctggccaaggtgaagaagcagttcgaggacgagatcaccagcagcagaaacaccttcgcccagtaccagtaccagcaccagaacagaagcgagcaggaggccatccacagcagccaggtgggcaccagcagaagcagccaggagatggccagaaacgagcaggagggcagcaaggtgcagaagatcgacgtgcacggcaccgagatggtgagccacctggagaagcacaccgaggaggtgaaccaggccagccagttccaccagtacgtgcaggagaccgtgatcgacacccccgaggacgaggagatccccaaggtgagcaccaagctgctgaaggagcagttcgagaagagcgcccaggagaagatcctgtacagcgacaaggagatgaccacccccgccaagcagatcaagaagctgctgctgcaggacaaggagatctgcatcctgtgccagaagaccgtgtaccccatggagtgcctggtggccgacaagcagaacttccacaagagctgcttcagatgccaccactgcaacagcaagctgagcctgggcaactacgccagcctgcacggccagatctactgcaagccccacttcaagcagctgttcaagagcaagggcaactacgacgagggcttcggccacaagcagcacaaggacagatggaactgcaagaaccagagcagaagcgtggacttcatccccaacgaggagcccaacatgtgcaagaacatcgccgagaacaccctggtgcccggcgacagaaacgagcacctggacgccggcaacagcgagggccagagaaacgacctgagaaagctgggcgagagaggcaagctgaaggtgatctggccccccagcaaggagatccccaagaagaccctgcccttcgaggaggagctgaagatgagcaagcccaagtggccccccgagatgaccaccctgctgagccccgagttcaagagcgagagcctgctggaggacgtgagaacccccgagaacaagggccagagacaggaccacttccccttcctgcagccctacctgcagagcacccacgtgtgccagaaggaggacgtgatcggcatcaaggagatgaagatgcccgagggcagaaaggacgagaagaaggagggcagaaagaacgtgcaggacagacccagcgaggccgaggacaccaagagcaacagaaagagcgccatggacctgaacgacaacaacaacgtgatcgtgcagagcgccgagaaggagaagaacgagaagaccaaccagaccaacggcgccgaggtgctgcaggtgaccaacaccgacgacgagatgatgcccgagaaccacaaggagaacctgaacaagaacaacaacaacaactacgtggccgtgagctacctgaacaactgcagacagaagaccagcatcctggagttcctggacctgctgcccctgagcagcgaggccaacgacaccgccaacgagtacgagatcgagaagctggagaacaccagcagaatcagcgagctgctgggcatcttcgagagcgagaagacctacagcagaaacgtgctggccatggccctgaagaagcagaccgacagagccgccgccggcagccccgtgcagcccgcccccaagcccagcctgagcagaggcctgatggtgaagggcggcagcagcatcatcagccccgacaccaacctgctgaacatcaagggcagccacagcaagagcaagaacctgcacttcttcttcagcaacaccgtgaagatcaccgccttcagcaagaagaacgagaacatcttcaactgcgacctgatcgacagcgtggaccagatcaagaacatgccctgcctggacctgagagagttcggcaaggacgtgaagccctggcacgtggagaccaccgaggccgccagaaacaacgagaacaccggcttcgacgccctgagccacgagtgcaccgccaagcccctgttccccagagtggaggtgcagagcgagcagctgaccgtggaggagcagatcaagagaaacagatgctacagcgacaccgagtag

SEQ ID NO: 105415 - DNA, 10650 bp, Artificial Sequence; identical to SEQ ID NO: 105413
  Description of Artificial Sequence: Synthetic coding sequence

SEQ ID NO: 105416 - DNA, 9984 bp, Artificial Sequence
  Description of Artificial Sequence: Synthetic coding sequence
atggccagataccaggccgccgtgagcagaggcgactgcagaagcttcagcgccaacatgatggaggagagcgagatgtgcgccgtgcccggcggcctggccaaggtgaagaagcagttcgaggacgagatcaccagcagcagaaacaccttcgcccagtaccagtaccagcaccagaacagaagcgagcaggaggccatccacagcagccaggtgggcaccagcagaagcagccaggagatggccagaaacgagcaggagggcagcaaggtgcagaagatcgacgtgcacggcaccgagatggtgagccacctggagaagcacaccgaggaggtgaaccaggccagccagttccaccagtacgtgcaggagaccgtgatcgacacccccgaggacgaggagatccccaaggtgagcaccaagctgctgaaggagcagttcgagaagagcgcccaggagaagatcctgtacagcgacaaggagatgaccacccccgccaagcagatcaagaccgagagcgagtacgaggagaccttcaagcccagcagcgtggtgagcaccagcagcaccagctgcgtgagcaccagccagagaaaggagaccagcaccaccagatacagcgaccacagcgtgaccagcagcaccctggcccagatcaacgccaccagcagcggcatgaccgaggagttccccccccccccccccgacgtgctgcagaccagcgtggacgtgaccgccttcagccagagccccgagctgcccagcccccccagaagactgcccgtgcccaaggacgtgtacagcaagcagagaaacctgtacgagctgaacagactgtacaagcacatccaccccgagctgagaaagaacctggagaaggactacatcagcgaggtgagcgagatcgtgagcagccagatgaacagcggcagcagcgtgagcgccgacgtgcagcaggccagatacgtgttcgagaacaccaacgacagcagccagaaggacctgaacagcgagagagagtacctggagtgggacgagatcctgaagggcgaggtgcagagcatcagatggatcttcgagaaccagcccctggacagcatcaacaacggcagccccgacgagggcgacatcagcagaggcatcgccgaccaggagatcatcgccggcggcgacgtgaagtacaccacctggatgttcgagacccagcccatcgacaccctgggcgcctacagcagcgacaccgtggagaacgccgagaagatccccgagctggccagaggcgacgtgtgcaccgccagatggatgttcgagaccagacccctggacagcatgaacaagatgcaccagagccaggaggagagcgccgtgaccatcagcaaggacatcaccggcggcgacgtgaagaccgtgagatacatgttcgagacccagcacctggaccagctgggccagctgcacagcgtggacgaggtgcacctgctgcagctgagaagcgagctgaaggagatcaagggcaacgtgaagagaagcatcaagtgcttcgagacccagcccctgtacgtgatcagagacggcagcggccagatgctggagatcaagaccgtgcacagagaggacgtggagaagggcgacgtgagaaccgccagatggatgttcgagacccagcccctggacaccatcaacaaggacatcaccgagatcaaggtggtgagaggcatcagcatggaggagaacgtgaagggcggcgtgagcaaggccaagtggctgttcgagacccagcccctggagaagatcaaggagagcgaggaggtgatcatcgagaaggagaagatcatcggcaccgacgtgagcagaaagtgctggatgttcgagacccagcccctggacatcctgaaggaggtgcccgacgccgacagcctgcagagagaggagatcatcggcggcgacgtgcagaccaccaagcacctgttcgagaccctgcccatcgaggccctgaaggacagccccgacatcggcaagctgcagaagatcaccgccagcgaggaggagaagggcgacgtgagacaccagaagtggatcttcgagacccagcccctggaggacatcagaaaggacaagaaggagtacaccagaaccgtgaagctggaggaggtggacagaggcgacgtgaagaactacacccacatcttcgagagcaacaacctgatcaagttcgacgccagccacaagatcgaggtggagggcgtgaccagaggcgccgtggagctgaacaagagcctgttcgagaccacccccctgtacgccatccaggaccccctgggcaagtaccaccaggtgaagaccgtgcagcaggaggagatcgtgagaggcgacgtgagaagctgcagatggctgttcgagaccagacccatcgaccagttcgacgagagcatccacaagttccagatcatcagaggcatcagcgcccaggagatccagaccggcaacgtgaagagcgccaagtggctgttcgagacccagcccctggacagcatcaagtacttcagcgacgtggaggagaccgagagcaagaccgagcagaccagagacatcgtgaagggcgacgtgaagacctgcaagtggctgttcgagacccagcccatggagagcctgtacgagaaggtgagcctgatgaccagcagcgaggagatccacaagggcgacgtgaagacctgcacctggctgttcgagacccagcccctggacaccatcaaggacgacagcgagaccgccgtgaagctgcagaccgtgaagcaggaggagatccagggcggcgacgtgagaaccgcctgcttcctgttcgagaccgagaacctggacagcatccagggcgaggaggtgaaggagatcaagcccgtggagatggacatccaggccggcgacgtgagcagcatgagatacaagttcgagaaccagagcctggacagcatcagcagcagcagcgaggaggtgctgaagaagatcaagaccctgaagaccgaggacatccagaagggcaacgtgctgaactgcagatggctgttcgagaaccagcccatcgacaagatcaaggagagccaggagggcgacgagtgcgtgaagaccgtgaccgacatccagggcggcgacgtgagaaagggctgcttcatcttcgagaccttcagcctggacgagatcaaggaggagagcgactacatcagcaccaagaagaccatcaccgaggaggtgatccagggcgacgtgaagagctacagaatgctgttcgagacccagcccctgtacgccatccaggacagagagggcagctaccacgaggtgaccaccgtgaagaaggaggaggtgatccacggcgacgtgagaggcaccagatggctgttcgagaccaagcccctggacagcatcaacaagagcgagaccgtgtacgtgatcaagagcgtgacccaggaggacatccagaagggcgacgtgagcagcgtgagatacagattcgagacccagcccctggaccagatcagcgaggagagccacaacatcatgcccagcatcgaccacatccagggcggcaacgtgaagaccagcagacagttcttcgagagcgagaacttcgacaagaacaactacatcagaaccgtgagcgtgaacgagatccagaagggcaacgtgaagaccagcacctggctgttcgagacccacaccatggacgagctgagaggcgagggcctggagtacgagaacatcaagaccgtgacccaggaggacgtgcagaagggcgacgtgaagcaggccgtgtggctgttcgagaacagaaccttcgacagcatcatggaggcccacaagggcatcaccaagatgaccaaggaggagatcccccccagcgacgtgaagaccaccacctggctgttcgagaccacccccctgcacgagttcaacgagaccagagtggagaagatcgagatcatcggcaagagcatcaaggagaccctggaggacctgtacagccagaaggtgatccaggcccccggcatcatcatcgaggccgacgagatcggcgacgtgagaatggccaagtacaagctgatgaaccaggccagccccgagatccagaaggaggagatcatcagagccgacctgagaaacatcatggtgaacctgctgagcaagagagactgcaccgagagagagatcctgatcagcgaggaggagaagggcaacgtgaacctgaccaagacccagctgctgaacagaagcaccgagttccacgccgagaaggaggagatcgtgaagggcgacgtgcagcaggccatcaagaacctgttcagcgaggagagaagcgtgaagaagggcatcctgatccaggaggacgagaagggcgacatcaacatgaccatctactgcctgctgcacgagaacgacggcgacaccatcgagagagaggaggtgatcggcggcgacgtgaagagaaccatccacaacctgctgagcagcaccagcaacaacaagatcagcgagagagccaagatcgacgccagcgagagaggcaacgtgcagttcttcaccacctgcatcgaggccggcgccctggactacctgaagcagctgcacaccgagagcaacgagaccctgaccgccaagaagcaggagggcgagaaggagatcatcggcggcgacgtggagggcaccaagctgctgctgaagaagagacagagcctggtggagagaaccgtgagcgagaccgacatcatccccggcgacgtgcacaacaccgtgaaggtgttcatgaccgagccccagagcaccttcggcaagatccccaaggaggagatcatcaagggcgacctgaccagcaccctgaacagcctgagccaggccgtgaaccagaagaccgtgaccaagaccgaggagatcatcaagggcaacatgctggccaccctgaagagcctgaaggagagcagccacagatggaaggagagcaagcagcccgacgccatccccggcgacatcgagaaggccatcgagtgcctggagaaggccaccaacaccaagaccgagatcctgaagaaggagctgctgaaggacgacctggagaccagcctgagaagcctgaaggaggcccagagaagcttcaaggaggtgcacaaggagggcgtgatcaagaaggacgccaaggccgtgatggccggcagcagcggcgagcagaagaccgacatccaccaggtggccgtgcagagaaacaagaacagcctgctgcagcccaagcccggccccttcgagcccgccgccaagtggcagggcggcgccgacaccctgagccagaccatgggcaagagctgccacggcaacctggtggaggagagaaccgaggtgaacctgcccaaggcccccaagggcaccgtgaagatcgtgatcgacagagagcagaacaacgacgccctggagaagagcctgagaagactgagcaacagccaccacaagagcaacgtgctggagagcggcgacaagaccggcgtgtggaccgacaccaccggcgagcagcacctgagagacgagtacatgagcagacagctgaccagcaccgtgagcgtgaagaacaacctgaccaccaaggagagcgacagagccgtgagagagctgaagaaggacgacgtgttcaacagcatccagagcgccggcaagaccgtgggcaagcagcagacctacgagctgagaaacgaccaccagaagatggagggcttccacatcaagagccccaagaagaccaagaacatcaagatcctgaccgacacccagagcagcaagcccagccccacccagcaccccgtgagcatgcccgtgggcggcacctacgacctgagcggcgacttccagaagcagaccctgctgaagcaggagaccaagtacagcaacaaggacatcaagaagaagaacatcaacctgcagcccatgtggcagctgctgcccgtggagcaggacaccagcaacgtgaccgagatgaaggtgagcgagaagagccacaacaccttcaaggccaccaacaagaagagagagaccgacgtgcacctgaagagccaggacttcctgatgaagaccaacaccagcaccggcctgaagatggccatggagagaagcctgaaccccatcaacttcaaccccgagaacaacgtgaaggagagcgagtgccccctgcccccccccagcccccccccccccccccccagcaacgccagcagcgagatcgagttccccctgcccccccccccccccctgatgatgttccccgagaagaacggcttcctgcccagcctgagcaccgagaagatcaaggccgagttcgagagcttccccggcctgcccctgccccccccccccgtggacgagaagagcgagagagagagcagcagcatgttcctgccccccccccccccccccacccccagccagaagcccgcccacctgctgagcagcagcgcccccgagaagcacagcggcgacttcatgcagcagtacagccagaaggaggccagcaacagccagaacagccaggccaagatcatcaccggcaagaccggcgtgctgcccccccccaccctgcccaagcccaagctgcccaagcacatcaaggacaacaagaacgacttcagccccaaggtggagctggccaccagcctgagcgacatggagtgcaagatcaccaccagcaaggaccagaagaaggtgatggtgatgaccagcagcgagcacaccgagaccaagcagaacgtgatcagcaagagcctggacgagagaaagcagctgagcatcgacagcgccaactgcctgagccacaccgtgcccggcaccagcgcccccagaaagaagcagatcgcccccctgatcaagagccacagcttccccgagagcagcggccagcagaaccccaagccctacatgagaaagttcaagacccccctgatgatcgccgaggagaagtacagacagcagaaggaggagatcgagaagcagaagcaggagagcagctactacaacatcgtgaagacccagagccagaaccagcacatcaccgaggtggagaaggagatgcccctgcagaagaccaacgaggaggtgagcctgagcggcatcgacagcgagtgcaccgtggtgcagcccagccccggcagccagagcaacgccagaatcctgggcgtgtgcagcgacaaccagctgagcaccaccagccccgagaccgtggccgccaagagactgcaccacgtgctggccgccagcgaggacaaggacaagatgaagaaggaggtgctgcagagcagcagagacatcatgcagagcaagagcgcctgcgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaacgagaccgaccacagctacgagagccacaagcagcagagcgagatcgacgtgcagaccttcaccaagaagcagtacctgaagaccaagaagaccgaggccagcaccgagtgcagccacaagcagagcctggccgagagacactaccagctgcccaagaaggagaagagagtgaccgtgcagctgcccaccgagagcatccagaagaaccaggaggacaagctgaagatggtgcccagaaagcagagagagttcagcggcagcgacagaggcaagctgcccggcagcgaggagaagaaccagggccccagcatgatcggcagaaaggaggagagactgatcaccgagagaaagcacgagcacctgaagaacaagagcgcccccaaggtggtgaagcagaaggtgatcgacgcccacctggacagccagacccagaacttccagcagacccagatccagaccgccgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagcagcgtgaaggagagccagagagacgacggcaagggcgccctgaacatcgtggagttcctgagaaagagagaggagctgcagcagatcctgagcagagtgaagcagttcgaggccgagcccaacaagagcggcctgaagaccttccagaccctgctgaacaccatccccggctggctgatcagcgaggacaagagagagtacgccgtgcacatcgccatggagaacaacctggagaaggtgaaggaggagatcacccacatcaagacccaggccgaggacatgctggtgagctacgagaacatcatccagaccgccatgatgagcagcaagaccggcaagcccggcaacaagcccaccagcctggacgagaccagcagcaaggtgagcaacgtgcacgtgagcaacaacaagaacagcgagcagaaggagaacaagatcgccaaggagaagaccgtgcagcaccaggtggccgcccaccacgaggccaccgtgagaagccacgtgaagacccaccaggagatcaagctggacgacagcaacatccccccccccagcctgaagaccagaccccccagccccaccttcatcaccatcgagagcaccgccagaagaaccgagaaccccaccaagaacgagctgagccagagccccaagaaggacagctacgtggagcccccccccagaagacccatgagccagaagagcgagatccacagagccaacaccagccccagcccccccagaagcagaagcgagcagctggtgagactgaaggacaccaccgccaagctgagcaagggcgccatcccctgccccgccgccacccccgtgcccatcgtggagaagagaagcgagatcatcatgagccccgccaccctgagaagacagatcaagatcgagaccagaggcagagacagcccccccaccatcaccatccccgtgaacatcaaccacgccgccagcggcagcttcagagagagcgtggacgcccaggaggagatcagaaaggtggagaagagagccacctacgtgcacaaggacggcctgaacagcaccgaccacatggtgcccgacaccgagagctacgacgccgtggagatcatcagaaaggtggccgtgccccccagactgagcgagcacacccagagatacgaggccgccaacagaaccgtgcagatggccgagaacttcgtgaacgaccccgagaacgagatcaacagatggttcagagagttcgagcacggccccgtgagcgaggccaagagcaacagaagagtgtacgccaagggcgagaccaaccacaacatccagcaggagagcagaaccttctgcaaggaggagttcggcctgaccagcctgggcaacaccagcttcaccgacttcagctgcaagcaccccagagagctgagagagaagatccccgtgaagcagcccagaatctgcagcgagaccagaagcctgagcgagcacttcagcggcatggacgccttcgagagccagatcgtggagagcaagatgaagaccagcagcagccacagcagcgaggccggcaagagcggctgcgacttcaagcacgccccccccacctacgaggacgtgatcgccggccacatcctggacatcagcgacagccccaaggaggtgagaaagaacttccagaagacctggcaggagagcggcagagtgttcaagggcctgggctacgccaccgccgacgccagcgccaccgagatgagaaccaccttccaggaggagagcgccttcatcagcgaggccgccgcccccagacagggcaacatgtacaccctgagcaaggacagcctgagcaacggcgtgcccagcggcagacaggccgagttcagctag

SEQ ID NO: 105417 - DNA, 2151 bp, Artificial Sequence
  Description of Artificial Sequence: Synthetic coding sequence
atggccagataccaggccgccgtgagcagaggcgactgcagaagcttcagcgccaacatgatggaggagagcgagatgtgcgccgtgcccggcggcctggccaaggtgaagaagcagttcgaggacgagatcaccagcagcagaaacaccttcgcccagtaccagtaccagcaccagaacagaagcgagcaggaggccatccacagcagccaggtgggcaccagcagaagcagccaggagatggccagaaacgagcaggagggcagcaaggtgcagaagatcgacgtgcacggcaccgagatggtgagccacctggagaagcacaccgaggaggtgaaccaggccagccagttccaccagtacgtgcaggagaccgtgatcgacacccccgaggacgaggagatccccaaggtgagcaccaagctgctgaaggagcagttcgagaagagcgcccaggagaagatcctgtacagcgacaaggagatgaccacccccgccaagcagatcaagaagctgctgctgcaggacaaggagatctgcatcctgtgccagaagaccgtgtaccccatggagtgcctggtggccgacaagcagaacttccacaagagctgcttcagatgccaccactgcaacagcaagctgagcctgggcaactacgccagcctgcacggccagatctactgcaagccccacttcaagcagctgttcaagagcaagggcaactacgacgagggcttcggccacaagcagcacaaggacagatggaactgcaagaaccagagcagaagcgtggacttcatccccaacgaggagcccaacatgtgcaagaacatcgccgagaacaccctggtgcccggcgacagaaacgagcacctggacgccggcaacagcgagggccagagaaacgacctgagaaagctgggcgagagaggcaagctgaaggtgatctggccccccagcaaggagatccccaagaagaccctgcccttcgaggaggagctgaagatgagcaagcccaagtggccccccgagatgaccaccctgctgagccccgagttcaagagcgagagcctgctggaggacgtgagaacccccgagaacaagggccagagacaggaccacttccccttcctgcagccctacctgcagagcacccacgtgtgccagaaggaggacgtgatcggcatcaaggagatgaagatgcccgagggcagaaaggacgagaagaaggagggcagaaagaacgtgcaggacagacccagcgaggccgaggacaccaagagcaacagaaagagcgccatggacctgaacgacaacaacaacgtgatcgtgcagagcgccgagaaggagaagaacgagaagaccaaccagaccaacggcgccgaggtgctgcaggtgaccaacaccgacgacgagatgatgcccgagaaccacaaggagaacctgaacaagaacaacaacaacaactacgtggccgtgagctacctgaacaactgcagacagaagaccagcatcctggagttcctggacctgctgcccctgagcagcgaggccaacgacaccgccaacgagtacgagatcgagaagctggagaacaccagcagaatcagcgagctgctgggcatcttcgagagcgagaagacctacagcagaaacgtgctggccatggccctgaagaagcagaccgacagagccgccgccggcagccccgtgcagcccgcccccaagcccagcctgagcagaggcctgatggtgaagggcggcagcagcatcatcagccccgacaccaacctgctgaacatcaagggcagccacagcaagagcaagaacctgcacttcttcttcagcaacaccgtgaagatcaccgccttcagcaagaagaacgagaacatcttcaactgcgacctgatcgacagcgtggaccagatcaagaacatgccctgcctggacctgagagagttcggcaaggacgtgaagccctggcacgtggagaccaccgaggccgccagaaacaacgagaacaccggcttcgacgccctgagccacgagtgcaccgccaagcccctgttccccagagtggaggtgcagagcgagcagctgaccgtggaggagcagatcaagagaaacagatgctacagcgacaccgagtag

SEQ ID NO: 105418 - DNA, 2817 bp, Artificial Sequence; identical to SEQ ID NO: 105414
  Description of Artificial Sequence: Synthetic coding sequence

SEQ ID NO: 105419 - DNA, 2892 bp, Artificial Sequence
  Description of Artificial Sequence: Synthetic coding sequence
atgcccctgcagaagaccaacgaggaggtgagcctgagcggcatcgacagcgagtgcaccgtggtgcagcccagccccggcagccagagcaacgccagaatcctgggcgtgtgcagcgacaaccagctgagcaccaccagccccgagaccgtggccgccaagagactgcaccacgtgctggccgccagcgaggacaaggacaagatgaagaaggaggtgctgcagagcagcagagacatcatgcagagcaagagcgcctgcgagatcaagcagagccaccaggagtgcagcacccagcagacccagcagaagaagtacctggagcagctgcacctgccccagagcaagcccatcagccccaacttcaaggtgaagaccatcaagctgcccaccctggaccacaccctgaacgagaccgaccacagctacgagagccacaagcagcagagcgagatcgacgtgcagaccttcaccaagaagcagtacctgaagaccaagaagaccgaggccagcaccgagtgcagccacaagcagagcctggccgagagacactaccagctgcccaagaaggagaagagagtgaccgtgcagctgcccaccgagagcatccagaagaaccaggaggacaagctgaagatggtgcccagaaagcagagagagttcagcggcagcgacagaggcaagctgcccggcagcgaggagaagaaccagggccccagcatgatcggcagaaaggaggagagactgatcaccgagagaaagcacgagcacctgaagaacaagagcgcccccaaggtggtgaagcagaaggtgatcgacgcccacctggacagccagacccagaacttccagcagacccagatccagaccgccgagagcaaggccgagcacaagaagctgccccagccctacaacagcctgcaggaggagaagtgcctggaggtgaagggcatccaggagaagcaggtgttcagcaacaccaaggacagcaagcaggagatcacccagaacaagagcttcttcagcagcgtgaaggagagccagagagacgacggcaagggcgccctgaacatcgtggagttcctgagaaagagagaggagctgcagcagatcctgagcagagtgaagcagttcgaggccgagcccaacaagagcggcctgaagaccttccagaccctgctgaacaccatccccggctggctgatcagcgaggacaagagagagtacgccgtgcacatcgccatggagaacaacctggagaaggtgaaggaggagatcacccacatcaagacccaggccgaggacatgctggtgagctacgagaacatcatccagaccgccatgatgagcagcaagaccggcaagcccggcaacaagcccaccagcctggacgagaccagcagcaaggtgagcaacgtgcacgtgagcaacaacaagaacagcgagcagaaggagaacaagatcgccaaggagaagaccgtgcagcaccaggtggccgcccaccacgaggccaccgtgagaagccacgtgaagacccaccaggagatcaagctggacgacagcaacatccccccccccagcctgaagaccagaccccccagccccaccttcatcaccatcgagagcaccgccagaagaaccgagaaccccaccaagaacgagctgagccagagccccaagaaggacagctacgtggagcccccccccagaagacccatgagccagaagagcgagatccacagagccaacaccagccccagcccccccagaagcagaagcgagcagctggtgagactgaaggacaccaccgccaagctgagcaagggcgccatcccctgccccgccgccacccccgtgcccatcgtggagaagagaagcgagatcatcatgagccccgccaccctgagaagacagatcaagatcgagaccagaggcagagacagcccccccaccatcaccatccccgtgaacatcaaccacgccgccagcggcagcttcagagagagcgtggacgcccaggaggagatcagaaaggtggagaagagagccacctacgtgcacaaggacggcctgaacagcaccgaccacatggtgcccgacaccgagagctacgacgccgtggagatcatcagaaaggtggccgtgccccccagactgagcgagcacacccagagatacgaggccgccaacagaaccgtgcagatggccgagaacttcgtgaacgaccccgagaacgagatcaacagatggttcagagagttcgagcacggccccgtgagcgaggccaagagcaacagaagagtgtacgccaagggcgagaccaaccacaacatccagcaggagagcagaaccttctgcaaggaggagttcggcctgaccagcctgggcaacaccagcttcaccgacttcagctgcaagcaccccagagagctgagagagaagatccccgtgaagcagcccagaatctgcagcgagaccagaagcctgagcgagcacttcagcggcatggacgccttcgagagccagatcgtggagagcaagatgaagaccagcagcagccacagcagcgaggccggcaagagcggctgcgacttcaagcacgccccccccacctacgaggacgtgatcgccggccacatcctggacatcagcgacagccccaaggaggtgagaaagaacttccagaagacctggcaggagagcggcagagtgttcaagggcctgggctacgccaccgccgacgccagcgccaccgagatgagaaccaccttccaggaggagagcgccttcatcagcgaggccgccgcccccagacagggcaacatgtacaccctgagcaaggacagcctgagcaacggcgtgcccagcggcagacaggccgagttcagctag

SEQ ID NO: 105420 - DNA, 2916 bp, Artificial Sequence
  Description of Artificial Sequence: Synthetic coding sequence
atgttccccatgcagaagggcagcctgaacctgctgagacagaagtgggagagctgcgactaccagagaagcgagtgccaccccagagacagccactgcaccatcttccagccccaggagagcaagctgctggcccccgagggcgaggtggtgagcgccccccagagcctggaccccaccagcctgccctacagcaccggcgaggagatgtggagcagcaagcccgaggagaaggacagcgtggacaagagcaacaacaccagagagtacggcagacccgaggtgctgaaggaggacagcctgagcagcagaagaagaatcgagagattcagcatcgccctggacgagctgagaagcgtgttcgaggcccccaagagcggcaacaagcccgccgagtacggcggcaaggaggtggagatcgagagaagcctgtgcagccccgccttcaagagccaccccggcagccagctggaggacagcgtgaaggacagcgacaagaagggcaaggagaccagcttcgacaagatgagccccgagagcggccacagcagaatcttcgaggccgtgttcagcaccgaccaggcccagatcctgagactgcacctgcaccccaagctgaccaagacccccaagaacagcctgaagagcagcacctacatcagcaccgccggccccaacaagcccgagagcggcttcgccgaggacagcgccgccagaggcgagggcgtgagcgacctgcacgaggtggtgagcctgaaggagagaatggccagataccaggccgccgtgagcagaggcgactgcagaagcttcagcgccaacatgatggaggagagcgagatgtgcgccgtgcccggcggcctggccaaggtgaagaagcagttcgaggacgagatcaccagcagcagaaacaccttcgcccagtaccagtaccagcaccagaacagaagcgagcaggaggccatccacagcagccaggtgggcaccagcagaagcagccaggagatggccagaaacgagcaggagggcagcaaggtgcagaagatcgacgtgcacggcaccgagatggtgagccacctggagaagcacaccgaggaggtgaaccaggccagccagttccaccagtacgtgcaggagaccgtgatcgacacccccgaggacgaggagatccccaaggtgagcaccaagctgctgaaggagcagttcgagaagagcgcccaggagaagatcctgtacagcgacaaggagatgaccacccccgccaagcagatcaagaagctgctgctgcaggacaaggagatctgcatcctgtgccagaagaccgtgtaccccatggagtgcctggtggccgacaagcagaacttccacaagagctgcttcagatgccaccactgcaacagcaagctgagcctgggcaactacgccagcctgcacggccagatctactgcaagccccacttcaagcagctgttcaagagcaagggcaactacgacgagggcttcggccacaagcagcacaaggacagatggaactgcaagaaccagagcagaagcgtggacttcatccccaacgaggagcccaacatgtgcaagaacatcgccgagaacaccctggtgcccggcgacagaaacgagcacctggacgccggcaacagcgagggccagagaaacgacctgagaaagctgggcgagagaggcaagctgaaggtgatctggccccccagcaaggagatccccaagaagaccctgcccttcgaggaggagctgaagatgagcaagcccaagtggccccccgagatgaccaccctgctgagccccgagttcaagagcgagagcctgctggaggacgtgagaacccccgagaacaagggccagagacaggaccacttccccttcctgcagccctacctgcagagcacccacgtgtgccagaaggaggacgtgatcggcatcaaggagatgaagatgcccgagggcagaaaggacgagaagaaggagggcagaaagaacgtgcaggacagacccagcgaggccgaggacaccaagagcaacagaaagagcgccatggacctgaacgacaacaacaacgtgatcgtgcagagcgccgagaaggagaagaacgagaagaccaaccagaccaacggcgccgaggtgctgcaggtgaccaacaccgacgacgagatgatgcccgagaaccacaaggagaacctgaacaagaacaacaacaacaactacgtggccgtgagctacctgaacaactgcagacagaagaccagcatcctggagttcctggacctgctgcccctgagcagcgaggccaacgacaccgccaacgagtacgagatcgagaagctggagaacaccagcagaatcagcgagctgctgggcatcttcgagagcgagaagacctacagcagaaacgtgctggccatggccctgaagaagcagaccgacagagccgccgccggcagccccgtgcagcccgcccccaagcccagcctgagcagaggcctgatggtgaagggcggcagcagcatcatcagccccgacaccaacctgctgaacatcaagggcagccacagcaagagcaagaacctgcacttcttcttcagcaacaccgtgaagatcaccgccttcagcaagaagaacgagaacatcttcaactgcgacctgatcgacagcgtggaccagatcaagaacatgccctgcctggacctgagagagttcggcaaggacgtgaagccctggcacgtggagaccaccgaggccgccagaaacaacgagaacaccggcttcgacgccctgagccacgagtgcaccgccaagcccctgttccccagagtggaggtgcagagcgagcagctgaccgtggaggagcagatcaagagaaacagatgctacagcgacaccgagtag

SEQ ID NO: 105421 - DNA, 2916 bp, Artificial Sequence; identical to SEQ ID NO: 105420
  Description of Artificial Sequence: Synthetic coding sequence

SEQ ID NO: 105422 - DNA, 1380 bp, Artificial Sequence
  Description of Artificial Sequence: Synthetic coding sequence
atggagaccgtgttcgaggagatggacgaggagagcaccggcggcgtgagcagcagcaaggaggagatcgtgctgggccagagactgcacctgagcttccccttcagcatcatcttcagcaccgtgctgtactgcggcgaggtggccttcggcctgtacatgttcgagatctacagaaaggccaacgacaccttctggatgagcttcaccatcagcttcatcatcgtgggcgccatcctggaccagatcatcctgatgttcttcaacaaggacctgagaagaaacaaggccgccctgctgttctggcacatcctgctgctgggccccatcgtgagatgcctgcacaccatcagaaactaccacaagtggctgaagaacctgaagcaggagaaggaggagacccaggtgagcatcaccaagagaaacaccatgctggagagagagatcgccttcagcatcagagacaacttcatgcagcagaaggccttcaagtacatgagcgtgatccaggccttcctgggcagcgtgccccagctgatcctgcagatgtacatcagcctgaccatcagagagtggcccctgaacagagccctgctgatgaccttcagcctgctgagcgtgacctacggcgccatcagatgcaacatcctggccatccagatcagcaacgacgacaccaccatcaagctgccccccatcgagttcttctgcgtggtgatgtggagattcctggaggtgatcagcagagtggtgaccctggccttcttcatcgccagcctgaagctgaagagcctgcccgtgctgctgatcatctacttcgtgagcctgctggccccctggctggagttctggaagagcggcgcccacctgcccggcaacaaggagaacaacagcaacatggtgggcaccgtgctgatgctgttcctgatcaccctgctgtacgccgccatcaacttcagctgctggagcgccgtgaagctgcagctgagcgacgacaagatcatcgacggcagacagagatggggccacagaatcctgcactacagcttccagttcctggagaacgtgatcatgatcctggtgttcagattcttcggcggcaagaccctgctgaactgctgcgacagcctgatcgccgtgcagctgatcatcagctacctgctggccaccggcttcatgctgctgttctaccagtacctgtacccctggcagagcggcaaggtgctgcccggcagaaccgagaaccagcccgaggccccctactactacgtgaacatcgagaagaccgagaagaacaagaacaagcagctgagaaactactgccacagctgcaacagagtgggctacttcagcatcagaaagagcatgacctgcagctag

SEQ ID NO: 105423 - DNA, 1389 bp, Artificial Sequence
  Description of Artificial Sequence: Synthetic coding sequence
atgaacaccagaccccagcacagcgagagaaccagcaccatggacagagtgtacgagatccccgaggagcccaacgtggaccccgtgagcagcctggaggaggacgtgatcagaggcgccaaccccagattcaccttccccttcagcatcctgttcagcaccttcctgtactgcggcgaggccgccagcgccctgtacatggtgagaatctacagaaagaacagcgagacctactggatgacctacaccttcagcttcttcatgttcagcagcatcatggtgcagctgaccctgatcttcgtgcacagagacctggccaaggacaagcccctgagcctgttcatgcacctgatcctgctgggccccgtgatcagatgcctggaggccatgatcaagtacctgaccctgtggaagaaggaggagcaggaggagccctacgtgagcctgaccagaaagaagatgctgatcgacggcgaggaggtgctgatcgagtgggaggtgggccacagcatcagaaccctggccatgcacagaaacgcctacaagagaatgagccagatccaggccttcctgggcagcgtgccccagctgacctaccagctgtacgtgagcctgatcagcgccgaggtgcccctgggcagagtggtgctgatggtgttcagcctggtgagcgtgacctacggcgccaccctgtgcaacatgctggccatccagatcaagtacgacgactacaagatcagactgggccccctggaggtgctgtgcatcaccatctggagaaccctggagatcaccagcagactgctgatcctggtgctgttcagcgccaccctgaagctgaaggccgtgcccttcctggtgctgaacttcctgatcatcctgttcgagccctggatcaagttctggagaagcggcgcccagatgcccaacaacatcgagaagaacttcagcagagtgggcaccctggtggtgctgatcagcgtgaccatcctgtacgccggcatcaacttcagctgctggagcgccctgcagctgagactggccgacagagacctggtggacaagggccagaactggggccacatgggcctgcactacagcgtgagactggtggagaacgtgatcatggtgctggtgttcaagttcttcggcgtgaaggtgctgctgaactactgccacagcctgatcgccctgcagctgatcatcgcctacctgatcagcatcggcttcatgctgctgttcttccagtacctgcaccccctgagaagcctgttcacccacaacgtggtggactacctgcactgcgtgtgctgccaccagcaccccagaaccagagtggagaacagcgagccccccttcgagaccgaggccagacagagcgtggtgtag

SEQ ID NO: 105424 - DNA, 1350 bp, Artificial Sequence
  Description of Artificial Sequence: Synthetic coding sequence
atggacagagtgtacgagatccccgaggagcccaacgtggaccccgtgagcagcctggaggaggacgtgatcagaggcgccaaccccagattcaccttccccttcagcatcctgttcagcaccttcctgtactgcggcgaggccgccagcgccctgtacatggtgagaatctacagaaagaacagcgagacctactggatgacctacaccttcagcttcttcatgttcagcagcatcatggtgcagctgaccctgatcttcgtgcacagagacctggccaaggacaagcccctgagcctgttcatgcacctgatcctgctgggccccgtgatcagatgcctggaggccatgatcaagtacctgaccctgtggaagaaggaggagcaggaggagccctacgtgagcctgaccagaaagaagatgctgatcgacggcgaggaggtgctgatcgagtgggaggtgggccacagcatcagaaccctggccatgcacagaaacgcctacaagagaatgagccagatccaggccttcctgggcagcgtgccccagctgacctaccagctgtacgtgagcctgatcagcgccgaggtgcccctgggcagagtggtgctgatggtgttcagcctggtgagcgtgacctacggcgccaccctgtgcaacatgctggccatccagatcaagtacgacgactacaagatcagactgggccccctggaggtgctgtgcatcaccatctggagaaccctggagatcaccagcagactgctgatcctggtgctgttcagcgccaccctgaagctgaaggccgtgcccttcctggtgctgaacttcctgatcatcctgttcgagccctggatcaagttctggagaagcggcgcccagatgcccaacaacatcgagaagaacttcagcagagtgggcaccctggtggtgctgatcagcgtgaccatcctgtacgccggcatcaacttcagctgctggagcgccctgcagctgagactggccgacagagacctggtggacaagggccagaactggggccacatgggcctgcactacagcgtgagactggtggagaacgtgatcatggtgctggtgttcaagttcttcggcgtgaaggtgctgctgaactactgccacagcctgatcgccctgcagctgatcatcgcctacctgatcagcatcggcttcatgctgctgttcttccagtacctgcaccccctgagaagcctgttcacccacaacgtggtggactacctgcactgcgtgtgctgccaccagcaccccagaaccagagtggagaacagcgagccccccttcgagaccgaggccagacagagcgtggtgtag

SEQ ID NO: 105425 - DNA, 1335 bp, Artificial Sequence
  Description of Artificial Sequence: Synthetic coding sequence
atgaagttccccgccagcgtgctggccagcgtgttcctgttcgtggccgagaccaccgccgccctgagcctgagcagcacctacagaagcggcggcgacagaatgtggcaggccctgaccctgctgttcagcctgctgccctgcgccctggtgcagctgaccctgctgttcgtgcacagagacctgagcagagacagacccctggtgctgctgctgcacctgctgcagctgggccccctgttcagatgcttcgaggtgttctgcatctacttccagagcggcaacaacgaggagccctacgtgagcatcaccaagaagagacagatgcccaagaacggcctgagcgaggagatcgagaaggaggtgggccaggccgagggcaagctgatcacccacagaagcgccttcagcagagccagcgtgatccaggccttcctgggcagcgccccccagctgaccctgcagctgtacatcagcgtgatgcagcaggacgtgaccgtgggcagaagcctgctgatgaccatcagcctgctgagcatcgtgtacggcgccctgagatgcaacatcctggccatcaagatcaagtacgacgagtacgaggtgaaggtgaagcccctggcctacgtgtgcatcttcctgtggagaagcttcgagatcgccaccagagtggtggtgctggtgctgttcaccagcgtgctgaagacctgggtggtggtgatcatcctgatcaacttcttcagcttcttcctgtacccctggatcctgttctggtgcagcggcagccccttccccgagaacatcgagaaggccctgagcagagtgggcaccaccatcgtgctgtgcttcctgaccctgctgtacaccggcatcaacatgttctgctggagcgccgtgcagctgaagatcgacagccccgacctgatcagcaagagccacaactggtaccagctgctggtgtactacatgatcagattcatcgagaacgccatcctgctgctgctgtggtacctgttcaagaccgacatctacatgtacgtgtgcgcccccctgctggtgctgcagctgctgatcggctactgcaccgccatcctgttcatgctggtgttctaccagttcttccacccctgcaagaagctgttcagcagcagcgtgagcgagggcttccagagatggctgagatgcttctgctgggcctgcagacagcagaagccctgcgagcccatcggcaaggaggacctgcagagcagcagagacagagacgagacccccagcagcagcaagaccagccccgagcccggccagttcctgaacgccgaggacctgtgcagcgcctag

SEQ ID NO: 105426 - DNA, 1929 bp, Artificial Sequence
  Description of Artificial Sequence: Synthetic coding sequence
atggccgccagcagaaagccccccagagtgagagtgaaccaccaggacttccagctgagaaacctgagaatcatcgagcccaacgaggtgacccacagcggcgacaccggcgtggagaccgacggcagaatgccccccaaggtgaccagcgagctgctgagacagctgagacaggccatgagaaacagcgagtacgtgaccgagcccatccaggcctacatcatccccagcggcgacgcccaccagagcgagtacatcgccccctgcgactgcagaagagccttcgtgagcggcttcgacggcagcgccggcaccgccatcatcaccgaggagcacgccgccatgtggaccgacggcagatacttcctgcaggccgccaagcagatggacagcaactggaccctgatgaagatgggcctgaaggacacccccacccaggaggactggctggtgagcgtgctgcccgagggcagcagagtgggcgtggaccccctgatcatccccaccgactactggaagaagatggccaaggtgctgagaagcgccggccaccacctgatccccgtgaaggagaacctggtggacaagatctggaccgacagacccgagagaccctgcaagcccctgctgaccctgggcctggactacaccggcatcagctggaaggacaaggtggccgacctgagactgaagatggccgagagaaacgtgatgtggttcgtggtgaccgccctggacgagatcgcctggctgttcaacctgagaggcagcgacgtggagcacaaccccgtgttcttcagctacgccatcatcggcctggagaccatcatgctgttcatcgacggcgacagaatcgacgcccccagcgtgaaggagcacctgctgctggacctgggcctggaggccgagtacagaatccaggtgcacccctacaagagcatcctgagcgagctgaaggccctgtgcgccgacctgagccccagagagaaggtgtgggtgagcgacaaggccagctacgccgtgagcgagaccatccccaaggaccacagatgctgcatgccctacacccccatctgcatcgccaaggccgtgaagaacagcgccgagagcgagggcatgagaagagcccacatcaaggacgccgtggccctgtgcgagctgttcaactggctggagaaggaggtgcccaagggcggcgtgaccgagatcagcgccgccgacaaggccgaggagttcagaagacagcaggccgacttcgtggacctgagcttccccaccatcagcagcaccggccccaacggcgccatcatccactacgccgacggcaccaccgacgtgaccagaaccatgcacttcggcacccccaccgcctacgagaaggagtgcttcacctacgtgctgaagggccacatcgccgtgagcgccgccgtgttccccaccggcaccaagggccacctgctggacagcttcgccagaagcgccctgtgggacagcggcctggactacctgcacggcaccggccacggcgtgggcagcttcctgaacgtgcacgagggcccctgcggcatcagctacaagaccttcagcgacgagcccctggaggccggcatgatcgtgaccgacgagcccggctactacgaggacggcgccttcggcatcagaatcgagaacgtggtgctggtggtgcccgtgaagaccaagtacaacttcaacaacagaggcagcctgaccttcgagcccctgaccctggtgcccatccagaccaagatgatcgacgtggacagcctgaccgacaaggagtgcgactggctgaacaactaccacctgacctgcagagacgtgatcggcaaggagctgcagaagcagggcagacaggaggccctggagtggctgatcagagagacccagcccatcagcaagcagcactag

SEQ ID NO: 105427 - DNA, 1872 bp, Artificial Sequence
  Description of Artificial Sequence: Synthetic coding sequence
atgccccccaaggtgaccagcgagctgctgagacagctgagacaggccatgagaaacagcgagtacgtgaccgagcccatccaggcctacatcatccccagcggcgacgcccaccagagcgagtacatcgccccctgcgactgcagaagagccttcgtgagcggcttcgacggcagcgccggcaccgccatcatcaccgaggagcacgccgccatgtggaccgacggcagatacttcctgcaggccgccaagcagatggacagcaactggaccctgatgaagatgggcctgaaggacacccccacccaggaggactggctggtgagcgtgctgcccgagggcagcagagtgggcgtggaccccctgatcatccccaccgactactggaagaagatggccaaggtgctgagaagcgccggccaccacctgatccccgtgaaggagaacctggtggacaagatctggaccgacagacccgagagaccctgcaagcccctgctgaccctgggcctggactacaccggcatcagctggaaggacaaggtggccgacctgagactgaagatggccgagagaaacgtgatgtggttcgtggtgaccgccctggacgagatcgcctggctgttcaacctgagaggcagcgacgtggagcacaaccccgtgttcttcagctacgccatcatcggcctggagaccatcatgctgttcatcgacggcgacagaatcgacgcccccagcgtgaaggagcacctgctgctggacctgggcctggaggccgagtacagaatccaggtgcacccctacaagagcatcctgagcgagctgaaggccctgtgcgccgacctgagccccagagagaaggtgtgggtgagcgacaaggccagctacgccgtgagcgagaccatccccaaggaccacagatgctgcatgccctacacccccatctgcatcgccaaggccgtgaagaacagcgccgagagcgagggcatgagaagagcccacatcaaggacgccgtggccctgtgcgagctgttcaactggctggagaaggaggtgcccaagggcggcgtgaccgagatcagcgccgccgacaaggccgaggagttcagaagacagcaggccgacttcgtggacctgagcttccccaccatcagcagcaccggccccaacggcgccatcatccactacgcccccgtgcccgagaccaacagaaccctgagcctggacgaggtgtacctgatcgacagcggcgcccagtacaaggacggcaccaccgacgtgaccagaaccatgcacttcggcacccccaccgcctacgagaaggagtgcttcacctacgtgctgaagggccacatcgccgtgagcgccgccgtgttccccaccggcaccaagggccacctgctggacagcttcgccagaagcgccctgtgggacagcggcctggactacctgcacggcaccggccacggcgtgggcagcttcctgaacgtgcacgagggcccctgcggcatcagctacaagaccttcagcgacgagcccctggaggccggcatgatcgtgaccgacgagcccggctactacgaggacggcgccttcggcatcagaatcgagaacgtggtgctggtggtgcccgtgaagaccaagtacaacttcaacaacagaggcagcctgaccttcgagcccctgaccctggtgcccatccagaccaagatgatcgacgtggacagcctgaccgacaaggagtgcgactggctgaacaactaccacctgacctgcagagacgtgatcggcaaggagctgcagaagcagggcagacaggaggccctggagtggctgatcagagagacccagcccatcagcaagcagcactag

SEQ ID NO: 105428 - DNA, 1659 bp, Artificial Sequence
  Description of Artificial Sequence: Synthetic coding sequence
atgtggaccgacggcagatacttcctgcaggccgccaagcagatggacagcaactggaccctgatgaagatgggcctgaaggacacccccacccaggaggactggctggtgagcgtgctgcccgagggcagcagagtgggcgtggaccccctgatcatccccaccgactactggaagaagatggccaaggtgctgagaagcgccggccaccacctgatccccgtgaaggagaacctggtggacaagatctggaccgacagacccgagagaccctgcaagcccctgctgaccctgggcctggactacaccggcatcagctggaaggacaaggtggccgacctgagactgaagatggccgagagaaacgtgatgtggttcgtggtgaccgccctggacgagatcgcctggctgttcaacctgagaggcagcgacgtggagcacaaccccgtgttcttcagctacgccatcatcggcctggagaccatcatgctgttcatcgacggcgacagaatcgacgcccccagcgtgaaggagcacctgctgctggacctgggcctggaggccgagtacagaatccaggtgcacccctacaagagcatcctgagcgagctgaaggccctgtgcgccgacctgagccccagagagaaggtgtgggtgagcgacaaggccagctacgccgtgagcgagaccatccccaaggaccacagatgctgcatgccctacacccccatctgcatcgccaaggccgtgaagaacagcgccgagagcgagggcatgagaagagcccacatcaaggacgccgtggccctgtgcgagctgttcaactggctggagaaggaggtgcccaagggcggcgtgaccgagatcagcgccgccgacaaggccgaggagttcagaagacagcaggccgacttcgtggacctgagcttccccaccatcagcagcaccggccccaacggcgccatcatccactacgcccccgtgcccgagaccaacagaaccctgagcctggacgaggtgtacctgatcgacagcggcgcccagtacaaggacggcaccaccgacgtgaccagaaccatgcacttcggcacccccaccgcctacgagaaggagtgcttcacctacgtgctgaagggccacatcgccgtgagcgccgccgtgttccccaccggcaccaagggccacctgctggacagcttcgccagaagcgccctgtgggacagcggcctggactacctgcacggcaccggccacggcgtgggcagcttcctgaacgtgcacgagggcccctgcggcatcagctacaagaccttcagcgacgagcccctggaggccggcatgatcgtgaccgacgagcccggctactacgaggacggcgccttcggcatcagaatcgagaacgtggtgctggtggtgcccgtgaagaccaagtacaacttcaacaacagaggcagcctgaccttcgagcccctgaccctggtgcccatccagaccaagatgatcgacgtggacagcctgaccgacaaggagtgcgactggctgaacaactaccacctgacctgcagagacgtgatcggcaaggagctgcagaagcagggcagacaggaggccctggagtggctgatcagagagacccagcccatcagcaagcagcactag

SEQ ID NO: 105429 - DNA, 912 bp, Artificial Sequence
  Description of Artificial Sequence: Synthetic coding sequence
atgccccccaaggtgaccagcgagctgctgagacagctgagacaggccatgagaaacagcgagtacgtgaccgagcccatccaggcctacatcatccccagcggcgacgcccaccagagcgagtacatcgccccctgcgactgcagaagagccttcgtgagcggcttcgacggcagcgccggcaccgccatcatcaccgaggagcacgccgccatgtggaccgacggcagatacttcctgcaggccgccaagcagatggacagcaactggaccctgatgaagatgggcctgaaggacacccccacccaggaggactggctggtgagcgtgctgcccgagggcagcagagtgggcgtggaccccctgatcatccccaccgactactggaagaagatggccaaggtgctgagaagcgccggccaccacctgatccccgtgaaggagaacctggtggacaagatctggaccgacagacccgagagaccctgcaagcccctgctgaccctgggcctggactacaccggcatcagctggaaggacaaggtggccgacctgagactgaagatggccgagagaaacgtgatgtggttcgtggtgaccgccctggacgagatcgcctggctgttcaacctgagaggcagcgacgtggagcacaaccccgtgttcttcagctacgccatcatcggcctggagaccatcatgctgttcatcgacggcgacagaatcgacgcccccagcgtgaaggagcacctgctgctggacctgggcctggaggccgagtacagaatccaggtgcacccctacaagagcatcctgagcgagctgaaggccctgtgcgccgacctgagccccagagagaaggtgtgggtgagcgacaaggccagctacgccgtgagcgagaccatcccctag

SEQ ID NO: 105430 - DNA, 2001 bp, Artificial Sequence
  Description of Artificial Sequence: Synthetic coding sequence
atggccgccagcagaaagccccccagagtgagagtgaaccaccaggacttccagctgagaaacctgagaatcatcgagcccaacgaggtgacccacagcggcgacaccggcgtggagaccgacggcagaatgccccccaaggtgaccagcgagctgctgagacagctgagacaggccatgagaaacagcgagtacgtgaccgagcccatccaggcctacatcatccccagcggcgacgcccaccagagcgagtacatcgccccctgcgactgcagaagagccttcgtgagcggcttcgacggcagcgccggcaccgccatcatcaccgaggagcacgccgccatgtggaccgacggcagatacttcctgcaggccgccaagcagatggacagcaactggaccctgatgaagatgggcctgaaggacacccccacccaggaggactggctggtgagcgtgctgcccgagggcagcagagtgggcgtggaccccctgatcatccccaccgactactggaagaagatggccaaggtgctgagaagcgccggccaccacctgatccccgtgaaggagaacctggtggacaagatctggaccgacagacccgagagaccctgcaagcccctgctgaccctgggcctggactacaccggcatcagctggaaggacaaggtggccgacctgagactgaagatggccgagagaaacgtgatgtggttcgtggtgaccgccctggacgagatcgcctggctgttcaacctgagaggcagcgacgtggagcacaaccccgtgttcttcagctacgccatcatcggcctggagaccatcatgctgttcatcgacggcgacagaatcgacgcccccagcgtgaaggagcacctgctgctggacctgggcctggaggccgagtacagaatccaggtgcacccctacaagagcatcctgagcgagctgaaggccctgtgcgccgacctgagccccagagagaaggtgtgggtgagcgacaaggccagctacgccgtgagcgagaccatccccaaggaccacagatgctgcatgccctacacccccatctgcatcgccaaggccgtgaagaacagcgccgagagcgagggcatgagaagagcccacatcaaggacgccgtggccctgtgcgagctgttcaactggctggagaaggaggtgcccaagggcggcgtgaccgagatcagcgccgccgacaaggccgaggagttcagaagacagcaggccgacttcgtggacctgagcttccccaccatcagcagcaccggccccaacggcgccatcatccactacgcccccgtgcccgagaccaacagaaccctgagcctggacgaggtgtacctgatcgacagcggcgcccagtacaaggacggcaccaccgacgtgaccagaaccatgcacttcggcacccccaccgcctacgagaaggagtgcttcacctacgtgctgaagggccacatcgccgtgagcgccgccgtgttccccaccggcaccaagggccacctgctggacagcttcgccagaagcgccctgtgggacagcggcctggactacctgcacggcaccggccacggcgtgggcagcttcctgaacgtgcacgagggcccctgcggcatcagctacaagaccttcagcgacgagcccctggaggccggcatgatcgtgaccgacgagcccggctactacgaggacggcgccttcggcatcagaatcgagaacgtggtgctggtggtgcccgtgaagaccaagtacaacttcaacaacagaggcagcctgaccttcgagcccctgaccctggtgcccatccagaccaagatgatcgacgtggacagcctgaccgacaaggagtgcgactggctgaacaactaccacctgacctgcagagacgtgatcggcaaggagctgcagaagcagggcagacaggaggccctggagtggctgatcagagagacccagcccatcagcaagcagcactag

SEQ ID NO: 105431 - DNA, 552 bp, Artificial Sequence
  Description of Artificial Sequence: Synthetic coding sequence
atggccagagcccactggggctgctgcccctggctggtgctgctgtgcgcctgcgcctggggccacaccaagcccgtggacctgggcggccaggacgtgagaaactgcagcaccaaccccccctacctgcccgtgaccgtggtgaacaccaccatgagcctgaccgccctgagacagcagatgcagacccagaacctgagcgcctacatcatccccggcaccgacgcccacatgaacgagtacatcggccagcacgacgagagaagagcctggatcaccggcttcaccggcagcgccggcaccgccgtggtgaccatgaagaaggccgccgtgtggaccgacagcagatactggacccaggccgagagacagatggactgcaactgggagctgcacaaggaggtgggcaccacccccatcgtgacctggctgctgaccgagatccccgccggcggcagagtgggcttcgaccccttcctgctgagcatcggcatgctgttcctgcagagcctgaacctgagcatgctgaccagagtgacccagctgccctag

SEQ ID NO: 105432 - DNA, 2025 bp, Artificial Sequence
  Description of Artificial Sequence: Synthetic coding sequence
atggccagagcccactggggctgctgcccctggctggtgctgctgtgcgcctgcgcctggggccacaccaagcccgtggacctgggcggccaggacgtgagaaactgcagcaccaaccccccctacctgcccgtgaccgtggtgaacaccaccatgagcctgaccgccctgagacagcagatgcagacccagaacctgagcgcctacatcatccccggcaccgacgcccacatgaacgagtacatcggccagcacgacgagagaagagcctggatcaccggcttcaccggcagcgccggcaccgccgtggtgaccatgaagaaggccgccgtgtggaccgacagcagatactggacccaggccgagagacagatggactgcaactgggagctgcacaaggaggtgggcaccacccccatcgtgacctggctgctgaccgagatccccgccggcggcagagtgggcttcgaccccttcctgctgagcatcgacacctgggagagctacgacctggccctgcagggcagcaacagacagctggtgagcatcaccaccaacctggtggacctggtgtggggcagcgagagaccccccgtgcccaaccagcccatctacgccctgcaggaggccttcaccggcagcacctggcaggagaaggtgagcggcgtgagaagccagatgcagaagcaccagaaggtgcccaccgccgtgctgctgagcgccctggaggagaccgcctggctgttcaacctgagagccagcgacatcccctacaaccccttcttctacagctacaccctgctgaccgacagcagcatcagactgttcgccaacaagagcagattcagcagcgagaccctgagctacctgaacagcagctgcaccggccccatgtgcgtgcagatcgaggactacagccaggtgagagacagcatccaggcctacagcctgggcgacgtgagaatctggatcggcaccagctacaccatgtacggcatctacgagatgatccccaaggagaagctggtgaccgacacctacagccccgtgatgatgaccaaggccgtgaagaacagcaaggagcaggccctgctgaaggccagccacgtgagagacgccgtggccgtgatcagatacctggtgtggctggagaagaacgtgcccaagggcaccgtggacgagttcagcggcgccgagatcgtggacaagttcagaggcgaggagcagttcagcagcggccccagcttcgagaccatcagcgccagcggcctgaacgccgccctggcccactacagccccaccaaggagctgaacagaaagctgagcagcgacgagatgtacctgctggacagcggcggccagtactgggacggcaccaccgacatcaccagaaccgtgcactggggcacccccagcgccttccagaaggaggcctacaccagagtgctgatcggcaacatcgacctgagcagactgatcttccccgccgccaccagcggcagaatggtggaggccttcgccagaagagccctgtgggacgccggcctgaactacggccacggcaccggccacggcatcggcaacttcctgtgcgtgcacgagtggcccgtgggcttccagagcaacaacatcgccatggccaagggcatgttcaccagcatcgagcccggctactacaaggacggcgagttcggcatcagactggaggacgtggccctggtggtggaggccaagaccaagtaccccggcagctacctgaccttcgaggtggtgagcttcgtgccctacgacagaaacctgatcgacgtgagcctgctgagccccgagcacctgcagtacctgaacagatactaccagaccatcagagagaaggtgggccccgagctgcagagaagacagctgctggaggagttcgagtggctgcagcagcacaccgagcccctggccgccagagcccccgacaccgccagctgggccagcgtgctggtggtgagcaccctggccatcctgggctggagcgtgtag

SEQ ID NO: 105433 - DNA, 1524 bp, Artificial Sequence
  Description of Artificial Sequence: Synthetic coding sequence
atgccctggctgctgagcgcccccaagctggtgcccgccgtggccaacgtgagaggcctgagcggctgcatgctgtgcagccagagaagatacagcctgcagcccgtgcccgagagaagaatccccaacagatacctgggccagcccagccccttcacccacccccacctgctgagacccggcgaggtgacccccggcctgagccaggtggagtacgccctgagaagacacaagctgatgagcctgatccagaaggaggcccagggccagagcggcaccgaccagaccgtggtggtgctgagcaaccccacctactacatgagcaacgacatcccctacaccttccaccaggacaacaacttcctgtacctgtgcggcttccaggagcccgacagcatcctggtgctgcagagcctgcccggcaagcagctgcccagccacaaggccatcctgttcgtgcccagaagagaccccagcagagagctgtgggacggccccagaagcggcaccgacggcgccatcgccctgaccggcgtggacgaggcctacaccctggaggagttccagcacctgctgcccaagatgaaggccgagaccaacatggtgtggtacgactggatgagacccagccacgcccagctgcacagcgactacatgcagcccctgaccgaggccaaggccaagagcaagaacaaggtgagaggcgtgcagcagctgatccagagactgagactgatcaagagccccgccgagatcgagagaatgcagatcgccggcaagctgaccagccaggccttcatcgagaccatgttcaccagcaaggcccccgtggaggaggccttcctgtacgccaagttcgagttcgagtgcagagccagaggcgccgacatcctggcctacccccccgtggtggccggcggcaacagaagcaacaccctgcactacgtgaagaacaaccagctgatcaaggacggcgagatggtgctgctggacggcggctgcgagagcagctgctacgtgagcgacatcaccagaacctggcccgtgaacggcagattcaccgccccccaggccgagctgtacgaggccgtgctggagatccagagagactgcctggccctgtgcttccccggcaccagcctggagaacatctacagcatgatgctgaccctgatcggccagaagctgaaggacctgggcatcatgaagaacatcaaggagaacaacgccttcaaggccgccagaaagtactgcccccaccacgtgggccactacctgggcatggacgtgcacgacacccccgacatgcccagaagcctgcccctgcagcccggcatggtgatcaccatcgagcccggcatctacatccccgaggacgacaaggacgcccccgagaagttcagaggcctgggcgtgagaatcgaggacgacgtggtggtgacccaggacagccccctgatcctgagcgccgactgccccaaggagatgaacgacatcgagcagatctgcagccaggccagctag

SEQ ID NO: 105434 - DNA, 837 bp, Artificial Sequence
  Description of Artificial Sequence: Synthetic coding sequence
atgccctggctgctgagcgcccccaagctggtgcccgccgtggccaacgtgagaggcctgagcggctgcatgctgtgcagccagagaagatacagcctgcagcccgtgcccgagagaagaatccccaacagatacctgggccagcccagccccttcacccacccccacctgctgagacccggcgaggtgacccccggcctgagccaggtggagtacgccctgagaagacacaagctgatgagcctgatccagaaggaggcccagggccagagcggcaccgaccagaccgtggtggtgctgagcaaccccacctactacatgagcaacgacatcccctacaccttccaccaggacaacaacttcctgtacctgtgcggcttccaggagcccgacagcatcctggtgctgcagagcctgcccggcaagcagctgcccagccacaaggccatcctgttcgtgcccagaagagaccccagcagagagctgtgggacggccccagaagcggcaccgacggcgccatcgccctgaccggcgtggacgaggcctacaccctggaggagttccagcacctgctgcccaagatgaaggccgagaccaacatggtgtggtacgactggatgagacccagccacgcccagctgcacagcgactacatgcagcccctgaccgaggccaaggccaagagcaagaacaaggtgagaggcgtgcagcagctgatccagagactgagactgatcaagagccccgccgagatcgagagaatgcagatcgccggcaagctgaccagccagagacagggcttcagcgtgctgagcagactggtgagcaacagctag

SEQ ID NO: 105435 - DNA, 867 bp, Artificial Sequence
  Description of Artificial Sequence: Synthetic coding sequence
atgccctggctgctgagcgcccccaagctggtgcccgccgtggccaacgtgagaggcctgagcggctgcatgctgtgcagccagagaagatacagcctgcagcccgtgcccgagagaagaatccccaacagatacctgggccagcccagccccttcacccacccccacctgctgagacccggcgaggtgacccccggcctgagccaggtggagtacgccctgagaagacacaagctgatgagcctgatccagaaggaggcccagggccagagcggcaccgaccagaccgtggtggtgctgagcaaccccacctactacatgagcaacgacatcccctacaccttccaccaggacaacaacttcctgtacctgtgcggcttccaggagcccgacagcatcctggtgctgcagagcctgcccggcaagcagctgcccagccacaaggccatcctgttcgtgcccagaagagaccccagcagagagctgtgggacggccccagaagcggcaccgacggcgccatcgccctgaccggcgtggacgaggcctacaccctggaggagttccagcacctgctgcccaagatgaaggccgagaccaacatggtgtggtacgactggatgagacccagccacgcccagctgcacagcgactacatgcagcccctgaccgaggccaaggccaagagcaagaacaaggtgagaggcgtgcagcagctgatccagagactgagactgatcaagagccccgccgagatcgagagaatgcagatcgccggcaagctgaccagccagaagagcgtgctgctggccagacacggcggcagcagactgtacagccaccacttcggcagacccagactgagctag

SEQ ID NO: 105436 - DNA, 1455 bp, Artificial Sequence
  Description of Artificial Sequence: Synthetic coding sequence
atgctgtgcagccagagaagatacagcctgcagcccgtgcccgagagaagaatccccaacagatacctgggccagcccagccccttcacccacccccacctgctgagacccggcgaggtgacccccggcctgagccaggtggagtacgccctgagaagacacaagctgatgagcctgatccagaaggaggcccagggccagagcggcaccgaccagaccgtggtggtgctgagcaaccccacctactacatgagcaacgacatcccctacaccttccaccaggacaacaacttcctgtacctgtgcggcttccaggagcccgacagcatcctggtgctgcagagcctgcccggcaagcagctgcccagccacaaggccatcctgttcgtgcccagaagagaccccagcagagagctgtgggacggccccagaagcggcaccgacggcgccatcgccctgaccggcgtggacgaggcctacaccctggaggagttccagcacctgctgcccaagatgaaggccgagaccaacatggtgtggtacgactggatgagacccagccacgcccagctgcacagcgactacatgcagcccctgaccgaggccaaggccaagagcaagaacaaggtgagaggcgtgcagcagctgatccagagactgagactgatcaagagccccgccgagatcgagagaatgcagatcgccggcaagctgaccagccaggccttcatcgagaccatgttcaccagcaaggcccccgtggaggaggccttcctgtacgccaagttcgagttcgagtgcagagccagaggcgccgacatcctggcctacccccccgtggtggccggcggcaacagaagcaacaccctgcactacgtgaagaacaaccagctgatcaaggacggcgagatggtgctgctggacggcggctgcgagagcagctgctacgtgagcgacatcaccagaacctggcccgtgaacggcagattcaccgccccccaggccgagctgtacgaggccgtgctggagatccagagagactgcctggccctgtgcttccccggcaccagcctggagaacatctacagcatgatgctgaccctgatcggccagaagctgaaggacctgggcatcatgaagaacatcaaggagaacaacgccttcaaggccgccagaaagtactgcccccaccacgtgggccactacctgggcatggacgtgcacgacacccccgacatgcccagaagcctgcccctgcagcccggcatggtgatcaccatcgagcccggcatctacatccccgaggacgacaaggacgcccccgagaagttcagaggcctgggcgtgagaatcgaggacgacgtggtggtgacccaggacagccccctgatcctgagcgccgactgccccaaggagatgaacgacatcgagcagatctgcagccaggccagctag

SEQ ID NO: 105437 - DNA, 2379 bp, Artificial Sequence
  Description of Artificial Sequence: Synthetic coding sequence
atggccttcagcggcatctacaagctggacgacggcaagccctacctgaacaactgcttccccgccagaaacctgctgagagtgcccgaggagggccagggccactggctggtggtgcagaagggcaacctgaagaagaagcccaagggcctggtgggcgcccaggccgagagaagagagagcctgaaggccaccagcttcgagttcaagggcaagaaggagagcagaagagagaaccaggtggacctgcccggccacatcctggaccaggccttcctgctgaagcaccactgcgtgagaaagcccagcgacctgtgcaccatcaacgccaaggagaacgacttcaagcacttccacagcgtgatctacatcaacgccagcgagaacctgctgcccctggaggccttccacaccttccccgccctgaaggagctggacctggccttcaacggcatcaagaccatctacgtgaagtacggcgacttcaagctgctggagttcctggacctgagcttcaacagcctgaccgtggaggccatctgcgacctgggcatcctgccccacctgagagtgctgctgctgaccggcaacggcctgaccagcctgccccccaacctggccgtggccgagcaggaggccagcgtgaccagcctgaccagcaagagatacatcctgagattccccgccctggagaccctgatgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggcagcccccacaaggagccccagttcatgctgcagagcaagcccagaatgctggaggacagcgacgagcagctggactacaccgtgctgcccatgaagaaggacgtggacagaaccgaggtggtgttcagcagctaccccggcttcagcaccagcgagaccaccaagatctgcagcctgccccccatcttcgagatcctgcccgtgaagagcctgaaggccagaaaccagaccctggccccccccttccccgagctgagatacctgagcctggcctacaacaagatcgccaaggaggacgccgtgctgcccgtggccctgttccccagcctgtgcgagttcgtgttccacaacaaccccctggtggcccacaccagaggcgtgccccccctgctgaagagcttcctgcaggagagactgggcatccacctgatcagaagaaagatcgtgaagcccaagcaccacgtgctgatgagcagaaaggagagctggaaggtgaagagcgagatccccaaggtgcccaagcagcccctggtgctgcaccaccccagaatgaccaccaccaagagccccagcaaggacatgctggagcccgaggccgagctggccgaggacctgcccaccaccaagagcaccagcgtggagagcgagatgcccaccgagaacctggagggccacagccccagctgcagaaccttcgtgcccctgccccccatctgcagcaacagcaccgtgcacagcgaggagaccctgagccacctgagcgacaccaccgtgagactgagccccgagagacccagcgacgaggacagcaagagcaccgagagcatcttcctgacccaggtgagcgagctgcccagcagcgtgatccacaaggacgacctggagctgaaggagaaggaccagaagaagccccccaccgcccccagagaggtgaagggcaccagaagaaagctgcccaccgccttcctgcccagcaagtaccacggctacgaggagctgctgaccgccaagcccgaccccgccttcatcgagcccaagggcatccagaagaacgcccaggccctgcagcagatgctgaagcaccccctgctgtgccacagcagcaagcccaagctggacaccctgcagaagccctacgtgcacaaggagaagagagcccagagaatccccatccccccccccaagaagaccagagcccagctgctggacgacatcttcatcagactgagagaccccagaaacatcaccgaggcccccctgggcgccgtgctgcaccagtggaccgagagaagactggtgaaccacaagcagtacctggaggccaagagactgctgaaggagttccaggccagatacagacagctggtgagcggcagcctgagaaccgtgttcggcaccacccccctgcccatggcctgccccgccctgagcgagagccagcccaagttcggccacttcctggagttcatggacgagttctgccaggagcccaccgccagcgacagccagggctag

SEQ ID NO: 105438 - DNA, 2337 bp, Artificial Sequence
  Description of Artificial Sequence: Synthetic coding sequence
atggccttcagcggcatctacaagctggacgacggcaagccctacctgaacaactgcttccccgccagaaacctgctgagagtgcccgaggagggccagggccactggctggtggtgcagaagggcaacctgaagaagaagcccaagggcctggtgggcgcccaggccgagagaagagagagcctgaaggccaccagcttcgagttcaagggcaagaaggagagcagaagagagaaccaggtggacctgcccggccacatcctggaccaggccttcctgctgaagcaccactgcgtgagaaagcccagcgacctgtgcaccatcaacgccaaggagaacgacttcaagcacttccacagcgtgatctacatcaacgccagcgagaacctgctgcccctggaggccttccacaccttccccgccctgaaggagctggacctggccttcaacggcatcaagaccatctacgtgaagtacggcgacttcaagctgctggagttcctggacctgagcttcaacagcctgaccgtggaggccatctgcgacctgggcatcctgccccacctgagagtgctgctgctgaccggcaacggcctgaccagcctgccccccaacctggccgtggccgagcaggaggccagcgtgaccagcctgaccagcaagagatacatcctgagattccccgccctggagaccctgatgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggcagcccccacaaggagccccagttcatgctgcagagcaagcccagaatgctggaggacagcgacgagcagctggactacaccgtgctgcccatgaagaaggacgtggacagaaccaccaccaagatctgcagcctgccccccatcttcgagatcctgcccgtgaagagcctgaaggccagaaaccagaccctggccccccccttccccgagctgagatacctgagcctggcctacaacaagatcgccaaggaggacgccgtgctgcccgtggccctgttccccagcctgtgcgagttcgtgttccacaacaaccccctggtggcccacaccagaggcgtgccccccctgctgaagagcttcctgcaggagagactgggcatccacctgatcagaagaaagatcgtgaagcccaagcaccacgtgctgatgagcagaaaggagagctggaaggtgaagagcgagatccccaaggtgcccaagcagcccctggtgctgcaccaccccagaatgaccaccaccaagagccccagcaaggacatgctggagcccgaggccgagctggccgaggacctgcccaccaccaagagcaccagcgtggagagcgagatgcccaccgagaacctggagggccacagccccagctgcagaaccttcgtgcccctgccccccatctgcagcaacagcaccgtgcacagcgaggagaccctgagccacctgagcgacaccaccgtgagactgagccccgagagacccagcgacgaggacagcaagagcaccgagagcatcttcctgacccaggtgagcgagctgcccagcagcgtgatccacaaggacgacctggagctgaaggagaaggaccagaagaagccccccaccgcccccagagaggtgaagggcaccagaagaaagctgcccaccgccttcctgcccagcaagtaccacggctacgaggagctgctgaccgccaagcccgaccccgccttcatcgagcccaagggcatccagaagaacgcccaggccctgcagcagatgctgaagcaccccctgctgtgccacagcagcaagcccaagctggacaccctgcagaagccctacgtgcacaaggagaagagagcccagagaatccccatccccccccccaagaagaccagagcccagctgctggacgacatcttcatcagactgagagaccccagaaacatcaccgaggcccccctgggcgccgtgctgcaccagtggaccgagagaagactggtgaaccacaagcagtacctggaggccaagagactgctgaaggagttccaggccagatacagacagctggtgagcggcagcctgagaaccgtgttcggcaccacccccctgcccatggcctgccccgccctgagcgagagccagcccaagttcggccacttcctggagttcatggacgagttctgccaggagcccaccgccagcgacagccagggctag

SEQ ID NO: 105439 - DNA, 2211 bp, Artificial Sequence
  Description of Artificial Sequence: Synthetic coding sequence
atggccttcagcggcatctacaagctggacgacggcaagccctacctgaacaactgcttccccgccagaaacctgctgagagtgcccgaggagggccagggccactggctggtggtgcagaagggcaacctgaagaagaagcccaagggcctggtgggcgcccaggccgagagaagagagagcctgaaggccaccagcttcgagttcaagggcaagaaggagagcagaagagagaaccaggtggacctgcccggccacatcctggaccaggccttcctgctgaagcaccactgcgtgagaaagcccagcgacctgtgcaccatcaacgccaaggagaacgacttcaagcacttccacagcgtgatctacatcaacgccagcgagaacctgctgcccctggaggccttccacaccttccccgccctgaaggagctggacctggccttcaacggcatcaagaccatctacgtgaagtacggcgacttcaagctgctggagttcctggacctgagcttcaacagcctgaccgtggaggccatctgcgacctgggcatcctgccccacctgagagtgctgctgctgaccggcaacggcctgaccagcctgccccccaacctggccgtggccgagcaggaggccagcgtgaccagcctgaccagcaagagatacatcctgagattccccgccctggagaccctgatgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggcagcccccacaaggagccccagttcatgctgcagagcaagcccagaatgctggaggacagcgacgagcagctggactacaccgtgctgcccatgaagaaggacgtggacagaaccatcgccaaggaggacgccgtgctgcccgtggccctgttccccagcctgtgcgagttcgtgttccacaacaaccccctggtggcccacaccagaggcgtgccccccctgctgaagagcttcctgcaggagagactgggcatccacctgatcagaagaaagatcgtgaagcccaagcaccacgtgctgatgagcagaaaggagagctggaaggtgaagagcgagatccccaaggtgcccaagcagcccctggtgctgcaccaccccagaatgaccaccaccaagagccccagcaaggacatgctggagcccgaggccgagctggccgaggacctgcccaccaccaagagcaccagcgtggagagcgagatgcccaccgagaacctggagggccacagccccagctgcagaaccttcgtgcccctgccccccatctgcagcaacagcaccgtgcacagcgaggagaccctgagccacctgagcgacaccaccgtgagactgagccccgagagacccagcgacgaggacagcaagagcaccgagagcatcttcctgacccaggtgagcgagctgcccagcagcgtgatccacaaggacgacctggagctgaaggagaaggaccagaagaagccccccaccgcccccagagaggtgaagggcaccagaagaaagctgcccaccgccttcctgcccagcaagtaccacggctacgaggagctgctgaccgccaagcccgaccccgccttcatcgagcccaagggcatccagaagaacgcccaggccctgcagcagatgctgaagcaccccctgctgtgccacagcagcaagcccaagctggacaccctgcagaagccctacgtgcacaaggagaagagagcccagagaatccccatccccccccccaagaagaccagagcccagctgctggacgacatcttcatcagactgagagaccccagaaacatcaccgaggcccccctgggcgccgtgctgcaccagtggaccgagagaagactggtgaaccacaagcagtacctggaggccaagagactgctgaaggagttccaggccagatacagacagctggtgagcggcagcctgagaaccgtgttcggcaccacccccctgcccatggcctgccccgccctgagcgagagccagcccaagttcggccacttcctggagttcatggacgagttctgccaggagcccaccgccagcgacagccagggctag

SEQ ID NO: 105440 - DNA, 891 bp, Artificial Sequence
  Description of Artificial Sequence: Synthetic coding sequence
atggccttcagcggcatctacaagctggacgacggcaagccctacctgaacaactgcttccccgccagaaacctgctgagagtgcccgaggagggccagggccactggctggtggtgcagaagggcaacctgaagaagaagcccaagggcctggtgggcgcccaggccgagagaagagagagcctgaaggccaccagcttcgagttcaagggcaagaaggagagcagaagagagaaccaggtggacctgcccggccacatcctggaccaggccttcctgctgaagcaccactgcgtgagaaagcccagcgacctgtgcaccatcaacgtgagcggcctgaagttcagcaaggccaaggagaacgacttcaagcacttccacagcgtgatctacatcaacgccagcgagaacctgctgcccctggaggccttccacaccttccccgccctgaaggagctggacctggccttcaacggcatcaagaccatctacgtgaagtacggcgacttcaagctgctggagttcctggacctgagcttcaacagcctgaccgtggaggccatctgcgacctgggcatcctgccccacctgagagtgctgctgctgaccggcaacggcctgaccagcctgccccccaacctggccgtggccgagcaggaggccagcgtgaccagcctgaccagcaagagatacatcctgagattccccgccctggagaccctgatgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggctag

SEQ ID NO: 105441 - DNA, 1797 bp, Artificial Sequence
  Description of Artificial Sequence: Synthetic coding sequence
atggccttcagcggcatctacaagctggacgacggcaagccctacctgaacaactgcttccccgccagaaacctgctgagagtgcccgaggagggccagggccactggctggtggtgcagaagggcaacctgaagaagaagcccaagggcctggtgggcgcccaggccgagagaagagagagcctgaaggccaccagcttcgagttcaagggcaagaaggagagcagaagagagaaccaggtggacctgcccggccacatcctggaccaggccttcctgctgaagcaccactgcgtgagaaagcccagcgacctgtgcaccatcaacgccaaggagaacgacttcaagcacttccacagcgtgatctacatcaacgccagcgagaacctgctgcccctggaggccttccacaccttccccgccctgaaggagctggacctggccttcaacggcatcaagaccatctacgtgaagtacggcgacttcaagctgctggagttcctggacctgagcttcaacagcctgaccgtggaggccatctgcgacctgggcatcctgccccacctgagagtgctgctgctgaccggcaacggcctgaccagcctgccccccaacctggccgtggccgagcaggaggccagcgtgaccagcctgaccagcaagagatacatcctgagattccccgccctggagaccctgatgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggcagcccccacaaggagccccagttcatgctgcagagcaagcccagaatgctggaggacagcgacgagcagctggactacaccgtgctgcccatgaagaaggacgtggacagaaccggcgtgccccccctgctgaagagcttcctgcaggagagactgggcatccacctgatcagaagaaagatcgtgaagcccaagcaccacgtgctgatgagcagaaaggagagctggaaggtgaagagcgagatccccaaggtgcccaagcagcccctggtgctgcaccaccccagaatgaccaccaccaagagccccagcaaggacatgctggagcccgaggccgagctggccgaggacctgcccaccaccaagagcaccagcgtggagagcgagatgcccaccgagaacctggagggccacagccccagctgcagaaccttcgtgcccctgccccccatctgcagcaacagcaccgtgcacagcgaggagaccctgagccacctgagcgacaccaccgtgagactgagccccgagagacccagcgacgaggacagcaagagcaccgagagcatcttcctgacccaggtgagcgagctgcccagcagcgtgatccacaaggacgacctggagctgaaggagaaggaccagaagaagccccccaccgcccccagagaggtgaagggcaccagaagaaagctgcccaccgccttcctgcccagcaagtaccacggctacgaggagctgctgaccgccaagcccgaccccgccttcatcgagcccaagggcatccagaagaacgcccaggccctgcagcagatgctgaagcaccccctgctgtgccacagcagcaagcccaagctggacaccctgcagaagccctacgtgcacaaggagaagagagtgctgagctgcaccagcggccagaacggcggctggtag

SEQ ID NO: 105442 - DNA, 1554 bp, Artificial Sequence
  Description of Artificial Sequence: Synthetic coding sequence
atgctggacgacaacagactgagcaaccccagctgcttcgccagcctggccggcctgagaagactgaagaagctgagcctggacgagaacagaatcatcagaatcccctacctgcagcaggtgcagctgtacgacgagagcgtggactggaacggcggcagaggcagcccccacaaggagccccagttcatgctgcagagcaagcccagaatgctggaggacagcgacgagcagctggactacaccgtgctgcccatgaagaaggacgtggacagaaccgaggtggtgttcagcagctaccccggcttcagcaccagcgagatcgccaaggaggacgccgtgctgcccgtggccctgttccccagcctgtgcgagttcgtgttccacaacaaccccctggtggcccacaccagaggcgtgccccccctgctgaagagcttcctgcaggagagactgggcatccacctgatcagaagaaagatcgtgaagcccaagcaccacgtgctgatgagcagaaaggagagctggaaggtgaagagcgagatccccaaggtgcccaagcagcccctggtgctgcaccaccccagaatgaccaccaccaagagccccagcaaggacatgctggagcccgaggccgagctggccgaggacctgcccaccaccaagagcaccagcgtggagagcgagatgcccaccgagaacctggagggccacagccccagctgcagaaccttcgtgcccctgccccccatctgcagcaacagcaccgtgcacagcgaggagaccctgagccacctgagcgacaccaccgtgagactgagccccgagagacccagcgacgaggacagcaagagcaccgagagcatcttcctgacccaggtgagcgagctgcccagcagcgtgatccacaaggacgacctggagctgaaggagaaggaccagaagaagccccccaccgcccccagagaggtgaagggcaccagaagaaagctgcccaccgccttcctgcccagcaagtaccacggctacgaggagctgctgaccgccaagcccgaccccgccttcatcgagcccaagggcatccagaagaacgcccaggccctgcagcagatgctgaagcaccccctgctgtgccacagcagcaagcccaagctggacaccctgcagaagccctacgtgcacaaggagaagagagcccagagaatccccatccccccccccaagaagaccagagcccagctgctggacgacatcttcatcagactgagagaccccagaaacatcaccgaggcccccctgggcgccgtgctgcaccagtggaccgagagaagactggtgaaccacaagcagtacctggaggccaagagactgctgaaggagttccaggccagatacagacagctggtgagcggcagcctgagaaccgtgttcggcaccacccccctgcccatggcctgccccgccctgagcgagagccagcccaagttcggccacttcctggagttcatggacgagttctgccaggagcccaccgccagcgacagccagggctag

SEQ ID NO: 105443 - DNA, 984 bp, Artificial Sequence
  Description of Artificial Sequence: Synthetic coding sequence
atgttccccagcagaagaaaggccgcccagctgccctgggaggacggcagaagcggcctgctgagcggcggcctgcccagaaagtgcagcgtgttccacctgttcgtggcctgcctgagcctgggcttcttcagcctgctgtggctgcagctgagctgcagcggcgacgtggccagagccgtgagaggccagggccaggagaccagcggcccccccagagcctgcccccccgagcccccccccgagcactgggaggaggacgccagctggggcccccacagactggccgtgctggtgcccttcagagagagattcgaggagctgctggtgttcgtgccccacatgagaagattcctgagcagaaagaagatcagacaccacatctacgtgctgaaccaggtggaccacttcagattcaacagagccgccctgatcaacgtgggcttcctggagagcagcaacagcaccgactacatcgccatgcacgacgtggacctgctgcccctgaacgaggagctggactacggcttccccgaggccggccccttccacgtggccagccccgagctgcaccccctgtaccactacaagacctacgtgggcggcatcctgctgctgagcaagcagcactacagactgtgcaacggcatgagcaacagattctggggctggggcagagaggacgacgagttctacagaagaatcaagggcgccggcctgcagctgttcagacccagcggcatcaccaccggctacaagaccttcagacacctgcacgaccccgcctggagaaagagagaccagaagagaatcgccgcccagaagcaggagcagttcaaggtggacagagagggcggcctgaacaccgtgaagtaccacgtggccagcagaaccgccctgagcgtgggcggcgccccctgcaccgtgctgaacatcatgctggactgcgacaagaccgccaccccctggtgcaccttcagctag

SEQ ID NO: 105444 - DNA, 642 bp, Artificial Sequence
  Description of Artificial Sequence: Synthetic coding sequence
atgagaagattcctgagcagaaagaagatcagacaccacatctacgtgctgaaccaggtggaccacttcagattcaacagagccgccctgatcaacgtgggcttcctggagagcagcaacagcaccgactacatcgccatgcacgacgtggacctgctgcccctgaacgaggagctggactacggcttccccgaggccggccccttccacgtggccagccccgagctgcaccccctgtaccactacaagacctacgtgggcggcatcctgctgctgagcaagcagcactacagactgtgcaacggcatgagcaacagattctggggctggggcagagaggacgacgagttctacagaagaatcaagggcgccggcctgcagctgttcagacccagcggcatcaccaccggctacaagaccttcagacacctgcacgaccccgcctggagaaagagagaccagaagagaatcgccgcccagaagcaggagcagttcaaggtggacagagagggcggcctgaacaccgtgaagtaccacgtggccagcagaaccgccctgagcgtgggcggcgccccctgcaccgtgctgaacatcatgctggactgcgacaagaccgccaccccctggtgcaccttcagctag

SEQ ID NO: 105445 - DNA, 2880 bp, Artificial Sequence
  Description of Artificial Sequence: Synthetic coding sequence
atggtggccgccccctgcgccagaagactggccagaagaagccacagcgccctgctggccgccctgaccgtgctgctgctgcagaccctggtggtgtggaacttcagcagcctggacagcggcgccggcgagagaagaggcggcgccgccgtgggcggcggcgagcagcccccccccgcccccgcccccagaagagagagaagagacctgcccgccgagcccgccgccgccagaggcggcggcggcggcggcggcggcggcggcggcggcagaggcccccaggccagagccagaggcggcggccccggcgagcccagaggccagcagcccgccagcagaggcgccctgcccgccagagccctggacccccaccccagccccctgatcaccctggagacccaggacggctacttcagccacagacccaaggagaaggtgagaaccgacagcaacaacgagaacagcgtgcccaaggacttcgagaacgtggacaacagcaacttcgcccccagaacccagaagcagaagcaccagcccgagctggccaagaagccccccagcagacagaaggagctgctgaagagaaagctggagcagcaggagaagggcaagggccacaccttccccggcaagggccccggcgaggtgctgccccccggcgacagagccgccgccaacagcagccacggcaaggacgtgagcagacccccccacgccagaaagaccggcggcagcagccccgagaccaagtacgaccagccccccaagtgcgacatcagcggcaaggaggccatcagcgccctgagcagagccaagagcaagcactgcagacaggagatcggcgagacctactgcagacacaagctgggcctgctgatgcccgagaaggtgaccagattctgccccctggagggcaaggccaacaagaacgtgcagtgggacgaggacagcgtggagtacatgcccgccaaccccgtgagaatcgccttcgtgctggtggtgcacggcagagccagcagacagctgcagagaatgttcaaggccatctaccacaaggaccacttctactacatccacgtggacaagagaagcaactacctgcacagacaggtgctgcaggtgagcagacagtacagcaacgtgagagtgaccccctggagaatggccaccatctggggcggcgccagcctgctgagcacctacctgcagagcatgagagacctgctggagatgaccgactggccctgggacttcttcatcaacctgagcgccgccgactaccccatcagaaccaacgaccagctggtggccttcctgagcagatacagagacatgaacttcctgaagagccacggcagagacaacgccagattcatcagaaagcagggcctggacagactgttcctggagtgcgacgcccacatgtggagactgggcgacagaagaatccccgagggcatcgccgtggacggcggcagcgactggttcctgctgaacagaagattcgtggagtacgtgaccttcagcaccgacgacctggtgaccaagatgaagcagttctacagctacaccctgctgcccgccgagagcttcttccacaccgtgctggagaacagcccccactgcgacaccatggtggacaacaacctgagaatcaccaactggaacagaaagctgggctgcaagtgccagtacaagcacatcgtggactggtgcggctgcagccccaacgacttcaagccccaggacttccacagattccagcagaccgccagacccaccttcttcgccagaaagttcgaggccgtggtgaaccaggagatcatcggccagctggactactacctgtacggcaactaccccgccggcacccccggcctgagaagctactgggagaacgtgtacgacgagcccgacggcatccacagcctgagcgacgtgaccctgaccctgtaccacagcttcgccagactgggcctgagaagagccgagaccagcctgcacaccgacggcgagaacagctgcagatactaccccatgggccaccccgccagcgtgcacctgtacttcctggccgacagattccagggcttcctgatcaagcaccacgccaccaacctggccgtgagcaagctggagaccctggagacctgggtgatgcccaagaaggtgttcaagatcgccagcccccccagcgacttcggcagactgcagttcagcgaggtgggcaccgactgggacgccaaggagagactgttcagaaacttcggcggcctgctgggccccatggacgagcccgtgggcatgcagaagtggggcaagggccccaacgtgaccgtgaccgtgatctgggtggaccccgtgaacgtgatcgccgccacctacgacatcctgatcgagagcaccgccgagttcacccactacaagccccccctgaacctgcccctgagacccggcgtgtggaccgtgaagatcctgcaccactgggtgcccgtggccgagaccaagttcctggtggcccccctgaccttcagcaacagacagcccatcaagcccgaggaggccctgaagctgcacaacggccccctgagaaacgcctacatggagcagagcttccagagcctgaaccccgtgctgagcctgcccatcaaccccgcccaggtggagcaggccagaagaaacgccgccagcaccggcaccgccctggagggctggctggacagcctggtgggcggcatgtggaccgccatggacatctgcgccaccggccccaccgcctgccccgtgatgcagacctgcagccagaccgcctggagcagcttcagccccgaccccaagagcgagctgggcgccgtgaagcccgacggcagactgagatag

SEQ ID NO: 105446 - DNA, 2598 bp, Artificial Sequence
  Description of Artificial Sequence: Synthetic coding sequence
atggtggccagcgccagagtgcagaagctggtgagaagatacaagctggccatcgccaccgccctggccatcctgctgctgcagggcctggtggtgtggagcttcagcggcctggaggaggacgaggccggcgagaagggcagacagagaaagcccagacccctggaccccggcgagggcagcaaggacaccgacagcagcgccggcagaagaggcagcaccggcagaagacacggcagatggagaggcagagccgagagccccggcgtgcccgtggccaaggtggtgagagccgtgaccagcagacagagagccagcagaagagtgccccccgcccccccccccgaggcccccggcagacagaacctgagcggcgccgccgccggcgaggccctggtgggcgccgccggcttccccccccacggcgacaccggcagcgtggagggcgccccccagcccaccgacaacggcttcacccccaagtgcgagatcgtgggcaaggacgccctgagcgccctggccagagccagcaccaagcagtgccagcaggagatcgccaacgtggtgtgcctgcaccaggccggcagcctgatgcccaaggccgtgcccagacactgccagctgaccggcaagatgagccccggcatccagtgggacgagagccaggcccagcagcccatggacggcccccccgtgagaatcgcctacatgctggtggtgcacggcagagccatcagacagctgaagagactgctgaaggccgtgtaccacgagcagcacttcttctacatccacgtggacaagagaagcgactacctgcacagagaggtggtggagctggcccagggctacgacaacgtgagagtgaccccctggagaatggtgaccatctggggcggcgccagcctgctgagaatgtacctgagaagcatgagagacctgctggaggtgcccggctgggcctgggacttcttcatcaacctgagcgccaccgactaccccaccagaaccaacgaggagctggtggccttcctgagcaagaacagagacaagaacttcctgaagagccacggcagagacaacagcagattcatcaagaagcagggcctggacagactgttccacgagtgcgacagccacatgtggagactgggcgagagacagatccccgccggcatcgtggtggacggcggcagcgactggttcgtgctgaccagaagcttcgtggagtacgtggtgtacaccgacgaccccctggtggcccagctgagacagttctacacctacaccctgctgcccgccgagagcttcttccacaccgtgctggagaacagcctggcctgcgagaccctggtggacaacaacctgagagtgaccaactggaacagaaagctgggctgcaagtgccagtacaagcacatcgtggactggtgcggctgcagccccaacgacttcaagccccaggacttcctgagactgcagcaggtgagcagacccaccttcttcgccagaaagttcgagagcaccgtgaaccaggaggtgctggagatcctggacttccacctgtacggcagctacccccccggcacccccgccctgaaggcctactgggagaacacctacgacgccgccgacggccccagcggcctgagcgacgtgatgctgaccgcctacaccgccttcgccagactgagcctgcaccacgccgccaccgccgccccccccatgggcacccccctgtgcagattcgagcccagaggcctgcccagcagcgtgcacctgtacttctacgacgaccacttccagggctacctggtgacccaggccgtgcagcccagcgcccagggccccgccgagaccctggagatgtggctgatgccccagggcagcctgaagctgctgggcagaagcgaccaggccagcagactgcagagcctggaggtgggcaccgactgggaccccaaggagagactgttcagaaacttcggcggcctgctgggccccctggacgagcccgtggccgtgcagagatgggccagaggccccaacctgaccgccaccgtggtgtggatcgaccccacctacgtggtggccaccagctacgacatcaccgtggacaccgagaccgaggtgacccagtacaagccccccctgagcagacccctgagacccggcccctggaccgtgagactgctgcagttctgggagcccctgggcgagaccagattcctggtgctgcccctgaccttcaacagaaagctgcccctgagaaaggacgacgccagctggctgcacgccggccccccccacaacgagtacatggagcagagcttccagggcctgagcagcatcctgaacctgccccagcccgagctggccgaggaggccgcccagagacacacccagctgaccggccccgccctggaggcctggaccgacagagagctgagcagcttctggagcgtggccggcctgtgcgccatcggccccagcccctgccccagcctggagccctgcagactgaccagctggagcagcctgagccccgaccccaagagcgagctgggccccgtgaaggccgacggcagactgagatag

SEQ ID NO: 105447 - DNA, 2031 bp, Artificial Sequence
  Description of Artificial Sequence: Synthetic coding sequence
atggtggccagcgccagagtgcagaagctggtgagaagatacaagctggccatcgccaccgccctggccatcctgctgctgcagggcctggtggtgtggagcttcagcggcctggaggaggacgaggccggcgagaagggcagacagagaaagcccagacccctggaccccggcgagggcagcaaggacaccgacagcagcgccggcagaagaggcagcaccggcagaagacacggcagatggagaggcagagccgagagccccggcgtgcccgtggccaaggtggtgagagccgtgaccagcagacagagagccagcagaagagtgccccccgcccccccccccgaggcccccggcagacagaacctgagcggcgccgccgccggcgaggccctggtgggcgccgccggcttccccccccacggcgacaccggcagcgtggagggcgccccccagcccaccgacaacggcttcacccccaagtgcgagatcgtgggcaaggacgccctgagcgccctggccagagccagcaccaagcagtgccagcaggagatcgccaacgtggtgtgcctgcaccaggccggcagcctgatgcccaaggccgtgcccagacactgccagctgaccggcaagatgagccccggcatccagtgggacgagagccaggcccagcagcccatggacggcccccccgtgagaatcgcctacatgctggtggtgcacggcagagccatcagacagctgaagagactgctgaaggccgtgtaccacgagcagcacttcttctacatccacgtggacaagagaagcgactacctgcacagagaggtggtggagctggcccagggctacgacaacgtgagagtgaccccctggagaatggtgaccatctggggcggcgccagcctgctgagaatgtacctgagaagcatgagagacctgctggaggtgcccggctgggcctgggacttcttcatcaacctgagcgccaccgactaccccaccagaaccaacgaggagctggtggccttcctgagcaagaacagagacaagaacttcctgaagagccacggcagagacaacagcagattcatcaagaagcagggcctggacagactgttccacgagtgcgacagccacatgtggagactgggcgagagacagatccccgccggcatcgtggtggacggcggcagcgactggttcgtgctgaccagaagcttcgtggagtacgtggtgtacaccgacgaccccctggtggcccagctgagacagttctacacctacaccctgctgcccgccgagagcttcttccacaccgtgctggagaacagcctggcctgcgagaccctggtggacaacaacctgagagtgaccaactggaacagaaagctgggctgcaagtgccagtacaagcacatcgtggactggtgcggctgcagccccaacgacttcaagccccaggacttcctgagactgcagcaggtgagcagacccaccttcttcgccagaaagttcgagagcaccgtgaaccaggaggtgctggagatcctggacttccacctgtacggcagctacccccccggcacccccgccctgaaggcctactgggagaacacctacgacgccgccgacggccccagcggcctgagcgacgtgatgctgaccgcctacaccgccttcgccagactgagcctgcaccacgccgccaccgccgccccccccatgggcacccccctgtgcagattcgagcccagaggcctgcccagcagcgtgcacctgtacttctacgacgaccacttccagggctacctggtgacccaggccgtgcagcccagcgcccagggccccgccgagaccctggagatgtggctgatgccccagggcagcctgaagctgctgggcagaagcgaccaggccagcagactgcagagcctggagaacagaggcctgagcatgctgcccagactggtgagcaacagctggccccaggccgtgctgcccctgcagccccccaaggccctgggctag

SEQ ID NO: 105448 - DNA, 1503 bp, Artificial Sequence
  Description of Artificial Sequence: Synthetic coding sequence
atgatcatcagccacttccccaagtgcgtggccgtgttcgccctgctggccctgagcgtgggcgccctggacaccttcatcgccgccgtgtacgagcacgccgtgatcctgcccaacagaaccgagacccccgtgagcaaggaggaggccctgctgctgatgaacaagaacatcgacgtgctggagaaggccgtgaagctggccgccaagcagggcgcccacatcatcgtgacccccgaggacggcatctacggctggatcttcaccagagagagcatctacccctacctggaggacatccccgaccccggcgtgaactggatcccctgcagagacccctggagattcggcaacacccccgtgcagcagagactgagctgcctggccaaggacaacagcatctacgtggtggccaacatcggcgacaagaagccctgcaacgccagcgacagccagtgcccccccgacggcagataccagtacaacaccgacgtggtgttcgacagccagggcaagctgctggccagataccacaagtacaacctgttcgcccccgagatccagttcgacttccccaaggacagcgagctggtgaccttcgacacccccttcggcaagttcggcatcttcacctgcttcgacatcttcagccacgaccccgccgtggtggtggtggacgagagcatcgacagcatcctgtaccccaccgcctggtacaacaccctgcccctgctgagcgccgtgcccttccacagcgcctgggccaaggccatgggcgtgaacctgctggccgccaacacccacaacaccagcatgcacatgaccggcagcggcatctacgcccccgaggccgtgaaggtgtaccactacgacatggagaccgagagcggccagctgctgctgagcgagctgaagagcagacccagaagagagcccacctaccccgccgccgtggactggcacgcctacgccagcagcgtgaagcccttcagcagcgagcagagcgacttcctgggcatgatctacttcgacgagttcaccttcaccaagctgaagagaaacaccggcaactacaccgcctgccagaaggacctgtgctgccacctgacctacaagatgagcgagaagagaaccgacgagatctacgccctgggcgccttcgacggcctgcacaccgtggagggccagtactacctgcagatctgcgccctgctgaagtgccagaccaccgacctggagacctgcggcgagcccgtgggcagcgccttcaccaagttcgaggacttcagcctgagcggcaccttcggcaccagatacgtgttcccccagatcatcctgagcggcagccagctggcccccgagagacactacgagatcagcagagacggcagactgagaagcagaagcggcgcccccctgcccgtgctggtgatggccctgtacggcagagtgttcgagaaggacccccccagactgggccagggcagcggcaagttccagtag

SEQ ID NO: 105449 - DNA, 1200 bp, Artificial Sequence
  Description of Artificial Sequence: Synthetic coding sequence
atggacagcagcaccaccgcccagtgcagacagctggaggccgccgtgggcggcgcccaggccctgagctgcctgaccggcagcagagcctacgagagattcaccggcaaccagatcgccaagatctaccagcagaaccccgaggcctacagccacaccgagagaatcagcctggtgagcagcttcgccgccagcctgttcctgggcagctacagccccatcgactacagcgacggcagcggcatgaacctgctgcagatccaggacaaggtgtggagccaggcctgcctgggcgcctgcgccccccacctggaggagaagctgagcccccccgtgcccagctgcagcgtggtgggcgccatcagcagctactacgtgcagagatacggcttcccccccggctgcaaggtggtggccttcaccggcgacaaccccgccagcctggccggcatgagactggaggagggcgacatcgccgtgagcctgggcaccagcgacaccctgttcctgtggctgcaggagcccatgcccgccctggagggccacatcttctgcaaccccgtggacagccagcactacatggccctgctgtgcttcaagaacggcagcctgatgagagagaagatcagaaacgagagcgtgagcagaagctggagcgacttcagcaaggccctgcagagcaccgagatgggcaacggcggcaacctgggcttctacttcgacgtgatggagatcacccccgagatcatcggcagacacagattcaacaccgagaaccacaaggtggccgccttccccggcgacgtggaggtgagagccctgatcgagggccagttcatggccaagagaatccacgccgagggcctgggctacagagtgatgagcaagaccaagatcctggccaccggcggcgccagccacaacagagagatcctgcaggtgctggccgacgtgttcgacgcccccgtgtacgtgatcgacaccgccaacagcgcctgcgtgggcagcgcctacagagccttccacggcctggccggcggcaccgacgtgcccttcagcgaggtggtgaagctggcccccaaccccagactggccgccacccccagccccggcgccagccaggtgtacgaggccctgctgccccagtacgccaagctggagcagagaatcctgagccagaccagaggcccccccgagtag

SEQ ID NO: 105450 - DNA, 4269 bp, Artificial Sequence
  Description of Artificial Sequence: Synthetic coding sequence
atgagcggcatcaagagaaccatcaaggagaccgaccccgactacgaggacgtgagcgtggccctgcccaacaagagacacaaggccatcgagaacagcgccagagacgccgccgtgcagaagatcgagaccatcatcaaggagcagttcgccctggagatgaagaacaaggagcacgagatcgaggtgatcgaccagagactgatcgaggccagaagaatgatggacaagctgagagcctgcatcgtggccaactactacgccagcgccggcctgctgaaggtgagcgagggcagcaagacctgcgacaccatggtgttcaaccaccccgccatcaagaagttcctggagagccccagcagaagcagcagccccgccaaccagagagccgagacccccagcgccaaccacagcgagagcgacagcctgagccagcacaacgacttcctgagcgacaaggacaacaacagcaacatggacatcgaggagagactgagcaacaacatggagcagagacccagcagaaacaccggcagagacaccagcagaatcaccggcagccacaagaccgagcagagaaacgccgacctgaccgacgagaccagcagactgttcgtgaagaagaccatcgtggtgggcaacgtgagcaagtacatcccccccgacaagagagaggagaacgaccagagcacccacaagtggatggtgtacgtgagaggcagcagaagagagcccagcatcaaccacttcgtgaagaaggtgtggttcttcctgcaccccagctacaagcccaacgacctggtggaggtgagagagccccccttccacctgaccagaagaggctggggcgagttccccgtgagagtgcaggtgcacttcaaggacagccagaacaagagaatcgacatcatccacaacctgaagctggacagaacctacaccggcctgcagaccctgggcgccgagaccgtggtggacgtggagctgcacagacacagcctgggcgaggactgcatctacccccagagcagcgagagcgacatcagcgacgccccccccagcctgcccctgaccatccccgcccccgtgaaggccagcagccccatcaagcagagccacgagcccgtgcccgacaccagcgtggagaagggcttccccgccagcaccgaggccgagagacacacccccttctacgccctgcccagcagcctggagagaacccccaccaagatgaccaccagccagaaggtgaccttctgcagccacggcaacagcgccttccagcccatcgccagcagctgcaagatcgtgccccagagccaggtgcccaaccccgagagccccggcaagagcttccagcccatcaccatgagctgcaagatcgtgagcggcagccccatcagcacccccagccccagccccctgcccagaacccccaccagcacccccgtgcacgtgaagcagggcaccgccggcagcgtgatcaacaacccctacgtgatcatggacaagcagcccggccaggtgatcggcgccaccacccccagcaccggcagccccaccaacaagatcagcaccgccagccaggtgagccagggcaccggcagccccgtgcccaagatccacggcagcagcttcgtgaccagcaccgtgaagcaggaggacagcctgttcgccagcatgccccccctgtgccccatcggcagccaccccaaggtgcagagccccaagcccatcaccggcggcctgggcgccttcaccaaggtgatcatcaagcaggagcccggcgaggccccccacgtgcccgccaccggcgccgccagccagagccccctgccccagtacgtgaccgtgaagggcggccacatgatcgccgtgagcccccagaagcaggtgatcacccccggcgagggcatcgcccagagcgccaaggtgcagcccagcaaggtggtgggcgtgcccgtgggcagcgccctgcccagcaccgtgaagcaggccgtggccatcagcggcggccagatcctggtggccaaggccagcagcagcgtgagcaaggccgtgggccccaagcaggtggtgacccagggcgtggccaaggccatcgtgagcggcggcggcggcaccatcgtggcccagcccgtgcagaccctgaccaaggcccaggtgaccgccgccggcccccagaagagcggcagccagggcagcgtgatggccaccctgcagctgcccgccaccaacctggccaacctggccaacctgccccccggcaccaagctgtacctgaccaccaacagcaagaaccccagcggcaagggcaagctgctgctgatcccccagggcgccatcctgagagccaccaacaacgccaacctgcagagcggcagcgccgccagcggcggcagcggcgccggcggcggcggcggcggcggcggcggcggcggcagcggcagcggcggcggcggcagcaccggcggcggcggcggcaccgccggcggcggcacccagagcaccgccggccccggcggcatcagccagcacctgacctacaccagctacatcctgaagcagaccccccagggcaccttcctggtgggccagcccagcccccagaccagcggcaagcagctgaccaccggcagcgtggtgcagggcaccctgggcgtgagcaccagcagcgcccagggccagcagaccctgaaggtgatcagcggccagaagaccaccctgttcacccaggccgcccacggcggccaggccagcctgatgaagatcagcgacagcaccctgaagaccgtgcccgccaccagccagctgagcaagcccggcaccaccatgctgagagtggccggcggcgtgatcaccaccgccaccagccccgccgtggccctgagcgccaacggccccgcccagcagagcgagggcatggcccccgtgagcagcagcaccgtgagcagcgtgaccaagaccagcggccagcagcaggtgtgcgtgagccaggccaccgtgggcacctgcaaggccgccacccccaccgtggtgagcgccaccagcctggtgcccacccccaaccccatcagcggcaaggccaccgtgagcggcctgctgaagatccacagcagccagagcagcccccagcaggccgtgctgaccatccccagccagctgaagcccctgagcgtgaacaccagcggcggcgtgcagaccatcctgatgcccgtgaacaaggtggtgcagagcttcagcaccagcaagccccccgccatcctgcccgtggccgcccccacccccgtggtgcccagcagcgcccccgccgccgtggccaaggtgaagaccgagcccgagacccccggccccagctgcctgagccaggagggccagaccgccgtgaagaccgaggagagcagcgagctgggcaactacgtgatcaagatcgaccacctggagaccatccagcagctgctgaccgccgtggtgaagaagatccccctgatcaccgccaagagcgaggacgccagctgcttcagcgccaagagcgtggagcagtactacggctggaacatcggcaagagaagagccgccgagtggcagagagccatgaccatgagaaaggtgctgcaggagatcctggagaagaaccccagattccaccacctgacccccctgaagaccaagcacatcgcccactggtgcagatgccacggctacaccccccccgaccccgagagcctgagaaacgacggcgacagcatcgaggacgtgctgacccagatcgacagcgagcccgagtgccccagcagcttcagcagcgccgacaacctgtgcagaaagctggaggacctgcagcagttccagaagagagagcccgagaacgaggaggaggtggacatcctgagcctgagcgagcccgtgaagatcaacatcaagaaggagcaggaggagaagcaggaggaggtgaagttctacctgccccccacccccggcagcgagttcatcggcgacgtgacccagaagatcggcatcaccctgcagcccgtggccctgcacagaaacgtgtacgccagcgtggtggaggacatgatcctgaaggccaccgagcagctggtgaacgacatcctgagacaggccctggccgtgggctaccagaccgccagccacaacagaatccccaaggagatcaccgtgagcaacatccaccaggccatctgcaacatccccttcctggacttcctgaccaacaagcacatgggcatcctgaacgaggaccagtag

SEQ ID NO: 105451 - DNA, 4269 bp, Artificial Sequence; identical to SEQ ID NO: 105450
  Description of Artificial Sequence: Synthetic coding sequence

SEQ ID NO: 105452 - DNA, 684 bp, Artificial Sequence
  Description of Artificial Sequence: Synthetic coding sequence
atgttcaagagaatggccgagttcggccccgacagcggcggcagagtgaagggcgtgaccatcgtgaagcccatcgtgtacggcaacgtggccagatacttcggcaagaagagagaggaggacggccacacccaccagtggaccgtgtacgtgaagccctacagaaacgaggacatgagcgcctacgtgaagaagatccagttcaagctgcacgagagctacggcaaccccctgagagtggtgaccaagcccccctacgagatcaccgagaccggctggggcgagttcgagatcatcatcaagatcttcttcatcgaccccaacgagagacccgtgaccctgtaccacctgctgaagctgttccagagcgacaccaacgccatgctgggcaagaagaccgtggtgagcgagttctacgacgagatgatcttccaggaccccaccgccatgatgcagcagctgctgaccaccagcagacagctgaccctgggcgcctacaagcacgagaccgagttcgccgagctggaggtgaagaccagagagaagctggaggccgccaagaagaagaccagcttcgagatcgccgagctgaaggagagactgaaggccagcagagagaccatcaactgcctgaagaacgagatcagaaagctggaggaggacgaccaggccaaggacatctag

SEQ ID NO: 105453 - DNA, 1053 bp, Artificial Sequence
  Description of Artificial Sequence: Synthetic coding sequence
atggccaccaccgccgcccccgccggcggcgccagaaacggcgccggccccgagtggggcggcttcgaggagaacatccagggcggcggcagcgccgtgatcgacatggagaacatggacgacaccagcggcagcagcttcgaggacatgggcgagctgcaccagagactgagagaggaggaggtggacgccgacgccgccgacgccgccgccgccgaggaggaggacggcgagttcctgggcatgaagggcttcaagggccagctgagcagacaggtggccgaccagatgtggcaggccggcaagagacaggccagcagagccttcagcctgtacgccaacatcgacatcctgagaccctacttcgacgtggagcccgcccaggtgagaagcagactgctggagagcatgatccccatcaagatggtgaacttcccccagaagatcgccggcgagctgtacggccccctgatgctggtgttcaccctggtggccatcctgctgcacggcatgaagaccagcgacaccatcatcagagagggcaccctgatgggcaccgccatcggcacctgcttcggctactggctgggcgtgagcagcttcatctacttcctggcctacctgtgcaacgcccagatcaccatgctgcagatgctggccctgctgggctacggcctgttcggccactgcatcgtgctgttcatcacctacaacatccacctgcacgccctgttctacctgttctggctgctggtgggcggcctgagcaccctgagaatggtggccgtgctggtgagcagaaccgtgggccccacccagagactgctgctgtgcggcaccctggccgccctgcacatgctgttcctgctgtacctgcacttcgcctaccacaaggtggtggagggcatcctggacaccctggagggccccaacatcccccccatccagagagtgcccagagacatccccgccatgctgcccgccgccagactgcccaccaccgtgctgaacgccaccgccaaggccgtggccgtgaccctgcagagccactag

SEQ ID NO: 105454 - DNA, 774 bp, Artificial Sequence
  Description of Artificial Sequence: Synthetic coding sequence
atgagcggcttcgagaacctgaacaccgacttctaccagaccagctacagcatcgacgaccagagccagcagagctacgactacggcggcagcggcggcccctacagcaagcagtacgccggctacgactacagccagcagggcagattcgtgccccccgacatgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggccggccccatggtgttctgcctggccttcggcgccaccctgctgctggccggcaagatccagttcggctacgtgtacggcatcagcgccatcggctgcctgggcatgttctgcctgctgaacctgatgagcatgaccggcgtgagcttcggctgcgtggccagcgtgctgggctactgcctgctgcccatgatcctgctgagcagcttcgccgtgatcttcagcctgcagggcatggtgggcatcatcctgaccgccggcatcatcggctggtgcagcttcagcgccagcaagatcttcatcagcgccctggccatggagggccagcagctgctggtggcctacccctgcgccctgctgtacggcgtgttcgccctgatcagcgtgttctag

SEQ ID NO: 105455 - DNA, 798 bp, Artificial Sequence
  Description of Artificial Sequence: Synthetic coding sequence
atgagcggcttcgagaacctgaacaccgacttctaccagaccagctacagcatcgacgaccagagccagcagagctacgactacggcggcagcggcggcccctacagcaagcagtacgccggctacgactacagccagcagggcagattcgtgccccccgacatgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggccggccccatggtgttctgcctggccttcggcgccaccctgctgctggccggcaagatccagttcggctacgtgtacggcatcagcgccatcggctgcctgggcatgttctgcctgctgaacctgatgagcatgaccggcgtgagcttcggctgcgtggccagcgtgctgggctactgcctgctgcccatgatcctgctgagcagcttcgccgtgatcttcagcctgcagggcatggtgggcatcatcctgaccgccggcatcatcggctggtgcagcttcagcgccagcaagatcttcatcagcgccctggccatggagggccagcagctgctggtggccctgcagcccaacatcacctacggcagcaactacttcctgttctgctgcctgccctacccccagcagcacttctag

SEQ ID NO: 105456 - DNA, 774 bp, Artificial Sequence; identical to SEQ ID NO: 105454
  Description of Artificial Sequence: Synthetic coding sequence

SEQ ID NO: 105457 - DNA, 612 bp, Artificial Sequence
  Description of Artificial Sequence: Synthetic coding sequence
atgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggccggccccatggtgttctgcctggccttcggcgccaccctgctgctggccggcaagatccagttcggctacgtgtacggcatcagcgccatcggctgcctgggcatgttctgcctgctgaacctgatgagcatgaccggcgtgagcttcggctgcgtggccagcgtgctgggctactgcctgctgcccatgatcctgctgagcagcttcgccgtgatcttcagcctgcagggcatggtgggcatcatcctgaccgccggcatcatcggctggtgcagcttcagcgccagcaagatcttcatcagcgccctggccatggagggccagcagctgctggtggcctacccctgcgccctgctgtacggcgtgttcgccctgatcagcgtgttctag

SEQ ID NO: 105458 - DNA, 534 bp, Artificial Sequence
  Description of Artificial Sequence: Synthetic coding sequence
atgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggccggccccatggtgttctgcctggccttcggcgccaccctgctgctggccggcaagatccagttcggctacgtgtacggcatcagcgccatcggctgcctgggcatgttctgcctgctgaacctgatgagcatgaccggcgtgagcttcggctgcgtggccagcgtgctgggctactgcctgctgcccatgatcctgctgagcagcttcgccgtgatcttcagcctgcagggcatggtgggcatcatcctgaccgccggcatcatcggctggtgcagcttcagcgccagcaagatcttcatcagcgccctgtag

SEQ ID NO: 105459 - DNA, 306 bp, Artificial Sequence
  Description of Artificial Sequence: Synthetic coding sequence
atgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggccggccccatggtgttctgcctggccttcggcgccaccctgctgctggccggcaagatccagttcggctacgtgtacggcatctag

SEQ ID NO: 105460 - DNA, 429 bp, Artificial Sequence
  Description of Artificial Sequence: Synthetic coding sequence
atgagcggcttcgagaacctgaacaccgacttctaccagaccagctacagcatcgacgaccagagccagcagagctacgactacggcggcagcggcggcccctacagcaagcagtacgccggctacgactacagccagcagggcagattcgtgccccccgacatgatgcagccccagcagccctacaccggccagatctaccagcccacccaggcctacacccccgccagcccccagcccttctacggcaacaacttcgaggacgagccccccctgctggaggagctgggcatcaacttcgaccacatctggcagaagaccctgaccgtgctgcaccccctgaaggtggccgacggcagcatcatgaacgagaccgacctggcccagtggttcttcgccctgctgctggagccccactgctactggtag

SEQ ID NO: 105461 - DNA, 882 bp, Artificial Sequence
  Description of Artificial Sequence: Synthetic coding sequence
atggcctaccacagcggctacggcgcccacggcagcaagcacagagccagagccgcccccgaccccccccccctgttcgacgacaccagcggcggctacagcagccagcccggcggctaccccgccaccggcgccgacgtggccttcagcgtgaaccacctgctgggcgaccccatggccaacgtggccatggcctacggcagcagcatcgccagccacggcaaggacatggtgcacaaggagctgcacagattcgtgagcgtgagcaagctgaagtacttcttcgccgtggacaccgcctacgtggccaagaagctgggcctgctggtgttcccctacacccaccagaactgggaggtgcagtacagcagagacgcccccctgccccccagacaggacctgaacgcccccgacctgtacatccccaccatggccttcatcacctacgtgctgctggccggcatggccctgggcatccagaagagattcagccccgaggtgctgggcctgtgcgccagcaccgccctggtgtgggtggtgatggaggtgctggccctgctgctgggcctgtacctggccaccgtgagaagcgacctgagcaccttccacctgctggcctacagcggctacaagtacgtgggcatgatcctgagcgtgctgaccggcctgctgttcggcagcgacggctactacgtggccctggcctggaccagcagcgccctgatgtacttcatcgtgagaagcctgagaaccgccgccctgggccccgacagcatgggcggccccgtgcccagacagagactgcagctgtacctgaccctgggcgccgccgccttccagcccctgatcatctactggctgaccttccacctggtgagatag

SEQ ID NO: 105462 - DNA, 360 bp, Artificial Sequence
  Description of Artificial Sequence: Synthetic coding sequence
atggtgaagatgaccaagagcaagaccttccaggcctacctgcccaactgccacagaacctacagctgcatccactgcagagcccacctggccaaccacgacgagctgatcagcaagagcttccagggcagccagggcagagcctacctgttcaacagcgtggtgaacgtgggctgcggccccgccgaggagagagtgctgctgaccggcctgcacgccgtggccgacatctactgcgagaactgcaagaccaccctgggctggaagtacgagcacgccttcgagagcagccagaagtacaaggagggcaagttcatcatcgagctggcccacatgatcaaggacaacggctgggagtag

SEQ ID NO: 105463 - DNA, 360 bp, Artificial Sequence
  Description of Artificial Sequence: Synthetic coding sequence
atggtgaagatgaccagaagcaagaccttccaggcctacctgcccagctgccacagaacctacagctgcatccactgcagagcccacctggccaaccacgacgagctgatcagcaagagcttccagggcagccagggcagagcctacctgttcaacagcgtggtgaacgtgggctgcggccccgccgaggagagagtgctgctgaccggcctgcacgccgtggccgacatctactgcgagaactgcaagaccaccctgggctggaagtacgagcacgccttcgagagcagccagaagtacaaggagggcaagtacatcatcgagctggcccacatgatcaaggacaacggctgggactag

SEQ ID NO: 105464 - DNA, 360 bp, Artificial Sequence
  Description of Artificial Sequence: Synthetic coding sequence
atggtgagaatcagcaagcccaagaccttccaggcctacctggacgactgccacagaagatacagctgcgcccactgcagagcccacctggccaaccacgacgacctgatcagcaagagcttccagggcagccagggcagagcctacctgttcaacagcgtggtgaacgtgggctgcggccccgccgaggagagagtgctgctgaccggcctgcacgccgtggccgacatccactgcgagaactgcaagaccaccctgggctggaagtacgagcaggccttcgagagcagccagaagtacaaggagggcaagtacatcatcgagctgaaccacatgatcaaggacaacggctgggactag

SEQ ID NO: 105465 - DNA, 474 bp, Artificial Sequence
  Description of Artificial Sequence: Synthetic coding sequence
atgtgcgtggcccaggtgctgaccgcccacctgctgccccccagacaggccctgggcagcctgtgcagcccctgggccgcccccagagtgggccccctgccccccgcccccgccatggtgagaatcagcaagcccaagaccttccaggcctacctggacgactgccacagaagatacagctgcgcccactgcagagcccacctggccaaccacgacgacctgatcagcaagagcttccagggcagccagggcagagcctacctgttcaacagcgtggtgaacgtgggctgcggccccgccgaggagagagtgctgctgaccggcctgcacgccgtggccgacatccactgcgagaactgcaagaccaccctgggctggaagtacgagcaggccttcgagagcagccagaagtacaaggagggcaagtacatcatcgagctgaaccacatgatcaaggacaacggctgggactag

SEQ ID NO: 105466 - DNA, 384 bp, Artificial Sequence
  Description of Artificial Sequence: Synthetic coding sequence
atgcccagctgcgaccccggccccggccccgcctgcctgcccaccaagaccttcagaagctacctgcccagatgccacagaacctacagctgcgtgcactgcagagcccacctggccaagcacgacgagctgatcagcaagagcttccagggcagccacggcagagcctacctgttcaacagcgtggtgaacgtgggctgcggccccgccgagcagagactgctgctgaccggcctgcacagcgtggccgacatcttctgcgagagctgcaagaccaccctgggctggaagtacgagcaggccttcgagaccagccagaagtacaaggagggcaagtacatcatcgagatgagccacatggtgaaggacaacggctgggactag

SEQ ID NO: 105467 - DNA, 384 bp, Artificial Sequence; identical to SEQ ID NO: 105466
  Description of Artificial Sequence: Synthetic coding sequence

SEQ ID NO: 105468 - DNA, 384 bp, Artificial Sequence; identical to SEQ ID NO: 105466
  Description of Artificial Sequence: Synthetic coding sequence

SEQ ID NO: 105469 - DNA, 243 bp, Artificial Sequence
  Description of Artificial Sequence: Synthetic coding sequence
atgcccagctgcgaccccggccccggccccgcctgcctgcccaccaagaccttcagaagctacctgcccagatgccacagaacctacagctgcgtgcactgcagagcccacctggccaagcacgacgagctgatcagcaagagcttccagggcagccacggcagagcctacctgttcaacagcgtggtgaacgtgggctgcggccccgccgagcagagactgctgctgaccggcctgcactag

SEQ ID NO: 105470 - DNA, 384 bp, Artificial Sequence; identical to SEQ ID NO: 105466
  Description of Artificial Sequence: Synthetic coding sequence

SEQ ID NO: 105471 - DNA, 366 bp, Artificial Sequence
  Description of Artificial Sequence: Synthetic coding sequence
atgggcagaatcttcctggaccacatcggcggcaccagactgttcagctgcgccaactgcgacaccatcctgaccaacagaagcgagctgatcagcaccagattcaccggcgccaccggcagagccttcctgttcaacaaggtggtgaacctgcagtacagcgaggtgcaggacagagtgatgctgaccggcagacacatggtgagagacgtgagctgcaagaactgcaacagcaagctgggctggatctacgagttcgccaccgaggacagccagagatacaaggagggcagagtgatcctggagagagccctggtgagagagagcgagggcttcgaggagcacgtgcccagcgacaacagctag

SEQ ID NO: 105472 - DNA, 366 bp, Artificial Sequence; identical to SEQ ID NO: 105471
  Description of Artificial Sequence: Synthetic coding sequence

SEQ ID NO: 105473 - DNA, 366 bp, Artificial Sequence; identical to SEQ ID NO: 105471
  Description of Artificial Sequence: Synthetic coding sequence

SEQ ID NO: 105474 - DNA, 366 bp, Artificial Sequence; identical to SEQ ID NO: 105471
  Description of Artificial Sequence: Synthetic coding sequence

SEQ ID NO: 105475 - DNA, 366 bp, Artificial Sequence; identical to SEQ ID NO: 105471
  Description of Artificial Sequence: Synthetic coding sequence

SEQ ID NO: 105476 - DNA, 2322 bp, Artificial Sequence
  Description of Artificial Sequence: Synthetic coding sequence
atgttcagcctgagcagcaccgtgcagccccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagtgcatgttcagcgacttcctgaccaagctgaacatcgtgagcatcggcaagggcaagatcttcgagggctacagaagcatgttcatggagcccgccaagagaatgaagaagagcctggacaccaccgacaactggcacatcagacccgagcccttcagcctgagcatcccccccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacggcaacctggacatcttcagcaccctgagaagcagctgcctgtacagacaccacagcagagccctgcagagcatctgcagcgacctgcagtactggcccgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggcgtggaggaggccaagcaggagctgcaggaggtggtggagttcctgaagaacccccagaagttcaccatcctgggcggcaagctgcccaagggcatcctgctggtgggcccccccggcaccggcaagaccctgctggccagagccgtggccggcgaggccgacgtgcccttctactacgccagcggcagcgagttcgacgagatgttcgtgggcgtgggcgccagcagaatcagaaacctgttcagagaggccaaggccaacgccccctgcgtgatcttcatcgacgagctggacagcgtgggcggcaagagaatcgagagccccatgcacccctacagcagacagaccatcaaccagctgctggccgagatggacggcttcaagcccaacgagggcgtgatcatcatcggcgccaccaacttccccgaggccctggacaacgccctgatcagacccggcagattcgacatgcaggtgaccgtgcccagacccgacgtgaagggcagaaccgagatcctgaagtggtacctgaacaagatcaagttcgaccagagcgtggaccccgagatcatcgccagaggcaccgtgggcttcagcggcgccgagctggagaacctggtgaaccaggccgccctgaaggccgccgtggacggcaaggagatggtgaccatgaaggagctggagttcagcaaggacaagatcctgatgggccccgagagaagaagcgtggagatcgacaacaagaacaagaccatcaccgcctaccacgagagcggccacgccatcatcgcctactacaccaaggacgccatgcccatcaacaaggccaccatcatgcccagaggccccaccctgggccacgtgagcctgctgcccgagaacgacagatggaacgagaccagagcccagctgctggcccagatggacgtgagcatgggcggcagagtggccgaggagctgatcttcggcaccgaccacatcaccaccggcgccagcagcgacttcgacaacgccaccaagatcgccaagagaatggtgaccaagttcggcatgagcgagaagctgggcgtgatgacctacagcgacaccggcaagctgagccccgagacccagagcgccatcgagcaggagatcagaatcctgctgagagacagctacgagagagccaagcacatcctgaagacccacgccaaggagcacaagaacctggccgaggccctgctgacctacgagaccctggacgccaaggagatccagatcgtgctggagggcaagaagctggaggtgagatag

SEQ ID NO: 105477 - DNA, 2223 bp, Artificial Sequence
  Description of Artificial Sequence: Synthetic coding sequence
atgttcagcctgagcagcaccgtgcagccccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagtgcatgttcagcgacttcctgaccaagctgaacatcgtgagcatcggcaagggcaagatcttcgagggctacagaagcatgttcatggagcccgccaagagaatgaagaagagcctggacaccaccgacaactggcacatcagacccgagcccttcagcctgagcatcccccccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacggcaacctggacatcttcagcaccctgagaagcagctgcctgtacagacaccacagcagagccctgcagagcatctgcagcgacctgcagtactggcccgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggcgtggaggaggccaagcaggagctgcaggaggtggtggagttcctgaagaacccccagaagttcaccatcctgggcggcaagctgcccaagggcatcctgctggtgggcccccccggcaccggcaagaccctgctggccagagccgtggccggcgaggccgacgtgcccttctactacgccagcggcagcgagttcgacgagatgttcgtgggcgtgggcgccagcagaatcagaaacctgttcagagaggccaaggccaacgccccctgcgtgatcttcatcgacgagctggacagcgtgggcggcaagagaatcgagagccccatgcacccctacagcagacagaccatcaaccagctgctggccgagatggacggcttcaagcccaacgagggcgtgatcatcatcggcgccaccaacttccccgaggccctggacaacgccctgatcagacccggcagattcgacatgcaggtgaccgtgcccagacccgacgtgaagggcagaaccgagatcctgaagtggtacctgaacaagatcaagttcgaccagagcgtggaccccgagatcatcgccagaggcaccgtgggcttcagcggcgccgagctggagaacctggtgaaccaggccgccctgaaggccgccgtggacggcaaggagatggtgaccatgaaggagctggagttcagcaaggacaagatcctgatgggccccgagagaagaagcgtggagatcgacaacaagaacaagaccatcaccgcctaccacgagagcggccacgccatcatcgcctactacaccaaggacgccatgcccatcaacaaggccaccatcatgcccagaggccccaccctgggccacgtgagcctgctgcccgagaacgacagatggaacgagaccagagcccagctgctggcccagatggacgtgagcatgggcggcagagtggccgaggagctgatcttcggcaccgaccacatcaccaccggcgccagcagcgacttcgacaacgccaccaagatcgccaagagaatggtgaccaagttcggcatgagcgagaagctgggcgtgatgacctacagcgacaccggcaagctgagccccgagacccagagcgccatcgagcaggagatcagaatcctgctgagagacagctacgagagagccaagcacatcctgaagacccacagctag

SEQ ID NO: 105478 - DNA, 2052 bp, Artificial Sequence
  Description of Artificial Sequence: Synthetic coding sequence
atgttcagcctgagcagcaccgtgcagccccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagcccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggcgtggaggaggccaagcaggagctgcaggaggtggtggagttcctgaagaacccccagaagttcaccatcctgggcggcaagctgcccaagggcatcctgctggtgggcccccccggcaccggcaagaccctgctggccagagccgtggccggcgaggccgacgtgcccttctactacgccagcggcagcgagttcgacgagatgttcgtgggcgtgggcgccagcagaatcagaaacctgttcagagaggccaaggccaacgccccctgcgtgatcttcatcgacgagctggacagcgtgggcggcaagagaatcgagagccccatgcacccctacagcagacagaccatcaaccagctgctggccgagatggacggcttcaagcccaacgagggcgtgatcatcatcggcgccaccaacttccccgaggccctggacaacgccctgatcagacccggcagattcgacatgcaggtgaccgtgcccagacccgacgtgaagggcagaaccgagatcctgaagtggtacctgaacaagatcaagttcgaccagagcgtggaccccgagatcatcgccagaggcaccgtgggcttcagcggcgccgagctggagaacctggtgaaccaggccgccctgaaggccgccgtggacggcaaggagatggtgaccatgaaggagctggagttcagcaaggacaagatcctgatgggccccgagagaagaagcgtggagatcgacaacaagaacaagaccatcaccgcctaccacgagagcggccacgccatcatcgcctactacaccaaggacgccatgcccatcaacaaggccaccatcatgcccagaggccccaccctgggccacgtgagcctgctgcccgagaacgacagatggaacgagaccagagcccagctgctggcccagatggacgtgagcatgggcggcagagtggccgaggagctgatcttcggcaccgaccacatcaccaccggcgccagcagcgacttcgacaacgccaccaagatcgccaagagaatggtgaccaagttcggcatgagcgagaagctgggcgtgatgacctacagcgacaccggcaagctgagccccgagacccagagcgccatcgagcaggagatcagaatcctgctgagagacagctacgagagagccaagcacatcctgaagacccacgccaaggagcacaagaacctggccgaggccctgctgacctacgagaccctggacgccaaggagatccagatcgtgctggagggcaagaagctggaggtgagatag

SEQ ID NO: 105479 - DNA, 2151 bp, Artificial Sequence
  Description of Artificial Sequence: Synthetic coding sequence
atgttcagcctgagcagcaccgtgcagccccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagcccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacggcaacctggacatcttcagcaccctgagaagcagctgcctgtacagacaccacagcagagccctgcagagcatctgcagcgacctgcagtactggcccgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggcgtggaggaggccaagcaggagctgcaggaggtggtggagttcctgaagaacccccagaagttcaccatcctgggcggcaagctgcccaagggcatcctgctggtgggcccccccggcaccggcaagaccctgctggccagagccgtggccggcgaggccgacgtgcccttctactacgccagcggcagcgagttcgacgagatgttcgtgggcgtgggcgccagcagaatcagaaacctgttcagagaggccaaggccaacgccccctgcgtgatcttcatcgacgagctggacagcgtgggcggcaagagaatcgagagccccatgcacccctacagcagacagaccatcaaccagctgctggccgagatggacggcttcaagcccaacgagggcgtgatcatcatcggcgccaccaacttccccgaggccctggacaacgccctgatcagacccggcagattcgacatgcaggtgaccgtgcccagacccgacgtgaagggcagaaccgagatcctgaagtggtacctgaacaagatcaagttcgaccagagcgtggaccccgagatcatcgccagaggcaccgtgggcttcagcggcgccgagctggagaacctggtgaaccaggccgccctgaaggccgccgtggacggcaaggagatggtgaccatgaaggagctggagttcagcaaggacaagatcctgatgggccccgagagaagaagcgtggagatcgacaacaagaacaagaccatcaccgcctaccacgagagcggccacgccatcatcgcctactacaccaaggacgccatgcccatcaacaaggccaccatcatgcccagaggccccaccctgggccacgtgagcctgctgcccgagaacgacagatggaacgagaccagagcccagctgctggcccagatggacgtgagcatgggcggcagagtggccgaggagctgatcttcggcaccgaccacatcaccaccggcgccagcagcgacttcgacaacgccaccaagatcgccaagagaatggtgaccaagttcggcatgagcgagaagctgggcgtgatgacctacagcgacaccggcaagctgagccccgagacccagagcgccatcgagcaggagatcagaatcctgctgagagacagctacgagagagccaagcacatcctgaagacccacgccaaggagcacaagaacctggccgaggccctgctgacctacgagaccctggacgccaaggagatccagatcgtgctggagggcaagaagctggaggtgagatag

SEQ ID NO: 105480 - DNA, 747 bp, Artificial Sequence
  Description of Artificial Sequence: Synthetic coding sequence
atgtaccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagcccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacggcaacctggacatcttcagcaccctgagaagcagctgcctgtacagacaccacagcagagccctgcagagcatctgcagcgacctgcagtactggcccgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttctag

SEQ ID NO: 105481 - DNA, 762 bp, Artificial Sequence
  Description of Artificial Sequence: Synthetic coding sequence
atgttcagcctgagcagcaccgtgcagccccaggtgaccgtgcccctgagccacctgatcaacgccttccacacccccaagaacaccagcgtgagcctgagcggcgtgagcgtgagccagaaccagcacagagacgtggtgcccgagcacgaggcccccagcagcgagcccagcctgaacctgagagacctgggcctgagcgagctgaagatcggccagatcgaccagctggtggagaacctgctgcccggcttctgcaagggcaagaacatcagcagccactggcacaccagccacgtgagcgcccagagcttcttcgagaacaagtacgtgttcatccagagcagaggcttcaagaccctgaagagcagaaccagaagactgcagagcaccagcgagagactggccgagacccagaacatcgcccccagcttcgtgaagggcttcctgctgagagacagaggcagcgacgtggagagcctggacaagctgatgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggctag

SEQ ID NO: 105482 - DNA, 1551 bp, Artificial Sequence
  Description of Artificial Sequence: Synthetic coding sequence
atgaagaccaagaacatccccgaggcccaccaggacgccttcaagaccggcttcgccgagggcttcctgaaggcccaggccctgacccagaagaccaacgacagcctgagaagaaccagactgatcctgttcgtgctgctgctgttcggcatctacggcctgctgaagaaccccttcctgagcgtgagattcagaaccaccaccggcctggacagcgccgtggaccccgtgcagatgaagaacgtgaccttcgagcacgtgaagggcgtggaggaggccaagcaggagctgcaggaggtggtggagttcctgaagaacccccagaagttcaccatcctgggcggcaagctgcccaagggcatcctgctggtgggcccccccggcaccggcaagaccctgctggccagagccgtggccggcgaggccgacgtgcccttctactacgccagcggcagcgagttcgacgagatgttcgtgggcgtgggcgccagcagaatcagaaacctgttcagagaggccaaggccaacgccccctgcgtgatcttcatcgacgagctggacagcgtgggcggcaagagaatcgagagccccatgcacccctacagcagacagaccatcaaccagctgctggccgagatggacggcttcaagcccaacgagggcgtgatcatcatcggcgccaccaacttccccgaggccctggacaacgccctgatcagacccggcagattcgacatgcaggtgaccgtgcccagacccgacgtgaagggcagaaccgagatcctgaagtggtacctgaacaagatcaagttcgaccagagcgtggaccccgagatcatcgccagaggcaccgtgggcttcagcggcgccgagctggagaacctggtgaaccaggccgccctgaaggccgccgtggacggcaaggagatggtgaccatgaaggagctggagttcagcaaggacaagatcctgatgggccccgagagaagaagcgtggagatcgacaacaagaacaagaccatcaccgcctaccacgagagcggccacgccatcatcgcctactacaccaaggacgccatgcccatcaacaaggccaccatcatgcccagaggccccaccctgggccacgtgagcctgctgcccgagaacgacagatggaacgagaccagagcccagctgctggcccagatggacgtgagcatgggcggcagagtggccgaggagctgatcttcggcaccgaccacatcaccaccggcgccagcagcgacttcgacaacgccaccaagatcgccaagagaatggtgaccaagttcggcatgagcgagaagctgggcgtgatgacctacagcgacaccggcaagctgagccccgagacccagagcgccatcgagcaggagatcagaatcctgctgagagacagctacgagagagccaagcacatcctgaagacccacgccaaggagcacaagaacctggccgaggccctgctgacctacgagaccatgcccaagagattcaagctgttcctgagaggcaagagctggaagtag

SEQ ID NO: 105483 - DNA, 1047 bp, Artificial Sequence
  Description of Artificial Sequence: Synthetic coding sequence
atgttcggccccgccaagggcagacacttcggcgtgcaccccgcccccggcttccccggcggcgtgagccagcaggccgccggcaccaaggccggccccgccggcgcctggcccgtgggcagcagaaccgacaccatgtggagactgagatgcaaggccaaggacggcacccacgtgctgcagggcctgagcagcagaaccagagtgagagagctgcagggccagatcgccgccatcaccggcatcgcccccggcggccagagaatcctggtgggctacccccccgagtgcctggacctgagcaacggcgacaccatcctggaggacctgcccatccagagcggcgacatgctgatcatcgaggaggaccagaccagacccagaagcagccccgccttcaccaagagaggcgccagcagctacgtgagagagaccctgcccgtgctgaccagaaccgtggtgcccgccgacaacagctgcctgttcaccagcgtgtactacgtggtggagggcggcgtgctgaaccccgcctgcgcccccgagatgagaagactgatcgcccagatcgtggccagcgaccccgacttctacagcgaggccatcctgggcaagaccaaccaggagtactgcgactggatcaagagagacgacacctggggcggcgccatcgagatcagcatcctgagcaagttctaccagtgcgagatctgcgtggtggacacccagaccgtgagaatcgacagattcggcgaggacgccggctacaccaagagagtgctgctgatctacgacggcatccactacgaccccctgcagagaaacttccccgaccccgacaccccccccctgaccatcttcagcagcaacgacgacatcgtgctggtgcaggccctggagctggccgacgaggccagaagaagaagacagttcaccgacgtgaacagattcaccctgagatgcatggtgtgccagaagggcctgaccggccaggccgaggccagagagcacgccaaggagaccggccacaccaacttcggcgaggtgtag

SEQ ID NO: 105484 - DNA, 915 bp, Artificial Sequence
  Description of Artificial Sequence: Synthetic coding sequence
atggagaccctgcacatcatctacagcgaggccaagagcttcaccgtggagggcctgagcagcagaaccagagtgagagagctgcagggccagatcgccgccatcaccggcatcgcccccggcggccagagaatcctggtgggctacccccccgagtgcctggacctgagcaacggcgacaccatcctggaggacctgcccatccagagcggcgacatgctgatcatcgaggaggaccagaccagacccagaagcagccccgccttcaccaagagaggcgccagcagctacgtgagagagaccctgcccgtgctgaccagaaccgtggtgcccgccgacaacagctgcctgttcaccagcgtgtactacgtggtggagggcggcgtgctgaaccccgcctgcgcccccgagatgagaagactgatcgcccagatcgtggccagcgaccccgacttctacagcgaggccatcctgggcaagaccaaccaggagtactgcgactggatcaagagagacgacacctggggcggcgccatcgagatcagcatcctgagcaagttctaccagtgcgagatctgcgtggtggacacccagaccgtgagaatcgacagattcggcgaggacgccggctacaccaagagagtgctgctgatctacgacggcatccactacgaccccctgcagagaaacttccccgaccccgacaccccccccctgaccatcttcagcagcaacgacgacatcgtgctggtgcaggccctggagctggccgacgaggccagaagaagaagacagttcaccgacgtgaacagattcaccctgagatgcatggtgtgccagaagggcctgaccggccaggccgaggccagagagcacgccaaggagaccggccacaccaacttcggcgaggtgtag

SEQ ID NO: 105485 - DNA, 915 bp, Artificial Sequence; identical to SEQ ID NO: 105484
  Description of Artificial Sequence: Synthetic coding sequence

SEQ ID NO: 105486 - DNA, 840 bp, Artificial Sequence
  Description of Artificial Sequence: Synthetic coding sequence
atgagccccgccagaagatgcagaggcatgagagccgccgtggccgccagcgtgggcctgagcgagggccccgccggcagcagaagcggcagactgttcagaccccccagccccgcccccgccgcccccggcgccagactgctgagactgcccggcagcggcgccgtgcaggccgccagccccgagagagccggctggaccgaggccctgagagccgccgtggccgagctgagagccggcgccgtggtggccgtgcccaccgacaccctgtacggcctggcctgcgccgccagctgcagcgccgccctgagagccgtgtacagactgaagggcagaagcgaggccaagcccctggccgtgtgcctgggcagagtggccgacgtgtacagatactgcagagtgagagtgcccgagggcctgctgaaggacctgctgcccggccccgtgaccctggtgatggagagaagcgaggagctgaacaaggacctgaaccccttcacccccctggtgggcatcagaatccccgaccacgccttcatgcaggacctggcccagatgttcgagggccccctggccctgaccagcgccaacctgagcagccaggccagcagcctgaacgtggaggagttccaggacctgtggccccagctgagcctggtgatcgacggcggccagatcggcgacggccagagccccgagtgcagactgggcagcaccgtggtggacctgagcgtgcccggcaagttcggcatcatcagacccggctgcgccctggagagcaccaccgccatcctgcagcagaagtacggcctgctgcccagccacgccagctacctgtag

SEQ ID NO: 105487 - DNA, 1740 bp, Artificial Sequence
  Description of Artificial Sequence: Synthetic coding sequence
atgagcgccagcagcctgctggagcagagacccaagggccagggcaacaaggtgcagaacggcagcgtgcaccagaaggacggcctgaacgacgacgacttcgagccctacctgagcccccaggccagacccaacaacgcctacaccgccatgagcgacagctacctgcccagctactacagccccagcatcggcttcagctacagcctgggcgaggccgcctggagcaccggcggcgacaccgccatgccctacctgaccagctacggccagctgagcaacggcgagccccacttcctgcccgacgccatgttcggccagcccggcgccctgggcagcacccccttcctgggccagcacggcttcaacttcttccccagcggcatcgacttcagcgcctggggcaacaacagcagccagggccagagcacccagagcagcggctacagcagcaactacgcctacgcccccagcagcctgggcggcgccatgatcgacggccagagcgccttcgccaacgagaccctgaacaaggcccccggcatgaacaccatcgaccagggcatggccgccctgaagctgggcagcaccgaggtggccagcaacgtgcccaaggtggtgggcagcgccgtgggcagcggcagcatcaccagcaacatcgtggccagcaacagcctgccccccgccaccatcgccccccccaagcccgccagctgggccgacatcgccagcaagcccgccaagcagcagcccaagctgaagaccaagaacggcatcgccggcagcagcctgccccccccccccatcaagcacaacatggacatcggcacctgggacaacaagggccccgtggccaaggcccccagccaggccctggtgcagaacatcggccagcccacccagggcagcccccagcccgtgggccagcaggccaacaacagcccccccgtggcccaggccagcgtgggccagcagacccagcccctgccccccccccccccccagcccgcccagctgagcgtgcagcagcaggccgcccagcccaccagatgggtggcccccagaaacagaggcagcggcttcggccacaacggcgtggacggcaacggcgtgggccagagccaggccggcagcggcagcacccccagcgagccccaccccgtgctggagaagctgagaagcatcaacaactacaaccccaaggacttcgactggaacctgaagcacggcagagtgttcatcatcaagagctacagcgaggacgacatccacagaagcatcaagtacaacatctggtgcagcaccgagcacggcaacaagagactggacgccgcctacagaagcatgaacggcaagggccccgtgtacctgctgttcagcgtgaacggcagcggccacttctgcggcgtggccgagatgaagagcgccgtggactacaacacctgcgccggcgtgtggagccaggacaagtggaagggcagattcgacgtgagatggatcttcgtgaaggacgtgcccaacagccagctgagacacatcagactggagaacaacgagaacaagcccgtgaccaacagcagagacacccaggaggtgcccctggagaaggccaagcaggtgctgaagatcatcgccagctacaagcacaccaccagcatcttcgacgacttcagccactacgagaagagacaggaggaggaggagagcgtgaagaaggagagacagggcagaggcaagtag

SEQ ID NO: 105488 - DNA, 1710 bp, Artificial Sequence
  Description of Artificial Sequence: Synthetic coding sequence
atgagcgccagcagcctgctggagcagagacccaagggccagggcaacaaggtgcagaacggcagcgtgcaccagaaggacggcctgaacgacgacgacttcgagccctacctgagcccccaggccagacccaacaacgcctacaccgccatgagcgacagctacctgcccagctactacagccccagcatcggcttcagctacagcctgggcgaggccgcctggagcaccggcggcgacaccgccatgccctacctgaccagctacggccagctgagcaacggcgagccccacttcctgcccgacgccatgttcggccagcccggcgccctgggcagcacccccttcctgggccagcacggcttcaacttcttccccagcggcatcgacttcagcgcctggggcaacaacagcagccagggccagagcacccagagcagcggctacagcagcaactacgcctacgcccccagcagcctgggcggcgccatgatcgacggccagagcgccttcgccaacgagaccctgaacaaggcccccggcatgaacaccatcgaccagggcatggccgccctgaagctgggcagcaccgaggtggccagcaacgtgcccaaggtggtgggcagcgccgtgggcagcggcagcatcaccagcaacatcgtggccagcaacagcctgccccccgccaccatcgccccccccaagcccgccagctgggccgacatcgccagcaagcccgccaagcagcagcccaagctgaagaccaagaacggcatcgccggcagcagcctgccccccccccccatcaagcacaacatggacatcggcacctgggacaacaagggccccgtggccaaggcccccagccaggccctggtgcagaacatcggccagcccacccagggcagcccccagcccgtgggccagcaggccaacaacagcccccccgtggcccaggccagcgtgggccagcagacccagcccctgccccccccccccccccagcccgcccagctgagcgtgcagcagcaggccgcccagcccaccagatgggtggcccccagaaacagaggcagcggcttcggccacaacggcgtggacggcaacggcgtgggccagagccaggccggcagcggcagcacccccagcgagccccaccccgtgctggagaagctgagaagcatcaacaactacaaccccaaggacttcgactggaacctgaagcacggcagagtgttcatcatcaagagctacagcgaggacgacatccacagaagcatcaagtacaacatctggtgcagcaccgagcacggcaacaagagactggacgccgcctacagaagcatgaacggcaagggccccgtgtacctgctgttcagcgtgaacggcagcggccacttctgcggcgtggccgagatgaagagcgccgtggactacaacacctgcgccggcgtgtggagccaggacaagtggaagggcagattcgacgtgagatggatcttcgtgaaggacgtgcccaacagccagctgagacacatcagactggagaacaacgagaacaagcccgtgaccaacagcagagacacccaggaggtgcccctggagaaggccaagcaggtgctgaagatcatcgccagctacaagcacaccaccagcatcttcgacgacttcagccactacgagaagagacagggcagaagaaagtgctag

SEQ ID NO: 105489 - DNA, 1590 bp, Artificial Sequence
  Description of Artificial Sequence: Synthetic coding sequence
atgagcgacagctacctgcccagctactacagccccagcatcggcttcagctacagcctgggcgaggccgcctggagcaccggcggcgacaccgccatgccctacctgaccagctacggccagctgagcaacggcgagccccacttcctgcccgacgccatgttcggccagcccggcgccctgggcagcacccccttcctgggccagcacggcttcaacttcttccccagcggcatcgacttcagcgcctggggcaacaacagcagccagggccagagcacccagagcagcggctacagcagcaactacgcctacgcccccagcagcctgggcggcgccatgatcgacggccagagcgccttcgccaacgagaccctgaacaaggcccccggcatgaacaccatcgaccagggcatggccgccctgaagctgggcagcaccgaggtggccagcaacgtgcccaaggtggtgggcagcgccgtgggcagcggcagcatcaccagcaacatcgtggccagcaacagcctgccccccgccaccatcgccccccccaagcccgccagctgggccgacatcgccagcaagcccgccaagcagcagcccaagctgaagaccaagaacggcatcgccggcagcagcctgccccccccccccatcaagcacaacatggacatcggcacctgggacaacaagggccccgtggccaaggcccccagccaggccctggtgcagaacatcggccagcccacccagggcagcccccagcccgtgggccagcaggccaacaacagcccccccgtggcccaggccagcgtgggccagcagacccagcccctgccccccccccccccccagcccgcccagctgagcgtgcagcagcaggccgcccagcccaccagatgggtggcccccagaaacagaggcagcggcttcggccacaacggcgtggacggcaacggcgtgggccagagccaggccggcagcggcagcacccccagcgagccccaccccgtgctggagaagctgagaagcatcaacaactacaaccccaaggacttcgactggaacctgaagcacggcagagtgttcatcatcaagagctacagcgaggacgacatccacagaagcatcaagtacaacatctggtgcagcaccgagcacggcaacaagagactggacgccgcctacagaagcatgaacggcaagggccccgtgtacctgctgttcagcgtgaacggcagcggccacttctgcggcgtggccgagatgaagagcgccgtggactacaacacctgcgccggcgtgtggagccaggacaagtggaagggcagattcgacgtgagatggatcttcgtgaaggacgtgcccaacagccagctgagacacatcagactggagaacaacgagaacaagcccgtgaccaacagcagagacacccaggaggtgcccctggagaaggccaagcaggtgctgaagatcatcgccagctacaagcacaccaccagcatcttcgacgacttcagccactacgagaagagacaggaggaggaggagagcgtgaagaaggagagacagggcagaggcaagtag

SEQ ID NO: 105490 - DNA, 1740 bp, Artificial Sequence; identical to SEQ ID NO: 105487
  Description of Artificial Sequence: Synthetic coding sequence

SEQ ID NO: 105491 - DNA, 1245 bp, Artificial Sequence
  Description of Artificial Sequence: Synthetic coding sequence
atggccagcggcgacaccctgtacatcgccaccgacggcagcgagatgcccgccgagatcgtggagctgcacgagatcgaggtggagaccatccccgtggagaccatcgagaccaccgtggtgggcgaggaggaggaggaggacgacgacgacgaggacggcggcggcggcgaccacggcggcggcggcggccacggccacgccggccaccaccaccaccaccaccaccaccaccaccacccccccatgatcgccctgcagcccctggtgaccgacgaccccacccaggtgcaccaccaccaggaggtgatcctggtgcagaccagagaggaggtggtgggcggcgacgacagcgacggcctgagagccgaggacggcttcgaggaccagatcctgatccccgtgcccgcccccgccggcggcgacgacgactacatcgagcagaccctggtgaccgtggccgccgccggcaagagcggcggcggcggcagcagcagcagcggcggcggcagagtgaagaagggcggcggcaagaagagcggcaagaagagctacctgagcggcggcgccggcgccgccggcggcggcggcgccgaccccggcaacaagaagtgggagcagaagcaggtgcagatcaagaccctggagggcgagttcagcgtgaccatgtggagcagcgacgagaagaaggacatcgaccacgagaccgtggtggaggagcagatcatcggcgagaacagcccccccgactacagcgagtacatgaccggcaagaagctgccccccggcggcatccccggcatcgacctgagcgaccccaagcagctggccgagttcgccagaatgaagcccagaaagatcaaggaggacgacgcccccagaaccatcgcctgcccccacaagggctgcaccaagatgttcagagacaacagcgccatgagaaagcacctgcacacccacggccccagagtgcacgtgtgcgccgagtgcggcaaggccttcgtggagagcagcaagctgaagagacaccagctggtgcacaccggcgagaagcccttccagtgcaccttcgagggctgcggcaagagattcagcctggacttcaacctgagaacccacgtgagaatccacaccggcgacagaccctacgtgtgccccttcgacggctgcaacaagaagttcgcccagagcaccaacctgaagagccacatcctgacccacgccaaggccaagaacaaccagtag

SEQ ID NO: 105492 - DNA, 105 bp, Artificial Sequence
  Description of Artificial Sequence: Synthetic coding sequence
atggccagcggcgacaccctgtacatcgccaccgacggcagcgagatgcccgccgagatcgtggagctgcacgagatcgaggtggagaccatccccgtggagtag

SEQ ID NO: 105493 - DNA, 1221 bp, Artificial Sequence
  Description of Artificial Sequence: Synthetic coding sequence
atggcccaggcccccgccgaccccggcagagagggccacctggagcagagaatcctgcaggtgctgaccgaggccggcagccccgtgaagctggcccagctggtgaaggagtgccaggcccccaagagagagctgaaccaggtgctgtacagaatgaagaaggagctgaaggtgagcctgaccagccccgccacctggtgcctgggcggcaccgaccccgagggcgagggccccgccgagctggccctgagcagccccgaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcagcgccggccccagacacctgcccagcatggcccccggcgacagcagcacctggggcaccctggtggacccctggggcccccaggacatccacatggagcagagcatcctgagaagagtgcagctgggccacagcaacgagatgagactgcacggcgtgcccagcgagggccccgcccacatcccccccggcagcccccccgtgagcgccaccgccgccggccccgaggccagcttcgaggccagaatccccagccccggcacccaccccgagggcgaggccgcccagagaatccacatgaagagctgcttcctggaggacgccaccatcggcaacagcaacaagatgagcatcagccccggcgtggccggccccggcggcgtggccggcagcggcgagggcgagcccggcgaggacgccggcagaagacccgccgacacccagagcagaagccacttccccagagacatcggccagcccatcacccccagccacagcaagctgacccccaagctggagaccatgaccctgggcaacagaagccacaaggccgccgagggcagccactacgtggacgaggccagccacgagggcagctggtggggcggcggcatctag

SEQ ID NO: 105494 - DNA, 1341 bp, Artificial Sequence
  Description of Artificial Sequence: Synthetic coding sequence
atggcccaggcccccgccgaccccggcagagagggccacctggagcagagaatcctgcaggtgctgaccgaggccggcagccccgtgaagctggcccagctggtgaaggagtgccaggcccccaagagagagctgaaccaggtgctgtacagaatgaagaaggagctgaaggtgagcctgaccagccccgccacctggtgcctgggcggcaccgaccccgagggcgagggccccgccgagctggccctgagcagccccgccgagagaccccagcagcacgccgccaccatccccgagacccccggcccccagttcagccagcagagagaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcagcgccggccccagacacctgcccagcatggcccccggcgacagcagcacctggggcaccctggtggacccctggggcccccaggacatccacatggagcagagcatcctgagaagagtgcagctgggccacagcaacgagatgagactgcacggcgtgcccagcgagggccccgcccacatcccccccggcagcccccccgtgagcgccaccgccgccggccccgaggccagcttcgaggccagaatccccagccccggcacccaccccgagggcgaggccgcccagagaatccacatgaagagctgcttcctggaggacgccaccatcggcaacagcaacaagatgagcatcagccccggcgtggccggccccggcggcgtggccggcagcggcgagggcgagcccggcgaggacgccgtggccgccttcaccgaggtgctgaaccccagcaagagcttcatgaagttcggcatcaacttcttccagacccccgtgaacgtggacagcctgaccagcagccacgagagccagatgttcctgaccgcctgcagactggtgatcttcagcagaagattcagcacctacttcgcccagatccacctgagaaaccacagcgtgctgcacctgtgcccccacaagatctacctgctgaagaacaagaagtag

SEQ ID NO: 105495 - DNA, 1143 bp, Artificial Sequence
  Description of Artificial Sequence: Synthetic coding sequence
atggcccaggcccccgccgaccccggcagagagggccacctggagcagagaatcctgcaggtgctgaccgaggccggcagccccgtgaagctggcccagctggtgaaggagtgccaggcccccaagagagagctgaaccaggtgctgtacagaatgaagaaggagctgaaggtgagcctgaccagccccgccacctggtgcctgggcggcaccgaccccgagggcgagggccccgccgagctggccctgagcagccccgccgagagaccccagcagcacgccgccaccatccccgagacccccggcccccagttcagccagcagagagaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcagcgccggccccagacacctgcccagcatggcccccggcgacagcagcacctggggcaccctggtggacccctggggcccccaggacatccacatggagcagagcatcctgagaagagtgcagctgggccacagcaacgagatgagactgcacggcgtgcccagcgagggccccgcccacatcccccccggcagcccccccgtgagcgccaccgccgccggccccgaggccagcttcgaggccagaatccccagccccggcacccaccccgagggcgaggccgcccagagaatccacatgaagagctgcttcctggaggacgccaccatcggcaacagcaacaagatgagcatcagccccggcgtggccggccccggcggcgtggccggcagcggcgagggcgagcccggcgaggacgccggcagaagacccgccgacacccaggccagaagcttcgacggccaggagtag

SEQ ID NO: 105496 - DNA, 1290 bp, Artificial Sequence
  Description of Artificial Sequence: Synthetic coding sequence
atggcccaggcccccgccgaccccggcagagagggccacctggagcagagaatcctgcaggtgctgaccgaggccggcagccccgtgaagctggcccagctggtgaaggagtgccaggcccccaagagagagctgaaccaggtgctgtacagaatgaagaaggagctgaaggtgagcctgaccagccccgccacctggtgcctgggcggcaccgaccccgagggcgagggccccgccgagctggccctgagcagccccgccgagagaccccagcagcacgccgccaccatccccgagacccccggcccccagttcagccagcagagagaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcagcgccggccccagacacctgcccagcatggcccccggcgacagcagcacctggggcaccctggtggacccctggggcccccaggacatccacatggagcagagcatcctgagaagagtgcagctgggccacagcaacgagatgagactgcacggcgtgcccagcgagggccccgcccacatcccccccggcagcccccccgtgagcgccaccgccgccggccccgaggccagcttcgaggccagaatccccagccccggcacccaccccgagggcgaggccgcccagagaatccacatgaagagctgcttcctggaggacgccaccatcggcaacagcaacaagatgagcatcagccccggcgtggccggccccggcggcgtggccggcagcggcgagggcgagcccggcgaggacgccggcagaagacccgccgacacccagagcagaagccacttccccagagacatcggccagcccatcacccccagccacagcaagctgacccccaagctggagaccatgaccctgggcaacagaagccacaaggccgccgagggcagccactacgtggacgaggccagccacgagggcagctggtggggcggcggcatctag

SEQ ID NO: 105497 - DNA, 747 bp, Artificial Sequence
  Description of Artificial Sequence: Synthetic coding sequence
atggcccaggcccccgccgaccccggcagagagggccacctggagcagagaatcctgcaggtgctgaccgaggccggcagccccgtgaagctggcccagctggtgaaggagtgccaggcccccaagagagagctgaaccaggtgctgtacagaatgaagaaggagctgaaggtgagcctgaccagccccgccacctggtgcctgggcggcaccgaccccgagggcgagggccccgccgagctggccctgagcagccccgccgagagaccccagcagcacgccgccaccatccccgagacccccggcccccagttcagccagcagagagaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcaagagccccaagagagcccagggcggcgacctgggcggcgagccccccgaccccctgggcggcggcaagggctag

SEQ ID NO: 105498 - DNA, 1065 bp, Artificial Sequence
  Description of Artificial Sequence: Synthetic coding sequence
atggcccaggcccccgccgaccccggcagagaggccgagagaccccagcagcacgccgccaccatccccgagacccccggcccccagttcagccagcagagagaggaggacatctacagattcctgaaggacaacggcccccagagagccctggtgatcgcccaggccctgggcatgagaaccgccaaggacgtgaacagagacctgtacagaatgaagagcagacacctgctggacatggacgagcagagcaaggcctggaccatctacagacccgaggacagcggcagaagagccaagagcgccagcatcatctaccagcacaaccccatcaacatgatctgccagaacggccccaacagctggatcagcatcgccaacagcgaggccatccagatcggccacggcaacatcatcaccagacagaccgtgagcagagaggacggcagcgccggccccagacacctgcccagcatggcccccggcgacagcagcacctggggcaccctggtggacccctggggcccccaggacatccacatggagcagagcatcctgagaagagtgcagctgggccacagcaacgagatgagactgcacggcgtgcccagcgagggccccgcccacatcccccccggcagcccccccgtgagcgccaccgccgccggccccgaggccagcttcgaggccagaatccccagccccggcacccaccccgagggcgaggccgcccagagaatccacatgaagagctgcttcctggaggacgccaccatcggcaacagcaacaagatgagcatcagccccggcgtggccggccccggcggcgtggccggcagcggcgagggcgagcccggcgaggacgccggcagaagacccgccgacacccagagcagaagccacttccccagagacatcggccagcccatcacccccagccacagcaagctgacccccaagctggagaccatgaccctgggcaacagaagccacaaggccgccgagggcagccactacgtggacgaggccagccacgagggcagctggtggggcggcggcatctag

SEQ ID NO: 105499 - DNA, 1860 bp, Artificial Sequence
  Description of Artificial Sequence: Synthetic coding sequence
atgcccgaccccgccgcccacctgcccttcttctacggcagcatcagcagagccgaggccgaggagcacctgaagctggccggcatggccgacggcctgttcctgctgagacagtgcctgagaagcctgggcggctacgtgctgagcctggtgcacgacgtgagattccaccacttccccatcgagagacagctgaacggcacctacgccatcgccggcggcaaggcccactgcggccccgccgagctgtgcgagttctacagcagagaccccgacggcctgccctgcaacctgagaaagccctgcaacagacccagcggcctggagccccagcccggcgtgttcgactgcctgagagacgccatggtgagagactacgtgagacagacctggaagctggagggcgaggccctggagcaggccatcatcagccaggccccccaggtggagaagctgatcgccaccaccgcccacgagagaatgccctggtaccacagcagcctgaccagagaggaggccgagagaaagctgtacagcggcgcccagaccgacggcaagttcctgctgagacccagaaaggagcagggcacctacgccctgagcctgatctacggcaagaccgtgtaccactacctgatcagccaggacaaggccggcaagtactgcatccccgagggcaccaagttcgacaccctgtggcagctggtggagtacctgaagctgaaggccgacggcctgatctactgcctgaaggaggcctgccccaacagcagcgccagcaacgccagcggcgccgccgcccccaccctgcccgcccaccccagcaccctgacccacccccagagaagaatcgacaccctgaacagcgacggctacacccccgagcccgccagaatcaccagccccgacaagcccagacccatgcccatggacaccagcgtgtacgagagcccctacagcgaccccgaggagctgaaggacaagaagctgttcctgaagagagacaacctgctgatcgccgacatcgagctgggctgcggcaacttcggcagcgtgagacagggcgtgtacagaatgagaaagaagcagatcgacgtggccatcaaggtgctgaagcagggcaccgagaaggccgacaccgaggagatgatgagagaggcccagatcatgcaccagctggacaacccctacatcgtgagactgatcggcgtgtgccaggccgaggccctgatgctggtgatggagatggccggcggcggccccctgcacaagttcctggtgggcaagagagaggagatccccgtgagcaacgtggccgagctgctgcaccaggtgagcatgggcatgaagtacctggaggagaagaacttcgtgcacagagacctggccgccagaaacgtgctgctggtgaacagacactacgccaagatcagcgacttcggcctgagcaaggccctgggcgccgacgacagctactacaccgccagaagcgccggcaagtggcccctgaagtggtacgcccccgagtgcatcaacttcagaaagttcagcagcagaagcgacgtgtggagctacggcgtgaccatgtgggaggccctgagctacggccagaagccctacaagaagatgaagggccccgaggtgatggccttcatcgagcagggcaagagaatggagtgcccccccgagtgcccccccgagctgtacgccctgatgagcgactgctggatctacaagtgggaggacagacccgacttcctgaccgtggagcagagaatgagagcctgctactacagcctggccagcaaggtggagggcccccccggcagcacccagaaggccgaggccgcctgcgcctag

SEQ ID NO: 105500 - DNA, 1482 bp, Artificial Sequence
  Description of Artificial Sequence: Synthetic coding sequence
atgagactgggccccagatggaagggcgaggccctggagcaggccatcatcagccaggccccccaggtggagaagctgatcgccaccaccgcccacgagagaatgccctggtaccacagcagcctgaccagagaggaggccgagagaaagctgtacagcggcgcccagaccgacggcaagttcctgctgagacccagaaaggagcagggcacctacgccctgagcctgatctacggcaagaccgtgtaccactacctgatcagccaggacaaggccggcaagtactgcatccccgagggcaccaagttcgacaccctgtggcagctggtggagtacctgaagctgaaggccgacggcctgatctactgcctgaaggaggcctgccccaacagcagcgccagcaacgccagcggcgccgccgcccccaccctgcccgcccaccccagcaccctgacccacccccagagaagaatcgacaccctgaacagcgacggctacacccccgagcccgccagaatcaccagccccgacaagcccagacccatgcccatggacaccagcgtgtacgagagcccctacagcgaccccgaggagctgaaggacaagaagctgttcctgaagagagacaacctgctgatcgccgacatcgagctgggctgcggcaacttcggcagcgtgagacagggcgtgtacagaatgagaaagaagcagatcgacgtggccatcaaggtgctgaagcagggcaccgagaaggccgacaccgaggagatgatgagagaggcccagatcatgcaccagctggacaacccctacatcgtgagactgatcggcgtgtgccaggccgaggccctgatgctggtgatggagatggccggcggcggccccctgcacaagttcctggtgggcaagagagaggagatccccgtgagcaacgtggccgagctgctgcaccaggtgagcatgggcatgaagtacctggaggagaagaacttcgtgcacagagacctggccgccagaaacgtgctgctggtgaacagacactacgccaagatcagcgacttcggcctgagcaaggccctgggcgccgacgacagctactacaccgccagaagcgccggcaagtggcccctgaagtggtacgcccccgagtgcatcaacttcagaaagttcagcagcagaagcgacgtgtggagctacggcgtgaccatgtgggaggccctgagctacggccagaagccctacaagaagatgaagggccccgaggtgatggccttcatcgagcagggcaagagaatggagtgcccccccgagtgcccccccgagctgtacgccctgatgagcgactgctggatctacaagtgggaggacagacccgacttcctgaccgtggagcagagaatgagagcctgctactacagcctggccagcaaggtggagggcccccccggcagcacccagaaggccgaggccgcctgcgcctag

SEQ ID NO: 105501 - DNA, 939 bp, Artificial Sequence
  Description of Artificial Sequence: Synthetic coding sequence
atgcccatggacaccagcgtgtacgagagcccctacagcgaccccgaggagctgaaggacaagaagctgttcctgaagagagacaacctgctgatcgccgacatcgagctgggctgcggcaacttcggcagcgtgagacagggcgtgtacagaatgagaaagaagcagatcgacgtggccatcaaggtgctgaagcagggcaccgagaaggccgacaccgaggagatgatgagagaggcccagatcatgcaccagctggacaacccctacatcgtgagactgatcggcgtgtgccaggccgaggccctgatgctggtgatggagatggccggcggcggccccctgcacaagttcctggtgggcaagagagaggagatccccgtgagcaacgtggccgagctgctgcaccaggtgagcatgggcatgaagtacctggaggagaagaacttcgtgcacagagacctggccgccagaaacgtgctgctggtgaacagacactacgccaagatcagcgacttcggcctgagcaaggccctgggcgccgacgacagctactacaccgccagaagcgccggcaagtggcccctgaagtggtacgcccccgagtgcatcaacttcagaaagttcagcagcagaagcgacgtgtggagctacggcgtgaccatgtgggaggccctgagctacggccagaagccctacaagaagatgaagggccccgaggtgatggccttcatcgagcagggcaagagaatggagtgcccccccgagtgcccccccgagctgtacgccctgatgagcgactgctggatctacaagtgggaggacagacccgacttcctgaccgtggagcagagaatgagagcctgctactacagcctggccagcaaggtggagggcccccccggcagcacccagaaggccgaggccgcctgcgcctag

SEQ ID NO: 105502 - DNA, 1344 bp, Artificial Sequence
  Description of Artificial Sequence: Synthetic coding sequence
atgctgctggacgccggcccccagtaccccgccatcggcgtgaccaccttcggcgccagcagacaccacagcgccggcgacgtggccgagagagacgtgggcctgggcatcaaccccttcgccgacggcatgggcgccttcaagctgaaccccagcagccacgagctggccagcgccggccagaccgccttcaccagccaggcccccggctacgccgccgccgccgccctgggccaccaccaccaccccggccacgtgggcagctacagcagcgccgccttcaacagcaccagagacttcctgttcagaaacagaggcttcggcgacgccgccgccgccgccagcgcccagcacagcctgttcgccgccagcgccggcggcttcggcggcccccacggccacaccgacgccgccggccacctgctgttccccggcctgcacgagcaggccgccggccacgccagccccaacgtggtgaacggccagatgagactgggcttcagcggcgacatgtaccccagacccgagcagtacggccaggtgaccagccccagaagcgagcactacgccgccccccagctgcacggctacggccccatgaacgtgaacatggccgcccaccacggcgccggcgccttcttcagatacatgagacagcccatcaagcaggagctgatctgcaagtggatcgagcccgagcagctggccaaccccaagaagagctgcaacaagaccttcagcaccatgcacgagctggtgacccacgtgaccgtggagcacgtgggcggccccgagcagagcaaccacatctgcttctgggaggagtgccccagagagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttcaagtgcgagttcgagggctgcgacagaagattcgccaacagcagcgacagaaagaagcacatgcacgtgcacaccagcgacaagccctacctgtgcaagatgtgcgacaagagctacacccaccccagcagcctgagaaagcacatgaaggtgcacgagagcagcagccagggcagccagcccagccccgccgccagcagcggctacgagagcagcaccccccccaccatcgtgagccccagcaccgacaaccccaccaccagcagcctgagccccagcagcagcgccgtgcaccacaccgccggccacagcgccctgagcagcaacttcaacgagtggtacgtgtag

SEQ ID NO: 105503 - DNA, 1599 bp, Artificial Sequence
  Description of Artificial Sequence: Synthetic coding sequence
atgctgctggacgccggcccccagttccccgccatcggcgtgggcagcttcgccagacaccaccaccacagcgccgccgccgccgccgccgccgccgccgagatgcaggacagagagctgagcctggccgccgcccagaacggcttcgtggacagcgccgccgcccacatgggcgccttcaagctgaaccccggcgcccacgagctgagccccggccagagcagcgccttcaccagccagggccccggcgcctaccccggcagcgccgccgccgccgccgccgccgccgccctgggcccccacgccgcccacgtgggcagctacagcggcccccccttcaacagcaccagagacttcctgttcagaagcagaggcttcggcgacagcgcccccggcggcggccagcacggcctgttcggccccggcgccggcggcctgcaccacgcccacagcgacgcccagggccacctgctgttccccggcctgcccgagcagcacggcccccacggcagccagaacgtgctgaacggccagatgagactgggcctgcccggcgaggtgttcggcagaagcgagcagtacagacaggtggccagccccagaaccgacccctacagcgccgcccagctgcacaaccagtacggccccatgaacatgaacatgggcatgaacatggccgccgccgccgcccaccaccaccaccaccaccaccaccaccccggcgccttcttcagatacatgagacagcagtgcatcaagcaggagctgatctgcaagtggatcgaccccgagcagctgagcaaccccaagaagagctgcaacaagaccttcagcaccatgcacgagctggtgacccacgtgagcgtggagcacgtgggcggccccgagcagagcaaccacgtgtgcttctgggaggagtgccccagagagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttccagtgcgagttcgagggctgcgacagaagattcgccaacagcagcgacagaaagaagcacatgcacgtgcacaccagcgacaagccctacctgtgcaagatgtgcgacaagagctacacccaccccagcagcctgagaaagcacatgaaggtgcacgagagcagcccccagggcagcgagagcagccccgccgccagcagcggctacgagagcagcaccccccccggcctggtgagccccagcgccgagccccagagcagcagcaacctgagccccgccgccgccgccgccgccgccgccgccgccgccgccgccgccgccgtgagcgccgtgcacagaggcggcggcagcggcagcggcggcgccggcggcggcagcggcggcggcagcggcagcggcggcggcggcggcggcgccggcggcggcggcggcggcagcagcggcggcggcagcggcaccgccggcggccacagcggcctgagcagcaacttcaacgagtggtacgtgtag

SEQ ID NO: 105504 - DNA, 489 bp, Artificial Sequence
  Description of Artificial Sequence: Synthetic coding sequence
ccccccccccccccccccccccccgccccccccccccccccccccctgaaccccaagaagagctgcaacaagaccttcagcaccatgcacgagctggtgacccacgtgagcgtggagcacgtgggcggccccgagcagagcaaccacgtgtgcttctgggaggagtgccccagagagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttccagtgcgagttcgagggctgcgacagaagattcgccaacagcagcgacagaaagaagcacatgcacgtgcacaccagcgacaagccctacctgtgcaagatgtgcgacaagagctacacccaccccagcagcctgagaaagcacatgaagtag

SEQ ID NO: 105505 - DNA, 783 bp, Artificial Sequence
  Description of Artificial Sequence: Synthetic coding sequence
atgctgctggacgccggcccccagttccccgccatcggcgtgggcagcttcgccagacaccaccaccacagcgccgccgccgccgccgccgccgccgccgagatgcaggacagagagctgagcctggccgccgcccagaacggcttcgtggacagcgccgccgcccacatgggcgccttcaagctgaaccccggcgcccacgagctgagccccggccagagcagcgccttcaccagccagggccccggcgcctaccccggcagcgccgccgccgccgccgccgccgccgccctgggcccccacgccgcccacgtgggcagctacagcggcccccccttcaacagcaccagagacttcctgttcagaagcagaggcttcggcgacagcgcccccggcggcggccagcacggcctgttcggccccggcgccggcggcctgcaccacgcccacagcgacgcccagggccacctgctgttccccggcctgcccgagcagcacggcccccacggcagccagaacgtgctgaacggccagatgagactgggcctgcccggcgaggtgttcggcagaagcgagcagtacagacaggtggccagccccagaaccgacccctacagcgccgcccagctgcacaaccagtacggccccatgaacatgaacatgggcatgaacatggccgccgccgccgcccaccaccaccaccaccaccaccaccccgtgcccagcctgctgaccaactgcgtgcacagcggcctgctgctgagcccccccagatggttctag

SEQ ID NO: 105506 - DNA, 1404 bp, Artificial Sequence
  Description of Artificial Sequence: Synthetic coding sequence
atgaccatgctgctggacggcggcccccagttccccggcctgggcgtgggcagcttcggcgcccccagacaccacgagatgcccaacagagagcccgccggcatgggcctgaaccccttcggcgacagcacccacgccgccgccgccgccgccgccgccgccgccttcaagctgagccccgccgccgcccacgacctgagcagcggccagagcagcgccttcaccccccagggcagcggctacgccaacgccctgggccaccaccaccaccaccaccaccaccaccaccacaccagccaggtgcccagctacggcggcgccgccagcgccgccttcaacagcaccagagagttcctgttcagacagagaagcagcggcctgagcgaggccgccagcggcggcggccagcacggcctgttcgccggcagcgccagcagcctgcacgcccccgccggcatccccgagccccccagctacctgctgttccccggcctgcacgagcagggcgccggccaccccagccccaccggccacgtggacaacaaccaggtgcacctgggcctgagaggcgagctgttcggcagagccgacccctacagacccgtggccagccccagaaccgacccctacgccgccggcgcccagttccccaactacagccccatgaacatgaacatgggcgtgaacgtggccgcccaccacggccccggcgccttcttcagatacatgagacagcccatcaagcaggagctgagctgcaagtggatcgacgaggcccagctgagcagacccaagaagagctgcgacagaaccttcagcaccatgcacgagctggtgacccacgtgaccatggagcacgtgggcggccccgagcagaacaaccacgtgtgctactgggaggagtgccccagagagggcaagagcttcaaggccaagtacaagctggtgaaccacatcagagtgcacaccggcgagaagcccttcccctgccccttccccggctgcggcaagatcttcgccagaagcgagaacctgaagatccacaagagaacccacaccggcgagaagcccttcaagtgcgagttcgagggctgcgacagaagattcgccaacagcagcgacagaaagaagcacatgcacgtgcacaccagcgacaagccctacatctgcaaggtgtgcgacaagagctacacccaccccagcagcctgagaaagcacatgaaggtgcacgagagccagggcagcgacagcagccccgccgccagcagcggctacgagagcagcaccccccccgccatcgccagcgccaacagcaaggacaccaccaagacccccagcgccgtgcagaccagcaccagccacaaccccggcctgccccccaacttcaacgagtggtacgtgtag

SEQ ID NO: 105507 - DNA, 1374 bp, Artificial Sequence
  Description of Artificial Sequence: Synthetic coding sequence
atgaccatgctgctggacggcggcccccagttccccggcctgggcgtgggcagcttcggcgcccccagacaccacgagatgcccaacagagagcccgccggcatgggcctgaaccccttcggcgacagcacccacgccgccgccgccgccgccgccgccgccgccttcaagctgagccccgccgccgcccacgacctgagcagcggccagagcagcgccttcaccccccagggcagcggctacgccaacgccctgggccaccaccaccaccaccaccaccaccaccaccacaccagccaggtgcccagctacggcggcgccgccagcgccgccttcaacagcaccagagagttcctgttcagacagagaagcagcggcctgagcgaggccgccagcggcggcggccagcacggcctgttcgccggcagcgccagcagcctgcacgcccccgccggcatccccgagccccccagctacctgctgttccccggcctgcacgagcagggcgccggccaccccagccccaccggccacgtggacaacaaccaggtgcacctgggcctgagaggcgagctgttcggcagagccgacccctacagacccgtggccagccccagaaccgacccctacgccgccggcgcccagttccccaactacagccccatgaacatgaacatgggcgtgaacgtggccgcccaccacggccccggcgccttcttcagatacatgagacagcccatcaagcaggagctgagctgcaagtggatcgacgaggcccagctgagcagacccaagaagagctgcgacagaaccttcagcaccatgcacgagctggtgacccacgtgaccatggagcacgtgggcggccccgagcagaacaaccacgtgtgctactgggaggagtgccccagagagggcaagagcttcaaggccaagtacaagctggtgaaccacatcagagtgcacaccggcgagaagcccttcccctgccccttccccggctgcggcaagatcttcgccagaagcgagaacctgaagatccacaagagaacccacaccggcgagaagcccttcaagtgcgagttcgagggctgcgacagaagattcgccaacagcagcgacagaaagaagcacatgcacgtgcacaccagcgacaagccctacatctgcaaggtgtgcgacaagagctacacccaccccagcagcctgagaaagcacatgaagtgctgccccgcctggtaccccggccagagcctgatccccgacgaggagctggacaccgacgtgggcatgcagcagcccgccctgcacaacaccacctaccccaagtgcagagtgaacgccgagcccaccgtgcaggagatgatctactag

SEQ ID NO: 105508 - DNA, 1005 bp, Artificial Sequence
  Description of Artificial Sequence: Synthetic coding sequence
atgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgcccggcgacatgtacgccagacccgagcccttcccccccggccccgccgccagaagcgacgccctggccgccgccgccgccctgcacggctacggcggcatgaacctgaccgtgaacctggccgccccccacggccccggcgccttcttcagatacatgagacagcccatcaagcaggagctgatctgcaagtggctggccgccgacggcaccgccacccccagcctgtgcagcaagaccttcagcaccatgcacgagctggtgacccacgtgaccgtggagcacgtgggcggccccgagcaggccaaccacatctgcttctgggaggagtgccccagacagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttcagatgcgagttcgagggctgcgagagaagattcgccaacagcagcgacagaaagaagcacagccacgtgcacaccagcgacaagccctacacctgcaaggtgagaggctgcgacaagtgctacacccaccccagcagcctgagaaagcacatgaaggtgcacggcagaagccccccccccagcagcggctacgacagcgccacccccagcgccctggtgagccccagcagcgactgcggccacaagagccaggtggccagcagcgccgccgtggccgccagaaccgccgacctgagcgagtag

SEQ ID NO: 105509 - DNA, 1119 bp, Artificial Sequence
  Description of Artificial Sequence: Synthetic coding sequence
atgaacggcccctgccagagcctgagaaaggccgagggcctgctggagggctgcaccagcgccgtgaccgtgttcagaaagctgcccctggacagcaaggcccagagccagaagatgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgcccggcgacatgtacgccagacccgagcccttcccccccggccccgccgccagaagcgacgccctggccgccgccgccgccctgcacggctacggcggcatgaacctgaccgtgaacctggccgccccccacggccccggcgccttcttcagatacatgagacagcccatcaagcaggagctgatctgcaagtggctggccgccgacggcaccgccacccccagcctgtgcagcaagaccttcagcaccatgcacgagctggtgacccacgtgaccgtggagcacgtgggcggccccgagcaggccaaccacatctgcttctgggaggagtgccccagacagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttcagatgcgagttcgagggctgcgagagaagattcgccaacagcagcgacagaaagaagcacagccacgtgcacaccagcgacaagccctacacctgcaaggtgagaggctgcgacaagtgctacacccaccccagcagcctgagaaagcacatgaaggtgcacggcagaagccccccccccagcagcggctacgacagcgccacccccagcgccctggtgagccccagcagcgactgcggccacaagagccaggtggccagcagcgccgccgtggccgccagaaccgccgacctgagcgagtag

SEQ ID NO: 105510 - DNA, 690 bp, Artificial Sequence
  Description of Artificial Sequence: Synthetic coding sequence
atgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgcccggcgacatgtacgccagacccgagcccttcccccccggccccgccgccagaagcgacgccctggccgccgccgccgccctgcacggctacggcggcatgaacctgaccgtgaacctggccgccccccacggccccggcgccttcttcagatacatgagacagcccatcaagcaggagctgatctgcaagtggctggccgccgacggcaccgccacccccagcctgtgcagcaagaccttcagcaccatgcacgagctggtgacccacgtgaccgtggagcacgtgggcggccccgagcaggccaaccacatctgcttctgggaggagtgccccagacagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacacctag

SEQ ID NO: 105511 - DNA, 207 bp, Artificial Sequence
  Description of Artificial Sequence: Synthetic coding sequence
atgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgccctag

SEQ ID NO: 105512 - DNA, 1005 bp, Artificial Sequence; identical to SEQ ID NO: 105508
  Description of Artificial Sequence: Synthetic coding sequence

SEQ ID NO: 105513 - DNA, 1005 bp, Artificial Sequence; identical to SEQ ID NO: 105508
  Description of Artificial Sequence: Synthetic coding sequence

SEQ ID NO: 105514 - DNA, 234 bp, Artificial Sequence
  Description of Artificial Sequence: Synthetic coding sequence
atgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgcccggcgacatgtacgccagacccgagccctag

SEQ ID NO: 105515 - DNA, 1155 bp, Artificial Sequence
  Description of Artificial Sequence: Synthetic coding sequence
atgccccccttctgcagaaacgccaagctgggcctgctgagcttcctgatctgcgccggcagaagcctgctgcccctgggcaagaacgccttctggctggagagaatcgagaacaacaacaccctgtgggagaaggcccagagccagaagatgagatacaagaccagcctggtgatgagaaagagactgagactgtacagaaacaccctgaaggagagcagcagcagcagcggccaccacggcccccagctgaccgccgccagcagccccagcgtgttccccggcctgcacgaggagcccccccaggccagccccagcagacccctgaacggcctgctgagactgggcctgcccggcgacatgtacgccagacccgagcccttcccccccggccccgccgccagaagcgacgccctggccgccgccgccgccctgcacggctacggcggcatgaacctgaccgtgaacctggccgccccccacggccccggcgccttcttcagatacatgagacagcccatcaagcaggagctgatctgcaagtggctggccgccgacggcaccgccacccccagcctgtgcagcaagaccttcagcaccatgcacgagctggtgacccacgtgaccgtggagcacgtgggcggccccgagcaggccaaccacatctgcttctgggaggagtgccccagacagggcaagcccttcaaggccaagtacaagctggtgaaccacatcagagtgcacaccggcgagaagcccttcccctgccccttccccggctgcggcaaggtgttcgccagaagcgagaacctgaagatccacaagagaacccacaccggcgagaagcccttcagatgcgagttcgagggctgcgagagaagattcgccaacagcagcgacagaaagaagcacagccacgtgcacaccagcgacaagccctacacctgcaaggtgagaggctgcgacaagtgctacacccaccccagcagcctgagaaagcacatgaaggtgcacggcagaagccccccccccagcagcggctacgacagcgccacccccagcgccctggtgagccccagcagcgactgcggccacaagagccaggtggccagcagcgccgccgtggccgccagaaccgccgacctgagcgagtag

SEQ ID NO: 105516 - DNA, 684 bp, Artificial Sequence
  Description of Artificial Sequence: Synthetic coding sequence
atgggcggcaagcagagcaccgccgccagaagcagaggccccttccccggcgtgagcaccgacgacagcgccgtgcccccccccggcggcgccccccacttcggccactacagaaccggcggcggcgccatgggcctgagaagcagaagcgtgagcagcgtggccggcatgggcatggaccccagcaccgccggcggcgtgcccttcggcctgtacacccccgccagcagaggcaccggcgacagcgagagagcccccggcggcggcggcagcgccagcgacagcacctacgcccacggcaacggctaccaggagaccggcggcggccaccacagagacggcatgctgtacctgggcagcagagccagcctggccgacgccctgcccctgcacatcgcccccagatggttcagcagccacagcggcttcaagtgccccatctgcagcaagagcgtggccagcgacgagatggagatgcacttcatcatgtgcctgagcaagcccagactgagctacaacgacgacgtgctgaccaaggacgccggcgagtgcgtgatctgcctggaggagctgctgcagggcgacaccatcgccagactgccctgcctgtgcatctaccacaagagctgcatcgacagctggttcgaggtgaacagaagctgccccgagcaccccgccgactag

SEQ ID NO: 105517 - DNA, 543 bp, Artificial Sequence
  Description of Artificial Sequence: Synthetic coding sequence
cagagaggcgtgcccgccgccggcacccccagcagccccagactgctggtgagcagaagcctgggcggcgccgtgggcagcgtggccagcggcgccagagccgcccagagccccttcagcatccccaacagcagcagcggcccctacggcagccaggacagcgtgcacagcagccccgaggacggcggcggcggcagagacagacccgtgggcggcagccccggcggccccagactggtgatcggcagcctgcccgcccacctgagcccccacatgttcggcggcttcaagtgccccgtgtgcagcaagttcgtgagcagcgacgagatggacctgcacctggtgatgtgcctgaccaagcccagaatcacctacaacgaggacgtgctgagcaaggacgccggcgagtgcgccatctgcctggaggagctgcagcagggcgacaccatcgccagactgccctgcctgtgcatctaccacaagggctgcatcgacgagtggttcgaggtgaacagaagctgccccgagcaccccagcgactag

SEQ ID NO: 105518 - DNA, 729 bp, Artificial Sequence
  Description of Artificial Sequence: Synthetic coding sequence
atgggcgccaagcagagcggccccgccgccgccaacggcagaaccagagcctacagcggcagcgacctgcccagcagcagcagcggcggcgccaacggcaccgccggcggcggcggcggcgccagagccgccgccgccggcagattccccgcccaggtgcccagcgcccaccagcccagcgccagcggcggcgccgccgccgccgccgccgcccccgccgcccccgccgcccccagaagcagaagcctgggcggcgccgtgggcagcgtggccagcggcgccagagccgcccagagccccttcagcatccccaacagcagcagcggcccctacggcagccaggacagcgtgcacagcagccccgaggacggcggcggcggcagagacagacccgtgggcggcagccccggcggccccagactggtgatcggcagcctgcccgcccacctgagcccccacatgttcggcggcttcaagtgccccgtgtgcagcaagttcgtgagcagcgacgagatggacctgcacctggtgatgtgcctgaccaagcccagaatcacctacaacgaggacgtgctgagcaaggacgccggcgagtgcgccatctgcctggaggagctgcagcagggcgacaccatcgccagactgccctgcctgtgcatctaccacaagggctgcatcgacgagtggttcgaggtgaacagaagctgccccgagcaccccagcgactag

SEQ ID NO: 105519 - DNA, 2511 bp, Artificial Sequence
  Description of Artificial Sequence: Synthetic coding sequence
atgcaccccctgggcctgtgcaacaacaacgacgaggaggacctgtacgagtacggctgggtgggcgtggtgaagctggagcagcccgagctggaccccaagccctgcctgaccgtgctgggcaaggccaagagagccgtgcagagaggcgccaccgccgtgatcttcgacgtgagcgagaaccccgaggccatcgaccagctgaaccagggcagcgaggaccccctgaagagacccgtggtgtacgtgaagggcgccgacgccatcaagctgatgaacatcgtgaacaagcagaaggtggccagagccagaatccagcacagaccccccagacagcccaccgagtacttcgacatgggcatcttcctggccttcttcgtggtggtgagcctggtgtgcctgatcctgctggtgaagatcaagctgaagcagagaagaagccagaacagcatgaacagactggccgtgcaggccctggagaagatggagaccagaaagttcaacagcaagagcaagggcagaagagagggcagctgcggcgccctggacaccctgagcagcagcagcaccagcgactgcgccatctgcctggagaagtacatcgacggcgaggagctgagagtgatcccctgcacccacagattccacagaaagtgcgtggacccctggctgctgcagcaccacacctgcccccactgcagacacaacatcatcgagcagaagggcaaccccagcgccgtgtgcgtggagaccagcaacctgagcagaggcagacagcagagagtgaccctgcccgtgcactaccccggcagagtgcacagaaccaacgccatccccgcctaccccaccagaaccagcatggacagccacggcaaccccgtgaccctgctgaccatggacagacacggcgagcagagcctgtacagcccccagacccccgcctacatcagaagctacccccccctgcacctggaccacagcctggccgcccacagatgcggcctggagcacagagcctacagccccgcccaccccttcagaagacccaagctgagcggcagaagcttcagcaaggccgcctgcttcagccagtacgagaccatgtaccagcactactacttccagggcctgagctaccccgagcaggagggccagagcccccccagcctggcccccagaggccccgccagagccttcccccccagcggcagcggcagcctgctgttccccaccgtggtgcacgtggccccccccagccacctggagagcggcagcaccagcagcttcagctgctaccacggccacagaagcgtgtgcagcggctacctggccgactgccccggcagcgacagcagcagcagcagcagcagcggccagtgccactgcagcagcagcgacagcgtggtggactgcaccgaggtgagcaaccagggcgtgtacggcagctgcagcaccttcagaagcagcctgagcagcgactacgaccccttcatctacagaagcagaagcccctgcagagccagcgaggccggcggcagcggcagcagcggcagaggccccgccctgtgcttcgagggcagccccccccccgaggagctgcccgccgtgcacagccacggcgccggcagaggcgagccctggcccggccccgccagccccagcggcgaccaggtgagcacctgcagcctggagatgaactacagcagcaacagcagcctggagcacagaggccccaacagcagcaccagcgaggtgggcctggaggccagccccggcgccgcccccgacctgagaagaacctggaagggcggccacgagctgcccagctgcgcctgctgctgcgagccccagcccagccccgccggccccagcgccggcgccgccggcagcagcaccctgttcctgggcccccacctgtacgagggcagcggccccgccggcggcgagccccagagcggcagcagccagggcctgtacggcctgcaccccgaccacctgcccagaaccgacggcgtgaagtacgagggcctgccctgctgcttctacgaggagaagcaggtggccagaggcggcggcggcggcagcggctgctacaccgaggactacagcgtgagcgtgcagtacaccctgaccgaggagcccccccccggctgctaccccggcgccagagacctgagccagagaatccccatcatccccgaggacgtggactgcgacctgggcctgcccagcgactgccagggcacccacagcctgggcagctggggcggcaccagaggccccgacacccccagaccccacagaggcctgggcgccaccagagaggaggagagagccctgtgctgccaggccagagccctgctgagacccggctgcccccccgaggaggccggcgccgtgagagccaacttccccagcgccctgcaggacacccaggagagcagcaccaccgccaccgaggccgccggccccagaagccacagcgccgacagcagcagccccggcgcctag

SEQ ID NO: 105520 - DNA, 2511 bp, Artificial Sequence; identical to SEQ ID NO: 105519
  Description of Artificial Sequence: Synthetic coding sequence

SEQ ID NO: 105521 - DNA, 2511 bp, Artificial Sequence; identical to SEQ ID NO: 105519
  Description of Artificial Sequence: Synthetic coding sequence

SEQ ID NO: 105522 - DNA, 1932 bp, Artificial Sequence
  Description of Artificial Sequence: Synthetic coding sequence
gtgcccagcgtgtggagaagcaccctgatggagagaagctgcggcagcagccccgtgctgaccggcttcaccggcagcgcctggacccccctgctgcagcaccacacctgcccccactgcagacacaacatcatcgagcagaagggcaaccccagcgccgtgtgcgtggagaccagcaacctgagcagaggcagacagcagagagtgaccctgcccgtgcactaccccggcagagtgcacagaaccaacgccatccccgcctaccccaccagaaccagcatggacagccacggcaaccccgtgaccctgctgaccatggacagacacggcgagcagagcctgtacagcccccagacccccgcctacatcagaagctacccccccctgcacctggaccacagcctggccgcccacagatgcggcctggagcacagagcctacagccccgcccaccccttcagaagacccaagctgagcggcagaagcttcagcaaggccgcctgcttcagccagtacgagaccatgtaccagcactactacttccagggcctgagctaccccgagcaggagggccagagcccccccagcctggcccccagaggccccgccagagccttcccccccagcggcagcggcagcctgctgttccccaccgtggtgcacgtggccccccccagccacctggagagcggcagcaccagcagcttcagctgctaccacggccacagaagcgtgtgcagcggctacctggccgactgccccggcagcgacagcagcagcagcagcagcagcggccagtgccactgcagcagcagcgacagcgtggtggactgcaccgaggtgagcaaccagggcgtgtacggcagctgcagcaccttcagaagcagcctgagcagcgactacgaccccttcatctacagaagcagaagcccctgcagagccagcgaggccggcggcagcggcagcagcggcagaggccccgccctgtgcttcgagggcagccccccccccgaggagctgcccgccgtgcacagccacggcgccggcagaggcgagccctggcccggccccgccagccccagcggcgaccaggtgagcacctgcagcctggagatgaactacagcagcaacagcagcctggagcacagaggccccaacagcagcaccagcgaggtgggcctggaggccagccccggcgccgcccccgacctgagaagaacctggaagggcggccacgagctgcccagctgcgcctgctgctgcgagccccagcccagccccgccggccccagcgccggcgccgccggcagcagcaccctgttcctgggcccccacctgtacgagggcagcggccccgccggcggcgagccccagagcggcagcagccagggcctgtacggcctgcaccccgaccacctgcccagaaccgacggcgtgaagtacgagggcctgccctgctgcttctacgaggagaagcaggtggccagaggcggcggcggcggcagcggctgctacaccgaggactacagcgtgagcgtgcagtacaccctgaccgaggagcccccccccggctgctaccccggcgccagagacctgagccagagaatccccatcatccccgaggacgtggactgcgacctgggcctgcccagcgactgccagggcacccacagcctgggcagctggggcggcaccagaggccccgacacccccagaccccacagaggcctgggcgccaccagagaggaggagagagccctgtgctgccaggccagagccctgctgagacccggctgcccccccgaggaggccggcgccgtgagagccaacttccccagcgccctgcaggacacccaggagagcagcaccaccgccaccgaggccgccggccccagaagccacagcgccgacagcagcagccccggcgcctag

SEQ ID NO: 105523 - DNA, 2811 bp, Artificial Sequence
  Description of Artificial Sequence: Synthetic coding sequence
atgagacccagaagcggcggcagacccggcgccaccggcagaagaagaagaagactgagaagaagacccagaggcctgagatgcagcagactgcccccccccccccccctgcccctgctgctgggcctgctgctggccgccgccggccccggcgccgccagagccaaggagaccgccttcgtggaggtggtgctgttcgagagcagccccagcggcgactacaccacctacaccaccggcctgaccggcagattcagcagagccggcgccaccctgagcgccgagggcgagatcgtgcagatgcaccccctgggcctgtgcaacaacaacgacgaggaggacctgtacgagtacggctgggtgggcgtggtgaagctggagcagcccgagctggaccccaagccctgcctgaccgtgctgggcaaggccaagagagccgtgcagagaggcgccaccgccgtgatcttcgacgtgagcgagaaccccgaggccatcgaccagctgaaccagggcagcgaggaccccctgaagagacccgtggtgtacgtgaagggcgccgacgccatcaagctgatgaacatcgtgaacaagcagaaggtggccagagccagaatccagcacagaccccccagacagcccaccgagtacttcgacatgggcatcttcctggccttcttcgtggtggtgagcctggtgtgcctgatcctgctggtgaagatcaagctgaagcagagaagaagccagaacagcatgaacagactggccgtgcaggccctggagaagatggagaccagaaagttcaacagcaagagcaagggcagaagagagggcagctgcggcgccctggacaccctgagcagcagcagcaccagcgactgcgccatctgcctggagaagtacatcgacggcgaggagctgagagtgatcccctgcacccacagattccacagaaagtgcgtggacccctggctgctgcagcaccacacctgcccccactgcagacacaacatcatcgagcagaagggcaaccccagcgccgtgtgcgtggagaccagcaacctgagcagaggcagacagcagagagtgaccctgcccgtgcactaccccggcagagtgcacagaaccaacgccatccccgcctaccccaccagaaccagcatggacagccacggcaaccccgtgaccctgctgaccatggacagacacggcgagcagagcctgtacagcccccagacccccgcctacatcagaagctacccccccctgcacctggaccacagcctggccgcccacagatgcggcctggagcacagagcctacagccccgcccaccccttcagaagacccaagctgagcggcagaagcttcagcaaggccgcctgcttcagccagtacgagaccatgtaccagcactactacttccagggcctgagctaccccgagcaggagggccagagcccccccagcctggcccccagaggccccgccagagccttcccccccagcggcagcggcagcctgctgttccccaccgtggtgcacgtggccccccccagccacctggagagcggcagcaccagcagcttcagctgctaccacggccacagaagcgtgtgcagcggctacctggccgactgccccggcagcgacagcagcagcagcagcagcagcggccagtgccactgcagcagcagcgacagcgtggtggactgcaccgaggtgagcaaccagggcgtgtacggcagctgcagcaccttcagaagcagcctgagcagcgactacgaccccttcatctacagaagcagaagcccctgcagagccagcgaggccggcggcagcggcagcagcggcagaggccccgccctgtgcttcgagggcagccccccccccgaggagctgcccgccgtgcacagccacggcgccggcagaggcgagccctggcccggccccgccagccccagcggcgaccaggtgagcacctgcagcctggagatgaactacagcagcaacagcagcctggagcacagaggccccaacagcagcaccagcgaggtgggcctggaggccagccccggcgccgcccccgacctgagaagaacctggaagggcggccacgagctgcccagctgcgcctgctgctgcgagccccagcccagccccgccggccccagcgccggcgccgccggcagcagcaccctgttcctgggcccccacctgtacgagggcagcggccccgccggcggcgagccccagagcggcagcagccagggcctgtacggcctgcaccccgaccacctgcccagaaccgacggcgtgaagtacgagggcctgccctgctgcttctacgaggagaagcaggtggccagaggcggcggcggcggcagcggctgctacaccgaggactacagcgtgagcgtgcagtacaccctgaccgaggagcccccccccggctgctaccccggcgccagagacctgagccagagaatccccatcatccccgaggacgtggactgcgacctgggcctgcccagcgactgccagggcacccacagcctgggcagctggggcggcaccagaggccccgacacccccagaccccacagaggcctgggcgccaccagagaggaggagagagccctgtgctgccaggccagagccctgctgagacccggctgcccccccgaggaggccggcgccgtgagagccaacttccccagcgccctgcaggacacccaggagagcagcaccaccgccaccgaggccgccggccccagaagccacagcgccgacagcagcagccccggcgcctag

SEQ ID NO: 105524 - DNA, 339 bp, Artificial Sequence
  Description of Artificial Sequence: Synthetic coding sequence
atgagctaccccgtgaccagccagccccagtgcgccaccaccagctgctaccagacccagctgagcgactggcacaccggcctgaccgactgctgcaacgacatgcccgtgtgcctgtgcggcaccttcgcccccctgtgcctggcctgcagaatcagcgacgacttcggcgagtgctgctgcgccccctacctgcccggcggcctgcacagcatcagaaccggcatgagagagagataccacatccagggcagcgtgggccacgactgggccgccctgaccttctgcctgccctgcgccctgtgccagatggccagagagctgaagatcagagagtag

SEQ ID NO: 105525 - DNA, 1440 bp, Artificial Sequence
  Description of Artificial Sequence: Synthetic coding sequence
atggccgccctggagaagatgaccttccccaagaagatgaccttccccgagaagcccagccacaagaagtacagagccgccctgaagaaggagaagagaaagaagagaagacaggagctggccagactgagagacagcggcctgagccaggaggaggaggaggacaccttcatcgaggagcagcagctggaggaggagaagctgctggagagagagagagagagactgcacgaggagtggctgctgagagagcagaaggcccaggaggagttcagaatcaagaaggagaaggaggaggccgccaagaagtggctggaggagcaggagagaaagctgaaggagcagtggaaggagcagcagagaaaggagagagaggaggaggagcagaagcagcaggagaagaaggagaaggaggaggccgtgcagaagatgctggaccaggccgagaacgacctggagaacagcaccacctggcagaaccccgagccccccgtggacttcagagtgatggagaaggacagagccaactgccccttctacagcaagaccggcgcctgcagattcggcgacagatgcagcagaaagcacaacttccccaccagcagccccaccctgctgatcaagagcatgttcaccaccttcggcatggagcagtgcagaagagacgactacgaccccgacgccagcctggagtacagcgaggaggagacctaccagcagttcctggacttctacgaggacgtgctgcccgagttcaagaacgtgggcaaggtgatccagttcaaggtgagctgcaacctggagccccacctgagaggcaacgtgtacgtgcagtaccagagcgaggaggagtgccaggccgccctgagcctgttcaacggcagatggtacgccggcagacagctgcagtgcgagttctgccccgtgaccagatggaagatggccatctgcggcctgttcgagatccagcagtgccccagaggcaagcactgcaacttcctgcacgtgttcagaaaccccaacaacgagttctgggaggccaacagagacatctacctgagcagcgaccagaccggcagcagcttcggcaagaacagcgagagaagagagaagatgggccaccacgaccactactacagcagacagagaggcagaagaaaccccagccccgaccacacctacaagagaaacggcgagagcgagagaaagaagagcagccacagaggcaagaagagccacaagagaaccagcaagagcagagagagacacaacagccccagcagaggcagaaacagacacagaagctgggaccagggcagaagaagccagagcagaagaagccacagaagcagaagccagagcagcagcagatgcagaagcagaggcagaagaaagagcggcaacagagacagaaccgtgcagagcccccagagcaagtag

SEQ ID NO: 105526 - DNA, 1449 bp, Artificial Sequence
  Description of Artificial Sequence: Synthetic coding sequence
atggccgcccccgagaagatgaccttccccgagaagcccagccacaagaagtacagagccgccctgaagaaggagaagagaaagaagagaagacaggagctggccagactgagagacagcggcctgagccagaaggaggaggaggaggacaccttcatcgaggagcagcagctggaggaggagaagctgctggagagagagagacagagactgcacgaggagtggctgctgagagagcagaaggcccaggaggagttcagaatcaagaaggagaaggaggaggccgccaagaagagacaggaggagcaggagagaaagctgaaggagcagtgggaggagcagcagagaaaggagagagaggaggaggagcagaagagacaggagaagaaggagaaggaggaggccctgcagaagatgctggaccaggccgagaacgagctggagaacggcaccacctggcagaaccccgagccccccgtggacttcagagtgatggagaaggacagagccaactgccccttctacagcaagaccggcgcctgcagattcggcgacagatgcagcagaaagcacaacttccccaccagcagccccaccctgctgatcaagagcatgttcaccaccttcggcatggagcagtgcagaagagacgactacgaccccgacgccagcctggagtacagcgaggaggagacctaccagcagttcctggacttctacgaggacgtgctgcccgagttcaagaacgtgggcaaggtgatccagttcaaggtgagctgcaacctggagccccacctgagaggcaacgtgtacgtgcagtaccagagcgaggaggagtgccaggccgccctgagcctgttcaacggcagatggtacgccggcagacagctgcagtgcgagttctgccccgtgaccagatggaagatggccatctgcggcctgttcgagatccagcagtgccccagaggcaagcactgcaacttcctgcacgtgttcagaaaccccaacaacgagttctgggaggccaacagagacatctacctgagccccgacagaaccggcagcagcttcggcaagaacagcgagagaagagagagaatgggccaccacgacgactactacagcagactgagaggcagaagaaaccccagccccgaccacagctacaagagaaacggcgagagcgagagaaagagcagcagacacagaggcaagaagagccacaagagaaccagcaagagcagagagagacacaacagcagaagcagaggcagaaacagagacagaagcagagacagaagcagaggcagaggcagcagaagcagaagcagaagcagaagcagaagaagcagaagaagcagaagccagagcagcagcagaagcagaagcagaggcagaagaagaagcggcaacagagacagaaccgtgcagagccccaagagcaagtag

SEQ ID NO: 105527 - DNA, 444 bp, Artificial Sequence
  Description of Artificial Sequence: Synthetic coding sequence
atggccgcccccgagaagatgaccttccccgagaagcccagccacaagaagtacagagccgccctgaagaaggagaagagaaagaagagaagacaggagctggccagactgagagacagcggcctgagccagaaggaggaggaggaggacaccttcatcgaggagcagcagctggaggaggagaagctgctggagagagagagactggagtgcagcggcgtgatcagcgcccacagaaacctgcacctgcccggcagccacgacagccccgccagcgccagcagagtggccggcatcaccggcacccacagacacacccagctgatcttcttctgcaccttcagcagagacggcgtgagcccctgctggcccggctggagcagaagcctggacctgatgatctgcccccccagaccccacaaggtgctgagactgcaggtgtag

SEQ ID NO: 105528 - DNA, 3438 bp, Artificial Sequence
  Description of Artificial Sequence: Synthetic coding sequence
atgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcaacgagagcgacctggagctggagaagaagtgcaaggaggacgacagagagaaggccagcaagagacccagaagccagaagaccgagaaggtgcagaagatcagcggcaaggaggccagacagctgagcggcgccaagaagcccatcatcagcgtggtgctgaccgcccacgaggccatccccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggacagagacagacacatgctggtgcacggcgacaagtggcccttcgcctgcgagctgtgcggccacggcgccaccaagtaccaggccctggagctgcacgtgagaaagcaccccttcgtgtacgtgtgcgccgtgtgcagaaagaagttcgtgagcagcatcagactgagaacccacatcaaggaggtgcacggcgccgcccaggaggccctggtgttcaccagcagcatcaaccagagcttctgcctgctggagcccggcggcgacatccagcaggaggccctgggcgaccagctgcagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 105529 - DNA, 3546 bp, Artificial Sequence
  Description of Artificial Sequence: Synthetic coding sequence
atggagaccagagccgccgagaacaccgccatcttcatgtgcaagtgctgcaacctgttcagccccaaccagagcgagctgctgagccacgtgagcgagaagcacatggaggagggcgtgaacgtggacgagatcatcatccccctgagacccctgagcacccccgagccccccaacagcagcaagaccggcgacgagttcctggtgatgaagagaaagagaggcagacccaagggcagcaccaagaagagcagcaccgaggaggagctggccgagaacatcgtgagccccaccgaggacagccccctggcccccgaggagggcaacagcctgccccccagcagcctggagtgcagcaagtgctgcagaaagttcagcaacaccagacagctgagaaagcacatctgcatcatcgtgctgaacctgggcgaggaggagggcgaggccggcgccaccaagatcgtgcccgtggaggccggcccccccgagaccggcgccaccaacagcgagaccaccagcgccgacctggtgcccagaagaggctaccaggagtacgccatccagcagaccccctacgagcagcccatgaagagcagcagactgggccccacccagctgaagatcttcacctgcgagtactgcaacaaggtgttcaagttcaagcacagcctgcaggcccacctgagaatccacaccaacgagaagccctacaagtgcccccagtgcagctacgccagcgccatcaaggccaacctgaacgtgcacctgagaaagcacaccggcgagaagttcgcctgcgactactgcagcttcacctgcctgagcaagggccacctgaaggtgcacatcgagagagtgcacaagaagatcaagcagcactgcagattctgcaagaagaagtacagcgacgtgaagaacctgatcaagcacatcagagacgcccacgacccccaggacaagaaggtgaaggaggccctggacgagctgtgcctgatgaccagagagggcaagagacagctgctgtacgactgccacatctgcgagagaaagttcaagaacgagctggacagagacagacacatgctggtgcacggcgacaagtggcccttcgcctgcgagctgtgcggccacggcgccaccaagtaccaggccctggagctgcacgtgagaaagcaccccttcgtgtacgtgtgcgccgtgtgcagaaagaagttcgtgagcagcatcagactgagaacccacatcaaggaggtgcacggcgccgcccaggaggccctggtgttcaccagcagcatcaaccagagcttctgcctgctggagcccggcggcgacatccagcaggaggccctgggcgaccagctgcagctggtggaggaggagttcgccctgcagggcgtgaacgccctgaaggaggaggcctgccccggcgacacccagctggaggagggcagaaaggagcccgaggcccccggcgagatgcccgcccccgccgtgcacctggccagcccccaggccgagagcaccgccctgcccccctgcgagctggagaccaccgtggtgagcagcagcgacctgcacagccaggaggtggtgagcgacgacttcctgctgaagaacgacaccagcagcgccgaggcccacgccgcccccgagaagccccccgacatgcagcacagaagcagcgtgcagacccagggcgaggtgatcaccctgctgctgagcaaggcccagagcgccggcagcgaccaggagagccacggcgcccagagccccctgggcgagggccagaacatggccgtgctgagcgccggcgaccccgaccccagcagatgcctgagaagcaaccccgccgaggccagcgacctgctgccccccgtggccggcggcggcgacaccatcacccaccagcccgacagctgcaaggccgcccccgagcacagaagcggcatcaccgccttcatgaaggtgctgaacagcctgcagaagaagcagatgaacaccagcctgtgcgagagaatcagaaaggtgtacggcgacctggagtgcgagtactgcggcaagctgttctggtaccaggtgcacttcgacatgcacgtgagaacccacaccagagagcacctgtactactgcagccagtgccactacagcagcatcaccaagaactgcctgaagagacacgtgatccagaagcacagcaacatcctgctgaagtgccccaccgacggctgcgactacagcacccccgacaagtacaagctgcaggcccacctgaaggtgcacaccgccctggacaagagaagctacagctgccccgtgtgcgagaagagcttcagcgaggacagactgatcaagagccacatcaagaccaaccaccccgaggtgagcatgagcaccatcagcgaggtgctgggcagaagagtgcagctgaagggcctgatcggcaagagagccatgaagtgcccctactgcgacttctacttcatgaagaacggcagcgacctgcagagacacatctgggcccacgagggcgtgaagcccttcaagtgcagcctgtgcgagtacgccaccagaagcaagagcaacctgaaggcccacatgaacagacacagcaccgagaagacccacctgtgcgacatgtgcggcaagaagttcaagagcaagggcaccctgaagagccacaagctgctgcacaccgccgacggcaagcagttcaagtgcaccgtgtgcgactacaccgccgcccagaagccccagctgctgagacacatggagcagcacgtgagcttcaagcccttcagatgcgcccactgccactacagctgcaacatcagcggcagcctgaagagacactacaacagaaagcaccccaacgaggagtacgccaacgtgggcaccggcgagctggccgccgaggtgctgatccagcagggcggcctgaagtgccccgtgtgcagcttcgtgtacggcaccaagtgggagttcaacagacacctgaagaacaagcacggcctgaaggtggtggagatcgacggcgaccccaagtgggagaccgccaccgaggcccccgaggagcccagcacccagtacctgcacatcaccgaggccgaggaggacgtgcagggcacccaggccgccgtggccgccctgcaggacctgagatacaccagcgagagcggcgacagactggaccccaccgccgtgaacatcctgcagcagatcatcgagctgggcgccgagacccacgacgccaccgccctggccagcgtggtggccatggcccccggcaccgtgaccgtggtgaagcaggtgaccgaggaggagcccagcagcaaccacaccgtgatgatccaggagaccgtgcagcaggccagcgtggagctggccgagcagcaccacctggtggtgagcagcgacgacgtggagggcatcgagaccgtgaccgtgtacacccagggcggcgaggccagcgagttcatcgtgtacgtgcaggaggccatgcagcccgtggaggagcaggccgtggagcagcccgcccaggagctgtag

SEQ ID NO: 105530 - DNA, 177 bp, Artificial Sequence
  Description of Artificial Sequence: Synthetic coding sequence
atggagaccagagccgccggcctgctggagttcgccggcggccccctgcacaccctgttcgcctgggtgagccccgtggaggccgccgagcagcagagactgctgcccgtgcccgccagcggcagcttcgtgcccgagggccacctgcccgacgccagccagagcagccccgtgtag

SEQ ID NO: 105531 - DNA, 1653 bp, Artificial Sequence
  Description of Artificial Sequence: Synthetic coding sequence
atggacctgaccaagatgggcatgatccagctgcagaaccccagccaccccaccggcctgctgtgcaaggccaaccagatgagactggccggcaccctgtgcgacgtggtgatcatggtggacagccaggagttccacgcccacagaaccgtgctggcctgcaccagcaagatgttcgagatcctgttccacagaaacagccagcactacaccctggacttcctgagccccaagaccttccagcagatcctggagtacgcctacaccgccaccctgcaggccaaggccgaggacctggacgacctgctgtacgccgccgagatcctggagatcgagtacctggaggagcagtgcctgaagatgctggagaccatccaggccagcgacgacaacgacaccgaggccaccatggccgacggcggcgccgaggaggaggaggacagaaaggccagatacctgaagaacatcttcatcagcaagcacagcagcgaggagagcggctacgccagcgtggccggccagagcctgcccggccccatggtggaccagagccccagcgtgagcaccagcttcggcctgagcgccatgagccccaccaaggccgccgtggacagcctgatgaccatcggccagagcctgctgcagggcaccctgcagccccccgccggccccgaggagcccaccctggccggcggcggcagacaccccggcgtggccgaggtgaagaccgagatgatgcaggtggacgaggtgcccagccagggcttcatccagagagagctgttcagcaagctgggcgagctggccgtgggcatgaagagcgagagcagaaccatcggcgagcagtgcagcgtgtgcggcgtggagctgcccgacaacgaggccgtggagcagcacagaaagctgcacagcggcatgaagacctacggctgcgagctgtgcggcaagagattcctggacagcctgagactgagaatgcacctgctggcccacagcgccggcgccaaggccttcgtgtgcgaccagtgcggcgcccagttcagcaaggaggacgccctggagacccacagacagacccacaccggcaccgacatggccgtgttctgcctgctgtgcggcaagagattccaggcccagagcgccctgcagcagcacatggaggtgcacgccggcgtgagaagctacatctgcagcgagtgcaacagaaccttccccagccacaccgccctgaagagacacctgagaagccacaccggcgaccacccctacgagtgcgagttctgcggcagctgcttcagagacgagagcaccctgaagagccacaagagaatccacaccggcgagaagccctacgagtgcaacggctgcggcaagaagttcagcctgaagcaccagctggagacccactacagagtgcacaccggcgagaagcccttcgagtgcaagctgtgccaccagagaagcagagactacagcgccatgatcaagcacctgagaacccacaacggcgccagcccctaccagtgcaccatctgcaccgagtactgccccagcctgagcagcatgcagaagcacatgaagggccacaagcccgaggagatcccccccgactggagaatcgagaagacctacctgtacctgtgctacgtgtag

SEQ ID NO: 105532 - DNA, 2022 bp, Artificial Sequence
  Description of Artificial Sequence: Synthetic coding sequence
atggacctgaccaagatgggcatgatccagctgcagaaccccagccaccccaccggcctgctgtgcaaggccaaccagatgagactggccggcaccctgtgcgacgtggtgatcatggtggacagccaggagttccacgcccacagaaccgtgctggcctgcaccagcaagatgttcgagatcctgttccacagaaacagccagcactacaccctggacttcctgagccccaagaccttccagcagatcctggagtacgcctacaccgccaccctgcaggccaaggccgaggacctggacgacctgctgtacgccgccgagatcctggagatcgagtacctggaggagcagtgcctgaagatgctggagaccatccaggccagcgacgacaacgacaccgaggccaccatggccgacggcggcgccgaggaggaggaggacagaaaggccagatacctgaagaacatcttcatcagcaagcacagcagcgaggagagcggctacgccagcgtggccggccagagcctgcccggccccatggtggaccagagccccagcgtgagcaccagcttcggcctgagcgccatgagccccaccaaggccgccgtggacagcctgatgaccatcggccagagcctgctgcagggcaccctgcagccccccgccggccccgaggagcccaccctggccggcggcggcagacaccccggcgtggccgaggtgaagaccgagatgatgcaggtggacgaggtgcccagccaggacagccccggcgccgccgagagcagcatcagcggcggcatgggcgacaaggtggaggagagaggcaaggagggccccggcacccccaccagaagcagcgtgatcaccagcgccagagagctgcactacggcagagaggagagcgccgagcaggtgcccccccccgccgaggccggccaggcccccaccggcagacccgagcaccccgcccccccccccgagaagcacctgggcatctacagcgtgctgcccaaccacaaggccgacgccgtgctgagcatgcccagcagcgtgaccagcggcctgcacgtgcagcccgccctggccgtgagcatggacttcagcacctacggcggcctgctgccccagggcttcatccagagagagctgttcagcaagctgggcgagctggccgtgggcatgaagagcgagagcagaaccatcggcgagcagtgcagcgtgtgcggcgtggagctgcccgacaacgaggccgtggagcagcacagaaagctgcacagcggcatgaagacctacggctgcgagctgtgcggcaagagattcctggacagcctgagactgagaatgcacctgctggcccacagcgccggcgccaaggccttcgtgtgcgaccagtgcggcgcccagttcagcaaggaggacgccctggagacccacagacagacccacaccggcaccgacatggccgtgttctgcctgctgtgcggcaagagattccaggcccagagcgccctgcagcagcacatggaggtgcacgccggcgtgagaagctacatctgcagcgagtgcaacagaaccttccccagccacaccgccctgaagagacacctgagaagccacaccggcgaccacccctacgagtgcgagttctgcggcagctgcttcagagacgagagcaccctgaagagccacaagagaatccacaccggcgagaagccctacgagtgcaacggctgcggcaagaagttcagcctgaagcaccagctggagacccactacagagtgcacaccggcgagaagcccttcgagtgcaagctgtgccaccagagaagcagagactacagcgccatgatcaagcacctgagaacccacaacggcgccagcccctaccagtgcaccatctgcaccgagtactgccccagcctgagcagcatgcagaagcacatgaagggccacaagcccgaggagatcccccccgactggagaatcgagaagacctacctgtacctgtgctacgtgtag

SEQ ID NO: 105533 - DNA, 2022 bp, Artificial Sequence; identical to SEQ ID NO: 105532
  Description of Artificial Sequence: Synthetic coding sequence

SEQ ID NO: 105534 - DNA, 447 bp, Artificial Sequence
  Description of Artificial Sequence: Synthetic coding sequence
atggacctgaccaagatgggcatgatccagctgcagaaccccagccaccccaccggcctgctgtgcaaggccaaccagatgagactggccggcaccctgtgcgacgtggtgatcatggtggacagccaggagttccacgcccacagaaccgtgctggcctgcaccagcaagatgttcgagatcctgttccacagaaacagccagcactacaccctggacttcctgagccccaagaccttccagcagatcctggagtacgcctacaccgccaccctgcaggccaaggccgaggacctggacgacctgctgtacgccgccgagatcctggagatcgagtacctggaggagcagtgcctgaagatgctggagaccatccaggccagcgacgacaacgacaccgaggccaccatggccgacggcggcgccgaggaggaggaggacagatag

SEQ ID NO: 105535 - DNA, 348 bp, Artificial Sequence
  Description of Artificial Sequence: Synthetic coding sequence
atggacctgaccaagatgggcatgatccagctgcagaaccccagccaccccaccggcctgctgtgcaaggccaaccagatgagactggccggcaccctgtgcgacgtggtgatcatggtggacagccaggagttccacgcccacagaaccgtgctggcctgcaccagcaagatgttcgagatcctgttccacagaaacagccagcactacaccctggacttcctgagccccaagaccttccagcagatcctggagtacgcctacaccgccaccctgcaggccaaggccgaggacctggacgacctgctgtacgccgccgagatcctggagatcgagtacctggagtag

SEQ ID NO: 105536 - DNA, 723 bp, Artificial Sequence
  Description of Artificial Sequence: Synthetic coding sequence
gaggccctgcccgtgagactgctgagacccctgctgctgagaccccacttccaggacgccccccccggcgaccccagacacggccagggcgcccaggtgcccaccctgagacaggaggtgcagcccggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccgtggtgcccgtgggctag

SEQ ID NO: 105537 - DNA, 2433 bp, Artificial Sequence
  Description of Artificial Sequence: Synthetic coding sequence
atggacttcccccagcacagccagcacgtgctggagcagctgaaccagcagagacagctgggcctgctgtgcgactgcaccttcgtggtggacggcgtgcacttcaaggcccacaaggccgtgctggccgcctgcagcgagtacttcaagatgctgttcgtggaccagaaggacgtggtgcacctggacatcagcaacgccgccggcctgggccaggtgctggagttcatgtacaccgccaagctgagcctgagccccgagaacgtggacgacgtgctggccgtggccaccttcctgcagatgcaggacatcatcaccgcctgccacgccctgaagagcctggccgagcccgccaccagccccggcggcaacgccgaggccctggccaccgagggcggcgacaagagagccaaggaggagaaggtggccaccagcaccctgagcagactggagcaggccggcagaagcacccccatcggccccagcagagacctgaaggaggagagaggcggccaggcccagagcgccgccagcggcgccgagcagaccgagaaggccgacgcccccagagagcccccccccgtggagctgaagcccgaccccaccagcggcatggccgccgccgaggccgaggccgccctgagcgagagcagcgagcaggagatggaggtggagcccgccagaaagggcgaggaggagcagaaggagcaggaggagcaggaggaggagggcgccggccccgccgaggtgaaggaggagggcagccagctggagaacggcgaggcccccgaggagaacgagaacgaggagagcgccggcaccgacagcggccaggagctgggcagcgaggccagaggcctgagaagcggcacctacggcgacagaaccgagagcaaggcctacggcagcgtgatccacaagtgcgaggactgcggcaaggagttcacccacaccggcaacttcaagagacacatcagaatccacaccggcgagaagcccttcagctgcagagagtgcagcaaggccttcagcgaccccgccgcctgcaaggcccacgagaagacccacagccccctgaagccctacggctgcgaggagtgcggcaagagctacagactgatcagcctgctgaacctgcacaagaagagacacagcggcgaggccagatacagatgcgaggactgcggcaagctgttcaccaccagcggcaacctgaagagacaccagctggtgcacagcggcgagaagccctaccagtgcgactactgcggcagaagcttcagcgaccccaccagcaagatgagacacctggagacccacgacaccgacaaggagcacaagtgcccccactgcgacaagaagttcaaccaggtgggcaacctgaaggcccacctgaagatccacatcgccgacggccccctgaagtgcagagagtgcggcaagcagttcaccaccagcggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccggccccgccaccctgcccgccgtggtgcccgtgggcgccgccgtgaccgccgacgagaccgaggtgctgaaggccgagatcagcaaggccgtgaagcaggtgcaggaggaggaccccaacacccacatcctgtacgcctgcgacagctgcggcgacaagttcctggacgccaacagcctggcccagcacgtgagaatccacaccgcccaggccctggtgatgttccagaccgacgccgacttctaccagcagtacggccccggcggcacctggcccgccggccaggtgctgcaggccggcgagctggtgttcagacccagagacggcgccgagggccagcccgccctggccgagaccagccccaccgcccccgagtgccccccccccgccgagtag

SEQ ID NO: 105538 - DNA, 2412 bp, Artificial Sequence
  Description of Artificial Sequence: Synthetic coding sequence
atggacttcccccagcacagccagcacgtgctggagcagctgaaccagcagagacagctgggcctgctgtgcgactgcaccttcgtggtggacggcgtgcacttcaaggcccacaaggccgtgctggccgcctgcagcgagtacttcaagatgctgttcgtggaccagaaggacgtggtgcacctggacatcagcaacgccgccggcctgggccaggtgctggagttcatgtacaccgccaagctgagcctgagccccgagaacgtggacgacgtgctggccgtggccaccttcctgcagatgcaggacatcatcaccgcctgccacgccctgaagagcctggccgagcccgccaccagccccggcggcaacgccgaggccctggccaccgagggcggcgacaagagagccaaggaggagaaggtggccaccagcaccctgagcagactggagcaggccggcagaagcacccccatcggccccagcagagacctgaaggaggagagaggcggccaggcccagagcgccgccagcggcgccgagcagaccgagaaggccgacgcccccagagagcccccccccgtggagctgaagcccgaccccaccagcggcatggccgccgccgaggccgaggccgccctgagcgagagcagcgagcaggagatggaggtggagcccgccagaaagggcgaggaggagcagaaggagcaggaggagcaggaggaggagggcgccggccccgccgaggtgaaggaggagggcagccagctggagaacggcgaggcccccgaggagaacgagaacgaggagagcgccggcaccgacagcggccaggagctgggcagcgaggccagaggcctgagaagcggcacctacggcgacagaaccgagagcaaggcctacggcagcgtgatccacaagtgcgaggactgcggcaaggagttcacccacaccggcaacttcaagagacacatcagaatccacaccggcgagaagcccttcagctgcagagagtgcagcaaggccttcagcgaccccgccgcctgcaaggcccacgagaagacccacagccccctgaagccctacggctgcgaggagtgcggcaagagctacagactgatcagcctgctgaacctgcacaagaagagacacagcggcgaggccagatacagatgcgaggactgcggcaagctgttcaccaccagcggcaacctgaagagacaccagctggtgcacagcggcgagaagccctaccagtgcgactactgcggcagaagcttcagcgaccccaccagcaagatgagacacctggagacccacgacaccgacaaggagcacaagtgcccccactgcgacaagaagttcaaccaggtgggcaacctgaaggcccacctgaagatccacatcgccgacggccccctgaagtgcagagagtgcggcaagcagttcaccaccagcggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccgtggtgcccgtgggcgccgccgtgaccgccgacgagaccgaggtgctgaaggccgagatcagcaaggccgtgaagcaggtgcaggaggaggaccccaacacccacatcctgtacgcctgcgacagctgcggcgacaagttcctggacgccaacagcctggcccagcacgtgagaatccacaccgcccaggccctggtgatgttccagaccgacgccgacttctaccagcagtacggccccggcggcacctggcccgccggccaggtgctgcaggccggcgagctggtgttcagacccagagacggcgccgagggccagcccgccctggccgagaccagccccaccgcccccgagtgccccccccccgccgagtag

SEQ ID NO: 105539 - DNA, 633 bp, Artificial Sequence
  Description of Artificial Sequence: Synthetic coding sequence
tgaagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccggccccgccaccctgcccgccgtggtgcccgtgggcgccgccgtgaccgccgacgagaccgaggtgctgaaggccgagatcagcaaggccgtgaagcaggtgcaggaggaggaccccaacacccacatcctgtacgcctgcgacagctgcggcgacaagttcctggacgccaacagcctggcccagcacgtgagaatccacaccgcccaggccctggtgatgttccagaccgacgccgacttctaccagcagtacggccccggcggcacctggcccgccggccaggtgctgcaggccggcgagctggtgttcagacccagagacggcgccgagggccagcccgccctggccgagaccagccccaccgcccccgagtgccccccccccgccgagtag

SEQ ID NO: 105540 - DNA, 726 bp, Artificial Sequence
  Description of Artificial Sequence: Synthetic coding sequence
tgagaggccctgcccgtgagactgctgagacccctgctgctgagaccccacttccaggacgccccccccggcgaccccagacacggccagggcgcccaggtgcccaccctgagacaggaggtgcagcccggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccgtggtgcccgtgggctag

SEQ ID NO: 105541 - DNA, 2169 bp, Artificial Sequence
  Description of Artificial Sequence: Synthetic coding sequence
atggacttcccccagcacagccagcacgtgctggagcagctgaaccagcagagacagctgggcctgctgtgcgactgcaccttcgtggtggacggcgtgcacttcaaggcccacaaggccgtgctggccgcctgcagcgagtacttcaagatgctgttcgtggaccagaaggacgtggtgcacctggacatcagcaacgccgccggcctgggccaggtgctggagttcatgtacaccgccaagctgagcctgagccccgagaacgtggacgacgtgctggccgtggcccccggcgccgagcagaccgagaaggccgacgcccccagagagcccccccccgtggagctgaagcccgaccccaccagcggcatggccgccgccgaggccgaggccgccctgagcgagagcagcgagcaggagatggaggtggagcccgccagaaagggcgaggaggagcagaaggagcaggaggagcaggaggaggagggcgccggccccgccgaggtgaaggaggagggcagccagctggagaacggcgaggcccccgaggagaacgagaacgaggagagcgccggcaccgacagcggccaggagctgggcagcgaggccagaggcctgagaagcggcacctacggcgacagaaccgagagcaaggcctacggcagcgtgatccacaagtgcgaggactgcggcaaggagttcacccacaccggcaacttcaagagacacatcagaatccacaccggcgagaagcccttcagctgcagagagtgcagcaaggccttcagcgaccccgccgcctgcaaggcccacgagaagacccacagccccctgaagccctacggctgcgaggagtgcggcaagagctacagactgatcagcctgctgaacctgcacaagaagagacacagcggcgaggccagatacagatgcgaggactgcggcaagctgttcaccaccagcggcaacctgaagagacaccagctggtgcacagcggcgagaagccctaccagtgcgactactgcggcagaagcttcagcgaccccaccagcaagatgagacacctggagacccacgacaccgacaaggagcacaagtgcccccactgcgacaagaagttcaaccaggtgggcaacctgaaggcccacctgaagatccacatcgccgacggccccctgaagtgcagagagtgcggcaagcagttcaccaccagcggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccgtggtgcccgtgggcgccgccgtgaccgccgacgagaccgaggtgctgaaggccgagatcagcaaggccgtgaagcaggtgcaggaggaggaccccaacacccacatcctgtacgcctgcgacagctgcggcgacaagttcctggacgccaacagcctggcccagcacgtgagaatccacaccgcccaggccctggtgatgttccagaccgacgccgacttctaccagcagtacggccccggcggcacctggcccgccggccaggtgctgcaggccggcgagctggtgttcagacccagagacggcgccgagggccagcccgccctggccgagaccagccccaccgcccccgagtgccccccccccgccgagtag

SEQ ID NO: 105542 - DNA, 1530 bp, Artificial Sequence
  Description of Artificial Sequence: Synthetic coding sequence
atggacttcccccagcacagccagcacgtgctggagcagctgaaccagcagagacagctgggcctgctgtgcgactgcaccttcgtggtggacggcgtgcacttcaaggcccacaaggccgtgctggccgcctgcagcgagtacttcaagatgctgttcgtggaccagaaggacgtggtgcacctggacatcagcaacgccgccggcggcgacaagagagccaaggaggagaaggtggccaccagcaccctgagcagactggagcaggccggcagaagcacccccatcggccccagcagagacctgaaggaggagagaggcggccaggcccagagcgccgccagcggcgccgagcagaccgagaaggccgacgcccccagagagcccccccccgtggagctgaagcccgaccccaccagcggcatggccgccgccgaggccgaggccgccctgagcgagagcagcgagcaggagatggaggtggagcccgccagaaagggcgaggaggagcagaaggagcaggaggagcaggaggaggagggcgccggccccgccgaggtgaaggaggagggcagccagctggagaacggcgaggcccccgaggagaacgagaacgaggagagcgccggcaccgacagcggccaggagctgggcagcgaggccagaggcctgagaagcggcacctacggcgacagaaccgagagcaaggcctacggcagcgtgatccacaagtgcgaggactgcggcaaggagttcacccacaccggcaacttcaagagacacatcagaatccacaccggcgagaagcccttcagctgcagagagtgcagcaaggccttcagcgaccccgccgcctgcaaggcccacgagaagacccacagccccctgaagccctacggctgcgaggagtgcggcaagagctacagactgatcagcctgctgaacctgcacaagaagagacacagcggcgaggccagatacagatgcgaggactgcggcaagctgttcaccaccagcggcaacctgaagagacaccagctggtgcacagcggcgagaagccctaccagtgcgactactgcggcagaagcttcagcgaccccaccagcaagatgagacacctggagacccacgacaccgacaaggagcacaagtgcccccactgcgacaagaagttcaaccaggtgtgcggccccctgcccgagcccgcccccggcagcagaagatggccccagccccacgcctgccacgtggtgggcagagccggcagcaccgcccccgccagcagaagcagcagcgcctgcagccccagaaagcaggcccagagagagcccctgcccagaggcagcagcagactgctgtgcggcggccaggccgacagcggcagaggcctggtgctgaagaagtggggcggcgccgcctacctgagccccctgggccccggcaccagccccgaccccggcgagatcgagcccttcaccgaccccggcaagcccgagagccagctgttcctgtgcggcagaggcagatag

SEQ ID NO: 105543 - DNA, 2166 bp, Artificial Sequence
  Description of Artificial Sequence: Synthetic coding sequence
atgatgtgctggccctggcccctgagcagcaagtgcagaaccagcagcagacccgccatgcccagcagccacctgctgagcagactgcccgccctgggcgagatgagaagaccctggccccagaaggtgtgccccgtgcccagccccggcggcgacaagagagccaaggaggagaaggtggccaccagcaccctgagcagactggagcaggccggcagaagcacccccatcggccccagcagagacctgaaggaggagagaggcggccaggcccagagcgccgccagcggcgccgagcagaccgagaaggccgacgcccccagagagcccccccccgtggagctgaagcccgaccccaccagcggcatggccgccgccgaggccgaggccgccctgagcgagagcagcgagcaggagatggaggtggagcccgccagaaagggcgaggaggagcagaaggagcaggaggagcaggaggaggagggcgccggccccgccgaggtgaaggaggagggcagccagctggagaacggcgaggcccccgaggagaacgagaacgaggagagcgccggcaccgacagcggccaggagctgggcagcgaggccagaggcctgagaagcggcacctacggcgacagaaccgagagcaaggcctacggcagcgtgatccacaagtgcgaggactgcggcaaggagttcacccacaccggcaacttcaagagacacatcagaatccacaccggcgagaagcccttcagctgcagagagtgcagcaaggccttcagcgaccccgccgcctgcaaggcccacgagaagacccacagccccctgaagccctacggctgcgaggagtgcggcaagagctacagactgatcagcctgctgaacctgcacaagaagagacacagcggcgaggccagatacagatgcgaggactgcggcaagctgttcaccaccagcggcaacctgaagagacaccagctggtgcacagcggcgagaagccctaccagtgcgactactgcggcagaagcttcagcgaccccaccagcaagatgagacacctggagacccacgacaccgacaaggagcacaagtgcccccactgcgacaagaagttcaaccaggtgggcaacctgaaggcccacctgaagatccacatcgccgacggccccctgaagtgcagagagtgcggcaagcagttcaccaccagcggcaacctgaagagacacctgagaatccacagcggcgagaagccctacgtgtgcatccactgccagagacagttcgccgaccccggcgccctgcagagacacgtgagaatccacaccggcgagaagccctgccagtgcgtgatgtgcggcaaggccttcacccaggccagcagcctgatcgcccacgtgagacagcacaccggcgagaagccctacgtgtgcgagagatgcggcaagagattcgtgcagagcagccagctggccaaccacatcagacaccacgacaacatcagaccccacaagtgcagcgtgtgcagcaaggccttcgtgaacgtgggcgacctgagcaagcacatcatcatccacaccggcgagaagccctacctgtgcgacaagtgcggcagaggcttcaacagagtggacaacctgagaagccacgtgaagaccgtgcaccagggcaaggccggcatcaagatcctggagcccgaggagggcagcgaggtgagcgtggtgaccgtggacgacatggtgaccctggccaccgaggccctggccgccaccgccgtgacccagctgaccgtggtgcccgtgggcgccgccgtgaccgccgacgagaccgaggtgctgaaggccgagatcagcaaggccgtgaagcaggtgcaggaggaggaccccaacacccacatcctgtacgcctgcgacagctgcggcgacaagttcctggacgccaacagcctggcccagcacgtgagaatccacaccgcccaggccctggtgatgttccagaccgacgccgacttctaccagcagtacggccccggcggcacctggcccgccggccaggtgctgcaggccggcgagctggtgttcagacccagagacggcgccgagggccagcccgccctggccgagaccagccccaccgcccccgagtgccccccccccgccgagtag

SEQ ID NO: 105544 - DNA, 2007 bp, Artificial Sequence
  Description of Artificial Sequence: Synthetic coding sequence
atgaccgagagaatccacagcatcaacctgcacaacttcagcaacagcgtgctggagaccctgaacgagcagagaaacagaggccacttctgcgacgtgaccgtgagaatccacggcagcatgctgagagcccacagatgcgtgctggccgccggcagccccttcttccaggacaagctgctgctgggctacagcgacatcgagatccccagcgtggtgagcgtgcagagcgtgcagaagctgatcgacttcatgtacagcggcgtgctgagagtgagccagagcgaggccctgcagatcctgaccgccgccagcatcctgcagatcaagaccgtgatcgacgagtgcaccagaatcgtgagccagaacgtgggcgacgtgttccccggcatccaggacagcggccaggacacccccagaggcacccccgagagcggcaccagcggccagagcagcgacaccgagagcggctacctgcagagccacccccagcacagcgtggacagaatctacagcgccctgtacgcctgcagcatgcagaacggcagcggcgagagaagcttctacagcggcgccgtggtgagccaccacgagaccgccctgggcctgcccagagaccaccacatggaggaccccagctggatcaccagaatccacgagagaagccagcagatggagagatacctgagcaccacccccgagaccacccactgcagaaagcagcccagacccgtgagaatccagaccctggtgggcaacatccacatcaagcaggagatggaggacgactacgactactacggccagcagagagtgcagatcctggagagaaacgagagcgaggagtgcaccgaggacaccgaccaggccgagggcaccgagagcgagcccaagggcgagagcttcgacagcggcgtgagcagcagcatcggcaccgagcccgacagcgtggagcagcagttcggccccggcgccgccagagacagccaggccgagcccacccagcccgagcaggccgccgaggcccccgccgagggcggcccccagaccaaccagctggagaccggcgccagcagccccgagagaagcaacgaggtggagatggacagcaccgtgatcaccgtgagcaacagcagcgacaagagcgtgctgcagcagcccagcgtgaacaccagcatcggccagcccctgcccagcacccagctgtacctgagacagaccgagaccctgaccagcaacctgagaatgcccctgaccctgaccagcaacacccaggtgatcggcaccgccggcaacacctacctgcccgccctgttcaccacccagcccgccggcagcggccccaagcccttcctgttcagcctgccccagcccctggccggccagcagacccagttcgtgaccgtgagccagcccggcctgagcaccttcaccgcccagctgcccgccccccagcccctggccagcagcgccggccacagcaccgccagcggccagggcgagaagaagccctacgagtgcaccctgtgcaacaagaccttcaccgccaagcagaactacgtgaagcacatgttcgtgcacaccggcgagaagccccaccagtgcagcatctgctggagaagcttcagcctgaaggactacctgatcaagcacatggtgacccacaccggcgtgagagcctaccagtgcagcatctgcaacaagagattcacccagaagagcagcctgaacgtgcacatgagactgcacagaggcgagaagagctacgagtgctacatctgcaagaagaagttcagccacaagaccctgctggagagacacgtggccctgcacagcgccagcaacggcaccccccccgccggcaccccccccggcgccagagccggcccccccggcgtggtggcctgcaccgagggcaccacctacgtgtgcagcgtgtgccccgccaagttcgaccagatcgagcagttcaacgaccacatgagaatgcacgtgagcgacggctag

SEQ ID NO: 105545 - DNA, 2007 bp, Artificial Sequence; identical to SEQ ID NO: 105544
  Description of Artificial Sequence: Synthetic coding sequence

SEQ ID NO: 105546 - DNA, 2007 bp, Artificial Sequence; identical to SEQ ID NO: 105544
  Description of Artificial Sequence: Synthetic coding sequence

SEQ ID NO: 105547 - DNA, 2007 bp, Artificial Sequence; identical to SEQ ID NO: 105544
  Description of Artificial Sequence: Synthetic coding sequence

SEQ ID NO: 105548 - DNA, 174 bp, Artificial Sequence
  Description of Artificial Sequence: Synthetic coding sequence
atgaccgagagaatccacagcatcaacctgcacaacttcagcaacagcgtgctggagaccctgaacgagcagagaaacagaggccacttctgcgacgtgaccgtgagaatccacggcagcatgctgagagcccacagatgcgtgctggccgccggcagccccttcttccagtag

SEQ ID NO: 105549 - DNA, 2007 bp, Artificial Sequence; identical to SEQ ID NO: 105544
  Description of Artificial Sequence: Synthetic coding sequence

SEQ ID NO: 105550 - DNA, 2226 bp, Artificial Sequence
  Description of Artificial Sequence: Synthetic coding sequence
atgctggagagaaagaagcccaagaccgccgagaaccagaaggccagcgaggagaacgagatcacccagcccggcggcagcagcgccaagcccggcctgccctgcctgaacttcgaggccgtgctgagccccgaccccgccctgatccacagcacccacagcctgaccaacagccacgcccacaccggcagcagcgactgcgacatcagctgcaagggcatgaccgagagaatccacagcatcaacctgcacaacttcagcaacagcgtgctggagaccctgaacgagcagagaaacagaggccacttctgcgacgtgaccgtgagaatccacggcagcatgctgagagcccacagatgcgtgctggccgccggcagccccttcttccaggacaagctgctgctgggctacagcgacatcgagatccccagcgtggtgagcgtgcagagcgtgcagaagctgatcgacttcatgtacagcggcgtgctgagagtgagccagagcgaggccctgcagatcctgaccgccgccagcatcctgcagatcaagaccgtgatcgacgagtgcaccagaatcgtgagccagaacgtgggcgacgtgttccccggcatccaggacagcggccaggacacccccagaggcacccccgagagcggcaccagcggccagagcagcgacaccgagagcggctacctgcagagccacccccagcacagcgtggacagaatctacagcgccctgtacgcctgcagcatgcagaacggcagcggcgagagaagcttctacagcggcgccgtggtgagccaccacgagaccgccctgggcctgcccagagaccaccacatggaggaccccagctggatcaccagaatccacgagagaagccagcagatggagagatacctgagcaccacccccgagaccacccactgcagaaagcagcccagacccgtgagaatccagaccctggtgggcaacatccacatcaagcaggagatggaggacgactacgactactacggccagcagagagtgcagatcctggagagaaacgagagcgaggagtgcaccgaggacaccgaccaggccgagggcaccgagagcgagcccaagggcgagagcttcgacagcggcgtgagcagcagcatcggcaccgagcccgacagcgtggagcagcagttcggccccggcgccgccagagacagccaggccgagcccacccagcccgagcaggccgccgaggcccccgccgagggcggcccccagaccaaccagctggagaccggcgccagcagccccgagagaagcaacgaggtggagatggacagcaccgtgatcaccgtgagcaacagcagcgacaagagcgtgctgcagcagcccagcgtgaacaccagcatcggccagcccctgcccagcacccagctgtacctgagacagaccgagaccctgaccagcaacctgagaatgcccctgaccctgaccagcaacacccaggtgatcggcaccgccggcaacacctacctgcccgccctgttcaccacccagcccgccggcagcggccccaagcccttcctgttcagcctgccccagcccctggccggccagcagacccagttcgtgaccgtgagccagcccggcctgagcaccttcaccgcccagctgcccgccccccagcccctggccagcagcgccggccacagcaccgccagcggccagggcgagaagaagccctacgagtgcaccctgtgcaacaagaccttcaccgccaagcagaactacgtgaagcacatgttcgtgcacaccggcgagaagccccaccagtgcagcatctgctggagaagcttcagcctgaaggactacctgatcaagcacatggtgacccacaccggcgtgagagcctaccagtgcagcatctgcaacaagagattcacccagaagagcagcctgaacgtgcacatgagactgcacagaggcgagaagagctacgagtgctacatctgcaagaagaagttcagccacaagaccctgctggagagacacgtggccctgcacagcgccagcaacggcaccccccccgccggcaccccccccggcgccagagccggcccccccggcgtggtggcctgcaccgagggcaccacctacgtgtgcagcgtgtgccccgccaagttcgaccagatcgagcagttcaacgaccacatgagaatgcacgtgagcgacggctag

SEQ ID NO: 105551 - DNA, 2007 bp, Artificial Sequence; identical to SEQ ID NO: 105544
  Description of Artificial Sequence: Synthetic coding sequence

SEQ ID NO: 105552 - DNA, 60 bp, Artificial Sequence
  Description of Artificial Sequence: Synthetic coding sequence
atgctggagagaaagaagcccaagaccgccgagaaccagaaggccagcgaggagaactag

SEQ ID NO: 105553 - DNA, 489 bp, Artificial Sequence
  Description of Artificial Sequence: Synthetic coding sequence
atggccgagaccgtggccgacaccagaagactgatcaccaagccccagaacctgaacgacgcctacggcccccccagcaacttcctggagatcgacgtgagcaacccccagaccgtgggcgtgggcagaggcagattcaccacctacgagatcagagtgaagaccaacctgcccatcttcaagctgaaggagagcaccgtgagaagaagatacagcgacttcgagtggctgagaagcgagctggagagagagagcaaggtggtggtgccccccctgcccggcaaggccttcctgagacagctgcccttcagaggcgacgacggcatcttcgacgacaacttcatcgaggagagaaagcagggcctggagcagttcatcaacaaggtggccggccaccccctggcccagaacgagagatgcctgcacatgttcctgcaggacgagatcatcgacaagagctacacccccagcaagatcagacacgcctag

SEQ ID NO: 105554 - DNA, 1308 bp, Artificial Sequence
  Description of Artificial Sequence: Synthetic coding sequence
atggacaccgccagccacagcctggtgctgctgcagcagctgaacatgcagagagagttcggcttcctgtgcgactgcaccgtggccatcggcgacgtgtacttcaaggcccacagagccgtgctggccgccttcagcaactacttcaagatgatcttcatccaccagaccagcgagtgcatcaagatccagcccaccgacatccagcccgacatcttcagctacctgctgcacatcatgtacaccggcaagggccccaagcagatcgtggaccacagcagactggaggagggcatcagattcctgcacgccgactacctgagccacatcgccaccgagatgaaccaggtgttcagccccgagaccgtgcagagcagcaacctgtacggcatccagatcagcaccacccagaagaccgtggtgaagcagggcctggaggtgaaggaggcccccagcagcaacagcggcaacagagccgccgtgcagggcgaccacccccagctgcagctgagcctggccatcggcctggacgacggcaccgccgaccagcagagagcctgccccgccacccaggccctggaggagcaccagaagccccccgtgagcatcaagcaggagagatgcgaccccgagagcgtgatcagccagagccaccccagccccagcagcgaggtgaccggccccaccttcaccgagaacagcgtgaagatccacctgtgccactactgcggcgagagattcgacagcagaagcaacctgagacagcacctgcacacccacgtgagcggcagcctgcccttcggcgtgcccgccagcatcctggagagcaacgacctgggcgaggtgcaccccctgaacgagaacagcgaggccctggagtgcagaagactgagcagcttcatcgtgaaggagaacgagcagcagcccgaccacaccaacagaggcaccaccgagcccctgcagatcagccaggtgagcctgatcagcaaggacaccgagcccgtggagctgaactgcaacttcagcttcagcagaaagagaaagatgagctgcaccatctgcggccacaagttccccagaaagagccagctgctggagcacatgtacacccacaagggcaagagctacagatacaacagatgccagagattcggcaacgccctggcccagagattccagccctactgcgacagctggagcgacgtgagcctgaagagcagcagactgagccaggagcacctggacctgccctgcgccctggagagcgagctgacccaggagaacgtggacaccatcctggtggagtag

SEQ ID NO: 105555 - DNA, 1308 bp, Artificial Sequence; identical to SEQ ID NO: 105554
  Description of Artificial Sequence: Synthetic coding sequence

SEQ ID NO: 105556 - DNA, 1464 bp, Artificial Sequence
  Description of Artificial Sequence: Synthetic coding sequence
atgagcctgccccccatcagactgcccagcccctacggcagcgacagactggtgcagctggccgccagactgagacccgccctgtgcgacaccctgatcaccgtgggcagccaggagttccccgcccacagcctggtgctggccggcgtgagccagcagctgggcagaagaggccagtgggccctgggcgagggcatcagccccagcaccttcgcccagctgctgaacttcgtgtacggcgagagcgtggagctgcagcccggcgagctgagacccctgcaggaggccgccagagccctgggcgtgcagagcctggaggaggcctgctggagagccagaggcgacagagccaagaagcccgaccccggcctgaagaagcaccaggaggagcccgagaagcccagcagaaaccccgagagagagctgggcgaccccggcgagaagcagaagcccgagcaggtgagcagaaccggcggcagagagcaggagatgctgcacaagcacagcccccccagaggcagacccgagatggccggcgccacccaggaggcccagcaggagcagaccagaagcaaggagaagagactgcaggcccccgtgggccagagaggcgccgacggcaagcacggcgtgctgacctggctgagagagaaccccggcggcagcgaggagagcctgagaaagctgcccggccccctgccccccgccggcagcctgcagaccagcgtgacccccagacccagctgggccgaggccccctggctggtgggcggccagcccgccctgtggagcatcctgctgatgccccccagatacggcatccccttctaccacagcacccccaccaccggcgcctggcaggaggtgtggagagagcagagaatccccctgagcctgaacgcccccaagggcctgtggagccagaaccagctggccagcagcagccccacccccggcagcctgccccagggccccgcccagctgagccccggcgagatggaggagagcgaccagggccacaccggcgccctggccacctgcgccggccacgaggacaaggccggctgcccccccagaccccaccccccccccgccccccccgccagaagcagaccctacgcctgcagcgtgtgcggcaagagattcagcctgaagcaccagatggagacccactacagagtgcacaccggcgagaagcccttcagctgcagcctgtgcccccagagaagcagagacttcagcgccatgaccaagcacctgagaacccacggcgccgccccctacagatgcagcctgtgcggcgccggctgccccagcctggccagcatgcaggcccacatgagaggccacagccccagccagctgccccccggctggaccatcagaagcaccttcctgtacagcagcagcagacccagcagacccagcaccagcccctgctgccccagcagcagcaccacctag

SEQ ID NO: 105557 - DNA, 1464 bp, Artificial Sequence; identical to SEQ ID NO: 105556
  Description of Artificial Sequence: Synthetic coding sequence

SEQ ID NO: 105558 - DNA, 2019 bp, Artificial Sequence
  Description of Artificial Sequence: Synthetic coding sequence
atggagagcagaaagctgatcagcgccaccgacatccagtacagcggcagcctgctgaacagcctgaacgagcagagaggccacggcctgttctgcgacgtgaccgtgatcgtggaggacagaaagttcagagcccacaagaacatcctgagcgccagcagcacctacttccaccagctgttcagcgtggccggccaggtggtggagctgagcttcatcagagccgagatcttcgccgagatcctgaactacatctacagcagcaagatcgtgagagtgagaagcgacctgctggacgagctgatcaagagcggccagctgctgggcgtgaagttcatcgccgagctgggcgtgcccctgagccaggtgaagagcatcagcggcaccgcccaggacggcaacaccgagcccctgccccccgacagcggcgacaagaacctggtgatccagaagagcaaggacgaggcccaggacaacggcgccaccatcatgcccatcatcaccgagagcttcagcctgagcgccgaggactacgagatgaagaagatcatcgtgaccgacagcgacgacgacgacgacgacgtgatcttctgcagcgagatcctgcccaccaaggagaccctgcccagcaacaacaccgtggcccaggtgcagagcaaccccggccccgtggccatcagcgacgtggcccccagcgccagcaacaacagcccccccctgaccaacatcacccccacccagaagctgcccacccccgtgaaccaggccaccctgagccagacccagggcagcgagaagctgctggtgagcagcgcccccacccacctgacccccaacatcatcctgctgaaccagacccccctgagcaccccccccaacgtgagcagcagcctgcccaaccacatgcccagcagcatcaacctgctggtgcagaaccagcagacccccaacagcgccatcctgaccggcaacaaggccaacgaggaggaggaggaggagatcatcgacgacgacgacgacaccatcagcagcagccccgacagcgccgtgagcaacaccagcctggtgccccaggccgacaccagccagaacaccagcttcgacggcagcctgatccagaagatgcagatccccaccctgctgcaggagcccctgagcaacagcctgaagatcagcgacatcatcaccagaaacaccaacgaccccggcgtgggcagcaagcacctgatggagggccagaagatcatcaccctggacaccgccaccgagatcgagggcctgagcaccggctgcaaggtgtacgccaacatcggcgaggacacctacgacatcgtgatccccgtgaaggacgaccccgacgagggcgaggccagactggagaacgagatccccaagaccagcggcagcgagatggccaacaagagaatgaaggtgaagcacgacgaccactacgagctgatcgtggacggcagagtgtactacatctgcatcgtgtgcaagagaagctacgtgtgcctgaccagcctgagaagacacttcaacatccacagctgggagaagaagtacccctgcagatactgcgagaaggtgttccccctggccgagtacagaaccaagcacgagatccaccacaccggcgagagaagataccagtgcctggcctgcggcaagagcttcatcaactaccagttcatgagcagccacatcaagagcgtgcacagccaggaccccagcggcgacagcaagctgtacagactgcacccctgcagaagcctgcagatcagacagtacgcctacctgagcgacagaagcagcaccatccccgccatgaaggacgacggcatcggctacaaggtggacaccggcaaggagccccccgtgggcaccaccaccagcacccagaacaagcccatgacctgggaggacatcttcatccagcaggagaacgacagcatcttcaagcagaacgtgaccgacggcagcaccgagttcgagttcatcatccccgagagctactag

SEQ ID NO: 105559 - DNA, 2019 bp, Artificial Sequence; identical to SEQ ID NO: 105558
  Description of Artificial Sequence: Synthetic coding sequence

SEQ ID NO: 105560 - DNA, 2019 bp, Artificial Sequence; identical to SEQ ID NO: 105558
  Description of Artificial Sequence: Synthetic coding sequence

SEQ ID NO: 105561 - DNA, 1515 bp, Artificial Sequence
  Description of Artificial Sequence: Synthetic coding sequence
atgagcgtggagatggacagcagcagcttcatccagttcgacgtgcccgagtacagcagcaccgtgctgagccagctgaacgagctgagactgcagggcaagctgtgcgacatcatcgtgcacatccagggccagcccttcagagcccacaaggccgtgctggccgccagcagcccctacttcagagaccacagcgccctgagcaccatgagcggcctgagcatcagcgtgatcaagaaccccaacgtgttcgagcagctgctgagcttctgctacaccggcagaatgagcctgcagctgaaggacgtggtgagcttcctgaccgccgccagcttcctgcagatgcagtgcgtgatcgacaagtgcacccagatcctggagagcatccacagcaagatcagcgtgggcgacgtggacagcgtgaccgtgggcgccgaggagaaccccgagagcagaaacggcgtgaaggacagcagcttcttcgccaaccccgtggagatcagccccccctactgcagccagggcagacagcccaccgccagcagcgacctgagaatggagaccacccccagcaaggccctgagaagcagactgcaggaggagggccacagcgacagaggcagcagcggcagcgtgagcgagtacgagatccagatcgagggcgaccacgagcagggcgacctgctggtgagagagagccagatcaccgaggtgaaggtgaagatggagaagagcgacagacccagctgcagcgacagcagcagcctgggcgacgacggctaccacaccgagatggtggacggcgagcaggtggtggccgtgaacgtgggcagctacggcagcgtgctgcagcacgcctacagctacagccaggccgccagccagcccaccaacgtgagcgaggccttcggcagcctgagcaacagcagccccagcagaagcatgctgagctgcttcagaggcggcagagccagacagaagagagccctgagcgtgcacctgcacagcgacctgcagggcctggtgcagggcagcgacagcgaggccatgatgaacaaccccggctacgagagcagccccagagagagaagcgccagaggccactggtacccctacaacgagagactgatctgcatctactgcggcaagagcttcaaccagaagggcagcctggacagacacatgagactgcacatgggcatcacccccttcgtgtgcaagttctgcggcaagaagtacaccagaaaggaccagctggagtaccacatcagaggccacaccgacgacaagcccttcagatgcgagatctgcggcaagtgcttccccttccagggcaccctgaaccagcacctgagaaagaaccaccccggcgtggccgaggtgagaagcagaatcgagagccccgagagaaccgacgtgtacgtggagcagaagctggagaacgacgccagcgccagcgagatgggcctggacagcagaatggagatccacaccgtgagcgacgcccccgactag

SEQ ID NO: 105562 - DNA, 1503 bp, Artificial Sequence
  Description of Artificial Sequence: Synthetic coding sequence
atggacagcagcagcttcatccagttcgacgtgcccgagtacagcagcaccgtgctgagccagctgaacgagctgagactgcagggcaagctgtgcgacatcatcgtgcacatccagggccagcccttcagagcccacaaggccgtgctggccgccagcagcccctacttcagagaccacagcgccctgagcaccatgagcggcctgagcatcagcgtgatcaagaaccccaacgtgttcgagcagctgctgagcttctgctacaccggcagaatgagcctgcagctgaaggacgtggtgagcttcctgaccgccgccagcttcctgcagatgcagtgcgtgatcgacaagtgcacccagatcctggagagcatccacagcaagatcagcgtgggcgacgtggacagcgtgaccgtgggcgccgaggagaaccccgagagcagaaacggcgtgaaggacagcagcttcttcgccaaccccgtggagatcagccccccctactgcagccagggcagacagcccaccgccagcagcgacctgagaatggagaccacccccagcaaggccctgagaagcagactgcaggaggagggccacagcgacagaggcagcagcggcagcgtgagcgagtacgagatccagatcgagggcgaccacgagcagggcgacctgctggtgagagagagccagatcaccgaggtgaaggtgaagatggagaagagcgacagacccagctgcagcgacagcagcagcctgggcgacgacggctaccacaccgagatggtggacggcgagcaggtggtggccgtgaacgtgggcagctacggcagcgtgctgcagcacgcctacagctacagccaggccgccagccagcccaccaacgtgagcgaggccttcggcagcctgagcaacagcagccccagcagaagcatgctgagctgcttcagaggcggcagagccagacagaagagagccctgagcgtgcacctgcacagcgacctgcagggcctggtgcagggcagcgacagcgaggccatgatgaacaaccccggctacgagagcagccccagagagagaagcgccagaggccactggtacccctacaacgagagactgatctgcatctactgcggcaagagcttcaaccagaagggcagcctggacagacacatgagactgcacatgggcatcacccccttcgtgtgcaagttctgcggcaagaagtacaccagaaaggaccagctggagtaccacatcagaggccacaccgacgacaagcccttcagatgcgagatctgcggcaagtgcttccccttccagggcaccctgaaccagcacctgagaaagaaccaccccggcgtggccgaggtgagaagcagaatcgagagccccgagagaaccgacgtgtacgtggagcagaagctggagaacgacgccagcgccagcgagatgggcctggacagcagaatggagatccacaccgtgagcgacgcccccgactag

SEQ ID NO: 105563 - DNA, 3591 bp, Artificial Sequence
  Description of Artificial Sequence: Synthetic coding sequence
atgatgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggaggagaagaacgagaagagacacgaggagcccgccatcaccaacggccccagaatcaccaacgccttcagcatcatcgagaccgagaacagcaacaacatgttcagccccctggacctgagagccagcttcaagaaggtgagcgacagcatgagaaccgccagcctgtgcctggagagaaccgacgtgtgccacgaggccgagcccgtgagaaccctggccgagcacagctacgccgtgagcagcgtggccgaggcctacagaagccagcccgtgagagagcacgacggcagcagccccggcaacaccggcaaggagaactgcgaggccctggccgccaagcccaagacctgcagaaagcccaagaccttcagcatcccccaggacagcgacagcgccaccgagaacatcccccccccccccgtgagcaacctggaggtgaaccaggagagaagcccccagcccgccgccgtgctgaccagaagcaagagccccaacaacgagggcgacgtgcacttcagcagagaggacgagaaccagagcagcgacgtgcccggcccccccgccgccgaggtgccccccctggtgtacaactgcagctgctgcagcaaggccttcgacagcagcaccctgctgagcgcccacatgcagctgcacaagcccacccaggagcccctggtgtgcaagtactgcaacaagcagttcaccaccctgaacagactggacagacacgagcagatctgcatgagaagcagccacatgcccatccccggcggcaaccagagattcctggagaactaccccaccatcggccagaacggcggcagcttcaccggccccgagcccctgctgagcgagaacagaatcggcgagttcagcagcaccggcagcaccctgcccgacaccgaccacatggtgaagttcgtgaacggccagatgctgtacagctgcgtggtgtgcaagagaagctacgtgaccctgagcagcctgagaagacacgccaacgtgcacagctggagaagaacctacccctgccactactgcaacaaggtgttcgccctggccgagtacagaaccagacacgagatctggcacaccggcgagagaagataccagtgcatcttctgcctggagaccttcatgacctactacatcctgaagaaccaccagaagagcttccacgccatcgaccacagactgagcatcagcaagaagaccgccaacggcggcctgaagcccagcgtgtacccctacaagctgtacagactgctgcccatgaagtgcaagagagccccctacaagagctacagaaacagcagctacgagaacgccagagagaacagccagatgaacgagagcgcccccggcacctacgtggtgcagaacccccacagcagcgagctgcccaccctgaacttccaggacaccgtgaacaccctgaccaacagccccgccatccccctggagaccagcgcctgccaggacatccccaccagcgccaacgtgcagaacgccgagggcaccaagtggggcgaggaggccctgaagatggacctggacaacaacttctacagcaccgaggtgagcgtgagcagcaccgagaacgccgtgagcagcgacctgagagccggcgacgtgcccgtgctgagcctgagcaacagcagcgagaacgccgccagcgtgatcagctacagcggcagcgcccccagcgtgatcgtgcacagcagccagttcagcagcgtgatcatgcacagcaacgccatcgccgccatgaccagcagcaaccacagagccttcagcgaccccgccgtgagccagagcctgaaggacgacagcaagcccgagcccgacaaggtgggcagattcgccagcagacccaagagcatcaaggagaagaagaagaccaccagccacaccagaggcgagatccccgaggagagcaactacgtggccgaccccggcggcagcctgagcaagaccaccaacatcgccgaggagaccagcaagatcgagacctacatcgccaagcccgccctgcccggcaccagcaccaacagcaacgtggcccccctgtgccagatcaccgtgaagatcggcaacgaggccatcgtgaagagacacatcctgggcagcaagctgttctacaagagaggcagaagacccaagtaccagatgcaggaggagcccctgccccagggcaacgaccccgagcccagcggcgacagccccctgggcctgtgccagagcgagtgcatggagatgagcgaggtgttcgacgacgccagcgaccaggacagcaccgacaagccctggagaccctactacaactacaagcccaagaagaagagcagacagctgaagaagatgagaaaggtgaactggagaaaggagcacggcaacagaagccccagccacaagtgcaagtaccccgccgagctggactgcgccgtgggcaaggccccccaggacaagcccttcgaggaggaggagaccaaggagatgcccaagctgcagtgcgagctgtgcgacggcgacaaggccgtgggcgccggcaaccagggcagaccccacagacacctgaccagcagaccctacgcctgcgagctgtgcgccaagcagttccagagccccagcaccctgaagatgcacatgagatgccacaccggcgagaagccctaccagtgcaagacctgcggcagatgcttcagcgtgcagggcaacctgcagaagcacgagagaatccacctgggcctgaaggagttcgtgtgccagtactgcaacaaggccttcaccctgaacgagaccctgaagatccacgagagaatccacaccggcgagaagagataccactgccagttctgcttccagagattcctgtacctgagcaccaagagaaaccacgagcagagacacatcagagagcacaacggcaagggctacgcctgcttccagtgccccaagatctgcaagaccgccgccgccctgggcatgcaccagaagaagcacctgttcaagagccccagccagcaggagaagatcggcgacgtgtgccacgagaacagcaaccccctggagaaccagcacttcatcggcagcgaggacaacgaccagaaggacaacatccagaccggcgtggagaacgtggtgctgtag

SEQ ID NO: 105564 - DNA, 3588 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggaggagaagaacgagaagagacacgaggagcccgccatcaccaacggccccagaatcaccaacgccttcagcatcatcgagaccgagaacagcaacaacatgttcagccccctggacctgagagccagcttcaagaaggtgagcgacagcatgagaaccgccagcctgtgcctggagagaaccgacgtgtgccacgaggccgagcccgtgagaaccctggccgagcacagctacgccgtgagcagcgtggccgaggcctacagaagccagcccgtgagagagcacgacggcagcagccccggcaacaccggcaaggagaactgcgaggccctggccgccaagcccaagacctgcagaaagcccaagaccttcagcatcccccaggacagcgacagcgccaccgagaacatcccccccccccccgtgagcaacctggaggtgaaccaggagagaagcccccagcccgccgccgtgctgaccagaagcaagagccccaacaacgagggcgacgtgcacttcagcagagaggacgagaaccagagcagcgacgtgcccggcccccccgccgccgaggtgccccccctggtgtacaactgcagctgctgcagcaaggccttcgacagcagcaccctgctgagcgcccacatgcagctgcacaagcccacccaggagcccctggtgtgcaagtactgcaacaagcagttcaccaccctgaacagactggacagacacgagcagatctgcatgagaagcagccacatgcccatccccggcggcaaccagagattcctggagaactaccccaccatcggccagaacggcggcagcttcaccggccccgagcccctgctgagcgagaacagaatcggcgagttcagcagcaccggcagcaccctgcccgacaccgaccacatggtgaagttcgtgaacggccagatgctgtacagctgcgtggtgtgcaagagaagctacgtgaccctgagcagcctgagaagacacgccaacgtgcacagctggagaagaacctacccctgccactactgcaacaaggtgttcgccctggccgagtacagaaccagacacgagatctggcacaccggcgagagaagataccagtgcatcttctgcctggagaccttcatgacctactacatcctgaagaaccaccagaagagcttccacgccatcgaccacagactgagcatcagcaagaagaccgccaacggcggcctgaagcccagcgtgtacccctacaagctgtacagactgctgcccatgaagtgcaagagagccccctacaagagctacagaaacagcagctacgagaacgccagagagaacagccagatgaacgagagcgcccccggcacctacgtggtgcagaacccccacagcagcgagctgcccaccctgaacttccaggacaccgtgaacaccctgaccaacagccccgccatccccctggagaccagcgcctgccaggacatccccaccagcgccaacgtgcagaacgccgagggcaccaagtggggcgaggaggccctgaagatggacctggacaacaacttctacagcaccgaggtgagcgtgagcagcaccgagaacgccgtgagcagcgacctgagagccggcgacgtgcccgtgctgagcctgagcaacagcagcgagaacgccgccagcgtgatcagctacagcggcagcgcccccagcgtgatcgtgcacagcagccagttcagcagcgtgatcatgcacagcaacgccatcgccgccatgaccagcagcaaccacagagccttcagcgaccccgccgtgagccagagcctgaaggacgacagcaagcccgagcccgacaaggtgggcagattcgccagcagacccaagagcatcaaggagaagaagaagaccaccagccacaccagaggcgagatccccgaggagagcaactacgtggccgaccccggcggcagcctgagcaagaccaccaacatcgccgaggagaccagcaagatcgagacctacatcgccaagcccgccctgcccggcaccagcaccaacagcaacgtggcccccctgtgccagatcaccgtgaagatcggcaacgaggccatcgtgaagagacacatcctgggcagcaagctgttctacaagagaggcagaagacccaagtaccagatgcaggaggagcccctgccccagggcaacgaccccgagcccagcggcgacagccccctgggcctgtgccagagcgagtgcatggagatgagcgaggtgttcgacgacgccagcgaccaggacagcaccgacaagccctggagaccctactacaactacaagcccaagaagaagagcagacagctgaagaagatgagaaaggtgaactggagaaaggagcacggcaacagaagccccagccacaagtgcaagtaccccgccgagctggactgcgccgtgggcaaggccccccaggacaagcccttcgaggaggaggagaccaaggagatgcccaagctgcagtgcgagctgtgcgacggcgacaaggccgtgggcgccggcaaccagggcagaccccacagacacctgaccagcagaccctacgcctgcgagctgtgcgccaagcagttccagagccccagcaccctgaagatgcacatgagatgccacaccggcgagaagccctaccagtgcaagacctgcggcagatgcttcagcgtgcagggcaacctgcagaagcacgagagaatccacctgggcctgaaggagttcgtgtgccagtactgcaacaaggccttcaccctgaacgagaccctgaagatccacgagagaatccacaccggcgagaagagataccactgccagttctgcttccagagattcctgtacctgagcaccaagagaaaccacgagcagagacacatcagagagcacaacggcaagggctacgcctgcttccagtgccccaagatctgcaagaccgccgccgccctgggcatgcaccagaagaagcacctgttcaagagccccagccagcaggagaagatcggcgacgtgtgccacgagaacagcaaccccctggagaaccagcacttcatcggcagcgaggacaacgaccagaaggacaacatccagaccggcgtggagaacgtggtgctgtag

SEQ ID NO: 105565 - DNA, 105 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgactag

SEQ ID NO: 105566 - DNA, 285 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagctag

SEQ ID NO: 105567 - DNA, 357 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttctag

SEQ ID NO: 105568 - DNA, 336 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggctag

SEQ ID NO: 105569 - DNA, 453 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggaggagaagaacgagtag

SEQ ID NO: 105570 - DNA, 2316 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggaggagaagaacgagaagagacacgaggagcccgccatcaccaacggccccagaatcaccaacgccttcagcatcatcgagaccgagaacagcaacaacatgttcagccccctggacctgagagccagcttcaagaaggtgagcgacagcatgagaaccgccagcctgtgcctggagagaaccgacgtgtgccacgaggccgagcccgtgagaaccctggccgagcacagctacgccgtgagcagcgtggccgaggcctacagaagccagcccgtgagagagcacgacggcagcagccccggcaacaccggcaaggagaactgcgaggccctggccgccaagcccaagacctgcagaaagcccaagaccttcagcatcccccaggacagcgacagcgccaccgagaacatcccccccccccccgtgagcaacctggaggtgaaccaggagagaagcccccagcccgccgccgtgctgaccagaagcaagagccccaacaacgagggcgacgtgcacttcagcagagaggacgagaaccagagcagcgacgtgcccggcccccccgccgccgaggtgccccccctggtgtacaactgcagctgctgcagcaaggccttcgacagcagcaccctgctgagcgcccacatgcagctgcacaagcccacccaggagcccctggtgtgcaagtactgcaacaagcagttcaccaccctgaacagactggacagacacgagcagatctgcatgagaagcagccacatgcccatccccggcggcaaccagagattcctggagaactaccccaccatcggccagaacggcggcagcttcaccggccccgagcccctgctgagcgagaacagaatcggcgagttcagcagcaccggcagcaccctgcccgacaccgaccacatggtgaagttcgtgaacggccagatgctgtacagctgcgtggtgtgcaagagaagctacgtgaccctgagcagcctgagaagacacgccaacgtgcacagctggagaagaacctacccctgccactactgcaacaaggtgttcgccctggccgagtacagaaccagacacgagatctggcacaccggcgagagaagataccagtgcatcttctgcctggagaccttcatgacctactacatcctgaagaaccaccagaagagcttccacgccatcgaccacagactgagcatcagcaagaagaccgccaacggcggcctgaagcccagcgtgtacccctacaagctgtacagactgctgcccatgaagtgcaagagagccccctacaagagctacagaaacagcagctacgagaacgccagagagaacagccagatgaacgagagcgcccccggcacctacgtggtgcagaacccccacagcagcgagctgcccaccctgaacttccaggacaccgtgaacaccctgaccaacagccccgccatccccctggagaccagcgcctgccaggacatccccaccagcgccaacgtgcagaacgccgagggcaccaagtggggcgaggaggccctgaagatggacctggacaacaacttctacagcaccgaggtgagcgtgagcagcaccgagaacgccgtgagcagcgacctgagagccggcgacgtgcccgtgctgagcctgagcaacagcagcgagaacgccgccagcgtgatcagctacagcggcagcgcccccagcgtgatcgtgcacagcagccagttcagcagcgtgatcatgcacagcaacgccatcgccgccatgaccagcagcaaccacagagccttcagcgaccccgccgtgagccagagcctgaaggacgacagcaagcccgagcccgacaaggtgggcagattcgccagcagaccctag

SEQ ID NO: 105571 - DNA, 441 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggagtag

SEQ ID NO: 105572 - DNA, 633 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggccgccgccggcaagaagctgggcatcagcttcctggaggacctgaccgacagaaacttcagcaacagccccggcccctacgtgttctgcatcaccgagaagggcgtggtgaaggaggagaagaacgagaagagacacgaggagcccgccatcaccaacggccccagaatcaccaacgccttcagcatcatcgagaccgagaacagcaacaacatgttcagccccctggacctgagagccagcttcaagaaggtgagcgacagcatgagaaccgccagcctgtgcctggagagaaccgacgtgtgccactag

SEQ ID NO: 105573 - DNA, 327 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagcagccacgtgctggagctggacgacctgaaggccgaggtgttcaccgagatcctgaactacatctacagcagcaccgtggtggtgaagagacaggagaccgtgaccgacctggcctag

SEQ ID NO: 105574 - DNA, 213 bp, Artificial Sequence
  Description of Artificial Sequence: Synthetic coding sequence
atgaccgtgatgagcctgagcagagacctgaaggacgacttccacagcgacaccgtgctgagcatcctgaacgagcagagaatcagaggcatcctgtgcgacgtgaccatcatcgtggaggacaccaagttcaaggcccacagcaacgtgctggccgccagcagcctgtacttcaagaacatcttctggagccacaccatctgcatcagctag

SEQ ID NO: 105575 - DNA, 3588 bp, Artificial Sequence; identical to SEQ ID NO: 105564
  Description of Artificial Sequence: Synthetic coding sequence

SEQ ID NO: 105576 - DNA, 3042 bp, Artificial Sequence
  Description of Artificial Sequence: Synthetic coding sequence
atgcccccccccgccgaggtgaccgaccccagccacgcccccgccgtgctgagacagctgaacgagcagagactgagaggcctgttctgcgacgtgaccctgatcgccggcgacaccaagttccccgcccacagaagcgtgctggccgccagcagccccttcttcagagaggccctgctgaccagcgcccccctgcccctgccccccgccaccggcggcgccgcccccaaccccgccaccaccaccgccgccagcagcagcagcagcagcagcagcagcagcagcagcagcagcagcagcgccagcagcagcagcagcagcagcagcagcagccccccccccgccagcccccccgccagcagcccccccagagtgctggagctgcccggcgtgcccgccgccgccttcagcgacgtgctgaacttcatctacagcgccagactggccctgcccggcggcggcggcgacggcgccgccgtggccgagatcggcgccctgggcagaagactgggcatcagcagactgcagggcctgggcgagggcggcgacgcctgggtgccccccacccccgcccccatggccaccagccagcccgaggaggacagcttcggccccggccccagacccgccggcgagtgggagggcgacagagccgaggcccaggcccccgacctgcagtgcagcctgcccagaagacccctgccctgcccccagtgcggcaagagcttcatccaccccaagagactgcagacccacgaggcccagtgcagaagaggcgccagcaccagaggcagcaccggcctgggcgccggcggcgccggccccggcggccccgccggcgtggacgccagcgccctgcccccccccgtgggcttcagaggcggccccgagcacgtggtgaaggtggtgggcggccacgtgctgtacgtgtgcgccgcctgcgagagaagctacgtgaccctgagcagcctgaagagacacagcaacgtgcacagctggagaagaaagtacccctgcagatactgcgagaaggtgttcgccctggccgagtacagaaccaagcacgaggtgtggcacaccggcgagagaagataccagtgcatcttctgctgggagaccttcgtgacctactacaacctgaagacccaccagagagccttccacggcatcagccccggcctgctggccagcgagaagacccccaacggcggctacaagcccaagctgaacaccctgaagctgtacagactgctgcccatgagagccgccaagagaccctacaagacctacagccagggcgcccccgaggcccccctgagccccaccctgaacacccccgcccccgtggccatgcccgccagccccccccccggccccccccccgcccccgagcccggccccccccccagcgtgatcaccttcgcccaccccgcccccagcgtgatcgtgcacggcggcagcagcagcggcggcggcggcagcggcaccgccagcaccggcggcagccaggccgccagcgtgatcacctacaccgccccccccagaccccccaagaagagagagtaccccccccccccccccgagcccgccgccacccccaccagccccgccaccgccgtgagccccgccaccgccgccggccccgccatggccaccaccaccgaggaggccaagggcagaaaccccagagccggcagaaccctgacctacaccgccaagcccgtgggcggcatcggcggcggcggcggcccccccaccggcgccggcagaggccccagccagctgcaggcccccccccccctgtgccagatcaccgtgagaatcggcgaggaggccatcgtgaagagaagaatcagcgagaccgacctgagacccggcgagctgagcggcgaggagatggaggagagcgaggaggacgaggaggaggaggacgaggaggaggaggaggaggacgaggaggagagcaaggccggcggcgaggaccagctgtggagaccctactacagctacaagcccaagagaaaggccggcgccgccggcggcgccagcgtgggcggcagcggcctgcccagaggcagaagaccccccagatggagacagaagctggagagaagaagctgggaggagacccccgccgccgagagccccgccggcagagccagaaccgagagaagacacagatgcggcgactgcgcccagaccttcaccaccctgagaaagctgagaaagcaccaggaggcccacggcggcggcagccacagcagcagagccggcagaagacccagcaccagattcacctgcccccactgcgccaaggtgtgcaagaccgccgccgccctgagcagacacggccagagacacgccgccgagagacccggcggcacccccacccccgtgatcgcctacagcaagggcagcgccggcaccagacccggcgacgtgaaggaggaggccccccaggagatgcaggtgagcagcagcagcggcgaggccggcggcggcagcaccgccgccgaggaggccagcgagaccgccagcctgcaggaccccatcatcagcggcggcgaggagccccccgtggtggccagcggcggcagctacgtgtacccccccgtgcaggagttccccctggccctgatcggcggcggcagagagcccggcggcggcagaggcaagagcggcagcgagggccccgtgggcgccggcgagggcgacagaatggagggcatcggcgccgccaaggtgaccttctaccccgagccctaccccctggtgtacggcccccagctgctggccgcctacccctacaacttcagcaacctggccgccctgcccgtggccctgaacatggtgctgcccgacgagaagggcgccggcgccctgcccttcctgcccggcgtgttcggctacgccgtgaacccccaggccgccccccccgccccccccaccccccccccccccaccctgcccccccccatcccccccaagggcgagggcgagagagccggcgtggagagaacccagaagggcgacgtgggctag

SEQ ID NO: 105577 - DNA, 3042 bp, Artificial Sequence; identical to SEQ ID NO: 105576
  Description of Artificial Sequence: Synthetic coding sequence

SEQ ID NO: 105578 - DNA, 708 bp, Artificial Sequence
  Description of Artificial Sequence: Synthetic coding sequence
atggagctgcccaactacagcagacagctgctgcagcagctgtacaccctgtgcaaggagcagcagttctgcgactgcaccatcagcatcggcaccatctacttcagagcccacaagctggtgctggccgccgccagcctgctgttcaagaccctgctggacaacaccgacaccatcagcatcgacgccagcgtggtgagccccgaggagttcgccctgctgctggagatgatgtacaccggcaagctgcccgtgggcaagcacaacttcagcaagatcatcagcctggccgacagcctgcagatgttcgacgtggccgtgagctgcaagaacctgctgaccagcctgctggccgccacccccggcggccccgtgaaggccgagaccgaggaggccgcccacagcgtgagccaggagatgagcgtgaacagccccaccgcccaggagagccagagaaacgccgagacccccgccgagacccccaccaccgccgaggcctgcagccccagccccgccgtgcagaccttcagcgaggccaagaagaccagcaccgagcccggctgcgagagaaagcactaccagctgaacttcctgctggagaacgagggcgtgttcagcgacgccctgatggtgacccaggacgtgctgaagaagctggagatgtgcagcaactgctgcgtgcccgtggaggccgtgcccatcttctag

SEQ ID NO: 105579 - DNA, 3384 bp, Artificial Sequence
  Description of Artificial Sequence: Synthetic coding sequence
atggagctgcccaactacagcagacagctgctgcagcagctgtacaccctgtgcaaggagcagcagttctgcgactgcaccatcagcatcggcaccatctacttcagagcccacaagctggtgctggccgccgccagcctgctgttcaagaccctgctggacaacaccgacaccatcagcatcgacgccagcgtggtgagccccgaggagttcgccctgctgctggagatgatgtacaccggcaagctgcccgtgggcaagcacaacttcagcaagatcatcagcctggccgacagcctgcagatgttcgacgtggccgtgagctgcaagaacctgctgaccagcctggtgaactgcagcgtgcagggccaggtggtgagagacgtgagcgcccccagcagcgagaccttcagaaaggagcccgagaagccccaggtggagatcctgagcagcgagggcgccggcgagccccacagcagccccgagctggccgccacccccggcggccccgtgaaggccgagaccgaggaggccgcccacagcgtgagccaggagatgagcgtgaacagccccaccgcccaggagagccagagaaacgccgagacccccgccgagacccccaccaccgccgaggcctgcagccccagccccgccgtgcagaccttcagcgaggccaagaagaccagcaccgagcccggctgcgagagaaagcactaccagctgaacttcctgctggagaacgagggcgtgttcagcgacgccctgatggtgacccaggacgtgctgaagaagctggagatgtgcagcgagatcaagggcccccagaaggaggtgatcctgaactgctgcgagggcagaacccccaaggagaccatcgagaacctgctgcacagaatgaccgaggagaagaccctgaccgccgagggcctggtgaagctgctgcaggccgtgaagaccaccttccccaacctgggcctgctgctggagaagctgcagaagagcgccaccctgcccagcaccaccgtgcagcccagccccgacgactacggcaccgagctgctgagaagataccacgagaacctgagcgagatcttcaccgacaaccagatcctgctgaagatgatcagccacatgaccagcctggcccccggcgagagagaggtgatggagaagctggtgaagagagacagcggcagcggcggcttcaacagcctgatcagcgccgtgctggagaagcagaccctgagcgccaccgccatctggcagctgctgctggtggtgcaggagaccaagacctgccccctggacctgctgatggaggagatcagaagagagcccggcgccgacgccttcttcagagccgtgaccacccccgagcacgccaccctggagaccatcctgagacacaaccagctgatcctggaggccatccagcagaagatcgagtacaagctgttcaccagcgaggaggagcacctggccgagaccgtgaaggagatcctgagcatccccagcgagaccgccagccccgaggccagcctgagagccgtgctgagcagagccatggagaagagcgtgcccgccatcgagatctgccacctgctgtgcagcgtgcacaagagcttccccggcctgcagcccgtgatgcaggagctggcctacatcggcgtgctgaccaaggaggacggcgagaaggagacctggaaggtgagcaacaagttccacctggaggccaacaacaaggaggacgagaaggccgccaaggaggacagccagcccggcgagcagaacgaccagggcgagaccggcagcctgcccggccagcaggagaaggaggccagcgccagccccgaccccgccaagaagagcttcatctgcaaggcctgcgacaagagcttccacttctactgcagactgaaggtgcacatgaagagatgcagagtggccaagagcaagcaggtgcagtgcaaggagtgcagcgagaccaaggacagcaagaaggagctggacaagcaccagctggaggcccacggcgccggcggcgagcccgacgcccccaagaagaagaagaagagactgcccgtgacctgcgacctgtgcggcagagagttcgcccacgccagcggcatgcagtaccacaagctgaccgagcacttcgacgagaagcccttcagctgcgaggagtgcggcgccaagttcgccgccaacagcaccctgaagaaccacctgagactgcacaccggcgacagacccttcatgtgcaagcactgcctgatgaccttcacccaggccagcgccctggcctaccacaccaagaagaagcacagcgagggcaagatgtacgcctgccagtactgcgacgccgtgttcgcccagagcatcgagctgagcagacacgtgagaacccacaccggcgacaagccctacgtgtgcagagactgcggcaagggcttcagacaggccaacggcctgagcatccacctgcacaccttccacaacatcgaggacccctacgactgcaagaagtgcagaatgagcttccccaccctgcaggaccacagaaagcacatccacgaggtgcacagcaaggagtaccacccctgccccacctgcggcaagatcttcagcgcccccagcatgctggagagacacgtggtgacccacgtgggcggcaagcccttcagctgcggcatctgcaacaaggcctaccagcagctgagcggcctgtggtaccacaacagaacccaccaccccgacgtgttcgccgcccagaaccacagaagcagcaagttcagcagcctgcagtgcagcagctgcgacaagaccttccccaacaccatcgagcacaagaagcacatcaaggccgagcacgccgacatgaagttccacgagtgcgaccagtgcaaggagctgttccccacccccgccctgctgcaggtgcacgtgaagtgccagcacagcggcagccagcccttcagatgcctgtactgcgccgccaccttcagattccccggcgccctgcagcaccacgtgaccaccgagcacttcaagcagagcgagaccaccttcccctgcgagctgtgcggcgagctgttcaccagccaggcccagctggacagccacctggagagcgagcaccccaaggtgatgagcaccgagacccaggccgccgccagccagatggcccaggtgatccagacccccgagcccgtggcccccaccgagcaggtgatcaccctggaggagacccagctggccggcagccaggtgttcgtgaccctgcccgacagccaggccagccaggccagcagcgagctggtggccgtgaccgtggaggacctgctggacggcaccgtgaccctgatctgcggcgaggccaagtag

SEQ ID NO: 105580 - DNA, 3720 bp, Artificial Sequence
  Description of Artificial Sequence: Synthetic coding sequence
atggagctgcccaactacagcagacagctgctgcagcagctgtacaccctgtgcaaggagcagcagttctgcgactgcaccatcagcatcggcaccatctacttcagagcccacaagctggtgctggccgccgccagcctgctgttcaagaccctgctggacaacaccgacaccatcagcatcgacgccagcgtggtgagccccgaggagttcgccctgctgctggagatgatgtacaccggcaagctgcccgtgggcaagcacaacttcagcaagatcatcagcctggccgacagcctgcagatgttcgacgtggccgtgagctgcaagaacctgctgaccagcctggtgaactgcagcgtgcagggccaggtggtgagagacgtgagcgcccccagcagcgagaccttcagaaaggagcccgagaagccccaggtggagatcctgagcagcgagggcgccggcgagccccacagcagccccgagctggccgccacccccggcggccccgtgaaggccgagaccgaggaggccgcccacagcgtgagccaggagatgagcgtgaacagccccaccgcccaggagagccagagaaacgccgagacccccgccgagacccccaccaccgccgaggcctgcagccccagccccgccgtgcagaccttcagcgaggccaagaagaccagcaccgagcccggctgcgagagaaagcactaccagctgaacttcctgctggagaacgagggcgtgttcagcgacgccctgatggtgacccaggacgtgctgaagaagctggagatgtgcagcgagatcaagggcccccagaaggagatgatcgtgaagtgcttcgagggcgagggcggccacagcgccttccagagaatcctgggcaaggtgagagaggagagcctggacgtgcagaccgtggtgagcctgctgagactgtaccagtacagcaaccccgccgtgaagaccgccctgctggacagaaagcccgaggacgtggacaccgtgcagcccaagggcagcaccgaggagggcaagaccctgagcgtgctgctgctggagcacaaggaggacctgatccagtgcgtgacccagctgagacccatcatggagagcctggagaccgccaaggaggagttcctgaccggcaccgagaagagagtgatcctgaactgctgcgagggcagaacccccaaggagaccatcgagaacctgctgcacagaatgaccgaggagaagaccctgaccgccgagggcctggtgaagctgctgcaggccgtgaagaccaccttccccaacctgggcctgctgctggagaagctgcagaagagcgccaccctgcccagcaccaccgtgcagcccagccccgacgactacggcaccgagctgctgagaagataccacgagaacctgagcgagatcttcaccgacaaccagatcctgctgaagatgatcagccacatgaccagcctggcccccggcgagagagaggtgatggagaagctggtgaagagagacagcggcagcggcggcttcaacagcctgatcagcgccgtgctggagaagcagaccctgagcgccaccgccatctggcagctgctgctggtggtgcaggagaccaagacctgccccctggacctgctgatggaggagatcagaagagagcccggcgccgacgccttcttcagagccgtgaccacccccgagcacgccaccctggagaccatcctgagacacaaccagctgatcctggaggccatccagcagaagatcgagtacaagctgttcaccagcgaggaggagcacctggccgagaccgtgaaggagatcctgagcatccccagcgagaccgccagccccgaggccagcctgagagccgtgctgagcagagccatggagaagagcgtgcccgccatcgagatctgccacctgctgtgcagcgtgcacaagagcttccccggcctgcagcccgtgatgcaggagctggcctacatcggcgtgctgaccaaggaggacggcgagaaggagacctggaaggtgagcaacaagttccacctggaggccaacaacaaggaggacgagaaggccgccaaggaggacagccagcccggcgagcagaacgaccagggcgagaccggcagcctgcccggccagcaggagaaggaggccagcgccagccccgaccccgccaagaagagcttcatctgcaaggcctgcgacaagagcttccacttctactgcagactgaaggtgcacatgaagagatgcagagtggccaagagcaagcaggtgcagtgcaaggagtgcagcgagaccaaggacagcaagaaggagctggacaagcaccagctggaggcccacggcgccggcggcgagcccgacgcccccaagaagaagaagaagagactgcccgtgacctgcgacctgtgcggcagagagttcgcccacgccagcggcatgcagtaccacaagctgaccgagcacttcgacgagaagcccttcagctgcgaggagtgcggcgccaagttcgccgccaacagcaccctgaagaaccacctgagactgcacaccggcgacagacccttcatgtgcaagcactgcctgatgaccttcacccaggccagcgccctggcctaccacaccaagaagaagcacagcgagggcaagatgtacgcctgccagtactgcgacgccgtgttcgcccagagcatcgagctgagcagacacgtgagaacccacaccggcgacaagccctacgtgtgcagagactgcggcaagggcttcagacaggccaacggcctgagcatccacctgcacaccttccacaacatcgaggacccctacgactgcaagaagtgcagaatgagcttccccaccctgcaggaccacagaaagcacatccacgaggtgcacagcaaggagtaccacccctgccccacctgcggcaagatcttcagcgcccccagcatgctggagagacacgtggtgacccacgtgggcggcaagcccttcagctgcggcatctgcaacaaggcctaccagcagctgagcggcctgtggtaccacaacagaacccaccaccccgacgtgttcgccgcccagaaccacagaagcagcaagttcagcagcctgcagtgcagcagctgcgacaagaccttccccaacaccatcgagcacaagaagcacatcaaggccgagcacgccgacatgaagttccacgagtgcgaccagtgcaaggagctgttccccacccccgccctgctgcaggtgcacgtgaagtgccagcacagcggcagccagcccttcagatgcctgtactgcgccgccaccttcagattccccggcgccctgcagcaccacgtgaccaccgagcacttcaagcagagcgagaccaccttcccctgcgagctgtgcggcgagctgttcaccagccaggcccagctggacagccacctggagagcgagcaccccaaggtgatgagcaccgagacccaggccgccgccagccagatggcccaggtgatccagacccccgagcccgtggcccccaccgagcaggtgatcaccctggaggagacccagctggccggcagccaggtgttcgtgaccctgcccgacagccaggccagccaggccagcagcgagctggtggccgtgaccgtggaggacctgctggacggcaccgtgaccctgatctgcggcgaggccaagtag

SEQ ID NO: 105581 - DNA, 1362 bp, Artificial Sequence
  Description of Artificial Sequence: Synthetic coding sequence
atggagctgcccaactacagcagacagctgctgcagcagctgtacaccctgtgcaaggagcagcagttctgcgactgcaccatcagcatcggcaccatctacttcagagcccacaagctggtgctggccgccgccagcctgctgttcaagaccctgctggacaacaccgacaccatcagcatcgacgccagcgtggtgagccccgaggagttcgccctgctgctggagatgatgtacaccggcaagctgcccgtgggcaagcacaacttcagcaagatcatcagcctggccgacagcctgcagatgttcgacgtggccgtgagctgcaagaacctgctgaccagcctggtgaactgcagcgtgcagggccaggtggtgagagacgtgagcgcccccagcagcgagaccttcagaaaggagcccgagaagccccaggtggagatcctgagcagcgagggcgccggcgagccccacagcagccccgagctggccgccacccccggcggccccgtgaaggccgagaccgaggaggccgcccacagcgtgagccaggagatgagcgtgaacagccccaccgcccaggagagccagagaaacgccgagacccccgccgagacccccaccaccgccgaggcctgcagccccagccccgccgtgcagaccttcagcgaggccaagaagaccagcaccgagcccggctgcgagagaaagcactaccagctgaacttcctgctggagaacgagggcgtgttcagcgacgccctgatggtgacccaggacgtgctgaagaagctggagatgtgcagcgagatcaagggcccccagaaggagatgatcgtgaagtgcttcgagggcgagggcggccacagcgccttccagagaatcctgggcaaggtgagagaggagagcctggacgtgcagaccgtggtgagcctgctgagactgtaccagtacagcaaccccgccgtgaagaccgccctgctggacagaaagcccgaggacgtggacaccgtgcagcccaagggcagcaccgaggagggcaagaccctgagcgtgctgctgctggagcacaaggaggacctgatccagtgcgtgacccagctgagacccatcatggagagcctggagaccgccaaggaggagttcctgaccggcaccgagaagagagtgatcctgaactgctgcgagggcagaacccccaaggagaccatcgagaacctgctgcacagaatgaccgaggagaagaccctgaccgccgagggcctggtgaagctgctgcaggccgtgaagaccaccttccccaacctgggcctgctgctggagaagctgcagaagagcgccaccctgcccagcaccacctag

SEQ ID NO: 105582 - DNA, 3720 bp, Artificial Sequence; identical to SEQ ID NO: 105580
  Description of Artificial Sequence: Synthetic coding sequence

SEQ ID NO: 105583 - DNA, 1269 bp, Artificial Sequence
  Description of Artificial Sequence: Synthetic coding sequence
atggagttccccgagcacggcggcagactgctgggcagactgagacagcagagagagctgggcttcctgtgcgactgcaccgtgctggtgggcgacgccagattccccgcccacagagccgtgctggccgcctgcagcgtgtacttccacctgttctacagagacagacccgccggcagcagagacaccgtgagactgaacggcgacatcgtgaccgcccccgccttcggcagactgctggacttcatgtacgagggcagactggacctgagaagcctgcccgtggaggacgtgctggccgccgccagctacctgcacatgtacgacatcgtgaaggtgtgcaagggcagactgcaggagaaggacagaagcctggaccccggcaaccccgcccccggcgccgagcccgcccagcccccctgcccctggcccgtgtggaccgccgacctgtgccccgccgccagaaaggccaagctgccccccttcggcgtgaaggccgccctgccccccagagccagcggcccccccccctgccaggtgcccgaggagagcgaccaggccctggacctgagcctgaagagcggccccagacaggagagagtgcaccccccctgcgtgctgcagacccccctgtgcagccagagacagcccggcgcccagcccctggtgaaggacgagagagacagcctgagcgagcaggaggagagcagcagcagcagaagcccccacagcccccccaagcccccccccgtgcccgccgccaagggcctggtggtgggcctgcagcccctgcccctgagcggcgagggcagcagagagctggagctgggcgccggcagactggccagcgaggacgagctgggccccggcggccccctgtgcatctgccccctgtgcagcaagctgttccccagcagccacgtgctgcagctgcacctgagcgcccacttcagagagagagacagcaccagagccagactgagccccgacggcgtggcccccacctgccccctgtgcggcaagaccttcagctgcacctacaccctgaagagacacgagagaacccacagcggcgagaagccctacacctgcgtgcagtgcggcaagagcttccagtacagccacaacctgagcagacacaccgtggtgcacaccagagagaagccccacgcctgcagatggtgcgagagaagattcacccagagcggcgacctgtacagacacgtgagaaagttccactgcggcctggtgaagagcctgctggtgtag

SEQ ID NO: 105584 - DNA, 1269 bp, Artificial Sequence; identical to SEQ ID NO: 105583
  Description of Artificial Sequence: Synthetic coding sequence

SEQ ID NO: 105585 - DNA, 1815 bp, Artificial Sequence
  Description of Artificial Sequence: Synthetic coding sequence
atggccagcacctgggccatccaggcccacatggaccaggacgagcccctggaggtgaagatcgaggaggagaagtacaccaccagacaggactgggacctgagaaagaacaacacccacagcagagaggtgttcagacagtacttcagacagttctgctaccaggagaccagcggccccagagaggccctgagcagactgagagagctgtgccaccagtggctgagacccgagacccacaccaaggagcagatcctggagctgctggtgctggagcagttcctgaccatcctgcccgaggagctgcaggcctgggtgcaggagcagcaccccgagagcggcgaggaggtggtgaccgtgctggaggacctggagagagagctggacgagcccggcgagcaggtgagcgtgcacaccggcgagcaggagatgttcctgcaggagaccgtgagactgagaaaggagggcgagcccagcatgagcctgcagagcatgaaggcccagcccaagtacgagagccccgagctggagagccagcaggagcaggtgctggacgtggagaccggcaacgagtacggcaacctgaagcaggaggtgagcgaggagatggagccccacggcaagaccagcagcaagttcgagaacgacatgagcaagagcgccagatgcggcgagaccagagagcccgaggagatcaccgaggagcccagcgcctgcagcagagaggacaagcagcccacctgcgacgagaacggcgtgagcctgaccgagaacagcgaccacaccgagcaccagagaatctgccccggcgaggagagctacggctgcgacgactgcggcaaggccttcagccagcacagccacctgatcgagcaccagagaatccacaccggcgacagaccctacaagtgcgaggagtgcggcaaggccttcagaggcagaaccgtgctgatcagacacaagatcatccacaccggcgagaagccctacaagtgcaacgagtgcggcaaggccttcggcagatggagcgccctgaaccagcaccagagactgcacaccggcgagaagcactaccactgcaacgactgcggcaaggccttcagccagaaggccggcctgttccaccacatcaagatccacaccagagacaagccctaccagtgcacccagtgcaacaagagcttcagcagaagaagcatcctgacccagcaccagggcgtgcacaccggcgccaagccctacgagtgcaacgagtgcggcaaggccttcgtgtacaacagcagcctggtgagccaccaggagatccaccacaaggagaagtgctaccagtgcaaggagtgcggcaagagcttcagccagagcggcctgatccagcaccagagaatccacaccggcgagaagccctacaagtgcgacgtgtgcgagaaggccttcatccagagaaccagcctgaccgagcaccagagaatccacaccggcgagagaccctacaagtgcgacaagtgcggcaaggccttcacccagagaagcgtgctgaccgagcaccagagaatccacaccggcgagagaccctacaagtgcgacgagtgcggcaacgccttcagaggcatcaccagcctgatccagcaccagagaatccacaccggcgagaagccctaccagtgcgacgagtgcggcaaggccttcagacagagaaagaagaccagctacaaggagatcctgctgaagaaccacagcgagccccaggccggcgtgaacctgctgctgagcagcctgatccccgagtggcagagctgcttcagaagagacctgtag

SEQ ID NO: 105586 - DNA, 1815 bp, Artificial Sequence; identical to SEQ ID NO: 105585
  Description of Artificial Sequence: Synthetic coding sequence

SEQ ID NO: 105587 - DNA, 1476 bp, Artificial Sequence
  Description of Artificial Sequence: Synthetic coding sequence
atggccatccccaagcacagcctgagccccgtgccctgggaggaggacagcttcctgcaggtgaaggtggaggaggaggaggaggccagcctgagccagggcggcgagagcagccacgaccacatcgcccacagcgaggccgccagactgagattcagacacttcagatacgaggaggccagcggcccccacgaggccctggcccacctgagagccctgtgctgccagtggctgcagcccgaggcccacagcaaggagcagatcctggagctgctggtgctggagcagttcctgggcgccctgccccccgagatccaggcctgggtgggcgcccagagccccaagagcggcgaggaggccgccgtgctggtggaggacctgacccaggtgctggacaagagaggctgggaccccggcgccgagcccaccgaggccagctgcaagcagagcgacctgggcgagagcgagcccagcaacgtgaccgagaccctgatgggcggcgtgagcctgggccccgccttcgtgaaggcctgcgagcccgagggcagcagcgagagaagcggcctgagcggcgagatctggaccaagagcgtgacccagcagatccacttcaagaagaccagcggcccctacaaggacgtgcccaccgaccagagaggcagagagagcggcgccagcagaaacagcagcagcgcctggcccaacctgaccagccaggagaagccccccagcgaggacaagttcgacctggtggacgcctacggcaccgagcccccctacacctacagcggcaagagaagcagcaagtgcagagagtgcagaaagatgttccagagcgccagcgccctggaggcccaccagaagacccacagcagaaagaccccctacgcctgcagcgagtgcggcaaggccttcagcagaagcacccacctggcccagcaccaggtggtgcacaccggcgccaagccccacgagtgcaaggagtgcggcaaggccttcagcagagtgacccacctgacccagcaccagagaatccacaccggcgagaagccctacaagtgcggcgagtgcggcaagaccttcagcagaagcacccacctgacccagcaccagagagtgcacaccggcgagagaccctacgagtgcgacgcctgcggcaaggccttcagccagagcacccacctgacccagcaccagagaatccacaccggcgagaagccctacaagtgcgacgcctgcggcagagccttcagcgactgcagcgccctgatcagacacctgagaatccacagcggcgagaagccctaccagtgcaaggtgtgccccaaggccttcgcccagagcagcagcctgatcgagcaccagagaatccacaccggcgagaagccctacaagtgcagcgactgcggcaaggccttcagcagaagcagcgccctgatggtgcacctgagaatccacatcaccgtgctgcagtag

SEQ ID NO: 105588 - DNA, 1302 bp, Artificial Sequence
  Description of Artificial Sequence: Synthetic coding sequence
atggccctggacctgagaaccatcttccagtgcgagcccagcgagaacaacctgggcagcgagaacagcgccttccagcagagccagggccccgccgtgcagagagaggagggcatcagcgagttcagcagaatggtgctgaacagcttccaggacagcaacaacagctacgccagacaggagctgcagagactgtacagaatcttccacagctggctgcagcccgagaagcacagcaaggacgagatcatcagcctgctggtgctggagcagttcatgatcggcggccactgcaacgacaaggccagcgtgaaggagaagtggaagagcagcggcaagaacctggagagattcatcgaggacctgaccgacgacagcatcaacccccccgccctggtgcacgtgcacatgcagggccaggaggccctgttcagcgaggacatgcccctgagagacgtgatcgtgcacctgaccaagcaggtgaacgcccagaccaccagagaggccaacatgggcacccccagccagaccagccaggacaccagcctggagaccggccagggctacgaggacgagcaggacggctggaacagcagcagcaagaccaccagagtgaacgagaacatcaccaaccagggcaaccagatcgtgagcctgatcatcatccaggaggagaacggccccagacccgaggagggcggcgtgagcagcgacaacccctacaacagcaagagagccgagctggtgaccgccagaagccaggagggcagcatcaacggcatcaccttccagggcgtgcccatggtgatgggcgccggctgcatcagccagcccgagcagagcagccccgagagcgccctgacccaccagagcaacgagggcaacagcacctgcgaggtgcaccagaagggcagccacggcgtgcagaagagctacaagtgcgaggagtgccccaaggtgttcaagtacctgtgccacctgctggcccaccagagaagacacagaaacgagagacccttcgtgtgccccgagtgccagaagggcttcttccagatcagcgacctgagagtgcaccagatcatccacaccggcaagaagcccttcacctgcagcatgtgcaagaagagcttcagccacaagaccaacctgagaagccacgagagaatccacaccggcgagaagccctacacctgccccttctgcaagaccagctacagacagagcagcacctaccacagacacatgagaacccacgagaagatcaccctgcccagcgtgcccagcacccccgaggccagctag

SEQ ID NO: 105589 - DNA, 2433 bp, Artificial Sequence
  Description of Artificial Sequence: Synthetic coding sequence
atgcccaaccagggcgaggactgctacttcttcttctacagcacctgcaccaagggcgacagctgccccttcagacactgcgaggccgccatcggcaacgagaccgtgtgcaccctgtggcaggagggcagatgcttcagacaggtgtgcagattcagacacatggagatcgacaagaagagaagcgagatcccctgctactgggagaaccagcccaccggctgccagaagctgaactgcgccttccaccacaacagaggcagatacgtggacggcctgttcctgccccccagcaagaccgtgctgcccaccgtgcccgagagccccgaggaggaggtgaaggccagccagctgagcgtgcagcagaacaagctgagcgtgcagagcaaccccagcccccagctgagaagcgtgatgaaggtggagagcagcgagaacgtgcccagccccacccacccccccgtggtgatcaacgccgccgacgacgacgaggacgacgacgaccagttcagcgaggagggcgacgagaccaagacccccaccctgcagcccacccccgaggtgcacaacggcctgagagtgaccagcgtgagaaagcccgccgtgaacatcaagcagggcgagtgcctgaacttcggcatcaagaccctggaggagatcaagagcaagaagatgaaggagaagagcaagaagcagggcgagggcagcagcggcgtgagcagcctgctgctgcaccccgagcccgtgcccggccccgagaaggagaacgtgagaaccgtggtgagaaccgtgaccctgagcaccaagcagggcgaggagcccctggtgagactgagcctgaccgagagactgggcaagagaaagttcagcgccggcggcgacagcgacccccccctgaagagaagcctggcccagagactgggcaagaaggtggaggcccccgagaccaacatcgacaagacccccaagaaggcccaggtgagcaagagcctgaaggagagactgggcatgagcgccgaccccgacaacgaggacgccaccgacaaggtgaacaaggtgggcgagatccacgtgaagaccctggaggagatcctgctggagagagccagccagaagagaggcgagctgcagaccaagctgaagaccgagggccccagcaagaccgacgacagcaccagcggcgccagaagcagcagcaccatcagaatcaagaccttcagcgaggtgctggccgagaagaagcacagacagcaggaggccgagagacagaagagcaagaaggacaccacctgcatcaagctgaagatcgacagcgagatcaagaagaccgtggtgctgccccccatcgtggccagcagaggccagagcgaggagcccgccggcaagaccaagagcatgcaggaggtgcacatcaagaccctggaggagatcaagctggagaaggccctgagagtgcagcagagcagcgagagcagcaccagcagccccagccagcacgaggccacccccggcgccagaagactgctgagaatcaccaagagaaccggcatgaaggaggagaagaacctgcaggagggcaacgaggtggacagccagagcagcatcagaaccgaggccaaggaggccagcggcgagaccaccggcgtggacatcaccaagatccaggtgaagagatgcgagaccatgagagagaagcacatgcagaagcagcaggagagagagaagagcgtgctgacccccctgagaggcgacgtggccagctgcaacacccaggtggccgagaagcccgtgctgaccgccgtgcccggcatcaccagacacctgaccaagagactgcccaccaagagcagccagaaggtggaggtggagaccagcggcatcggcgacagcctgctgaacgtgaagtgcgccgcccagaccctggagaagagaggcaaggccaagcccaaggtgaacgtgaagcccagcgtggtgaaggtggtgagcagccccaagctggcccccaagagaaaggccgtggagatgcacgccgccgtgatcgccgccgtgaagcccctgagcagcagcagcgtgctgcaggagccccccgccaagaaggccgccgtggccgtggtgcccctggtgagcgaggacaagagcgtgaccgtgcccgaggccgagaaccccagagacagcctggtgctgccccccacccagagcagcagcgacagcagcccccccgaggtgagcggccccagcagcagccagatgagcatgaagaccagaagactgagcagcgccagcaccggcaagccccccctgagcgtggaggacgacttcgagaagctgatctgggagatcagcggcggcaagctggaggccgagatcgacctggaccccggcaaggacgaggacgacctgctgctggagctgagcgagatgatcgacagctag

SEQ ID NO: 105590 - DNA, 2433 bp, Artificial Sequence; identical to SEQ ID NO: 105589
  Description of Artificial Sequence: Synthetic coding sequence

SEQ ID NO: 105591 - DNA, 2433 bp, Artificial Sequence; identical to SEQ ID NO: 105589
  Description of Artificial Sequence: Synthetic coding sequence

SEQ ID NO: 105592 - DNA, 2433 bp, Artificial Sequence; identical to SEQ ID NO: 105589
  Description of Artificial Sequence: Synthetic coding sequence

SEQ ID NO: 105593 - DNA, 153 bp, Artificial Sequence
  Description of Artificial Sequence: Synthetic coding sequence
atgcccaaccagggcgaggactgctacttcttcttctacagcacctgcaccaagggcgacagctgccccttcagacactgcgaggccgccatcggcaacgagaccgtgtgcaccctgtggcaggagggcagatgcttcagacaggtgtgctag

SEQ ID NO: 105594 - DNA, 1548 bp, Artificial Sequence
  Description of Artificial Sequence: Synthetic coding sequence
atgcccaaccagggcgaggactgctacttcttcttctacagcacctgcaccaagggcgacagctgccccttcagacactgcgaggccgccatcggcaacgagaccgtgtgcaccctgtggcaggagggcagatgcttcagacaggtgtgcagattcagacacatggagatcgacaagaagagaagcgagatcccctgctactgggagaaccagcccaccggctgccagaagctgaactgcgccttccaccacaacagaggcagatacgtggacggcctgttcctgccccccagcaagaccgtgctgcccaccgtgcccgagagccccgaggaggaggtgaaggccagccagctgagcgtgcagcagaacaagctgagcgtgcagagcaaccccagcccccagctgagaagcgtgatgaaggtggagagcagcgagaacgtgcccagccccacccacccccccgtggtgatcaacgccgccgacgacgacgaggacgacgacgaccagttcagcgaggagggcgacgagaccaagacccccaccctgcagcccacccccgaggtgcacaacggcctgagagtgaccagcgtgagaaagcccgccgtgaacatcaagcagggcgagtgcctgaacttcggcatcaagaccctggaggagatcaagagcaagaagatgaaggagaagagcaagaagcagggcgagggcagcagcggcgtgagcagcctgctgctgcaccccgagcccgtgcccggccccgagaaggagaacgtgagaaccgtggtgagaaccgtgaccctgagcaccaagcagggcgaggagcccctggtgagactgagcctgaccgagagactgggcaagagaaagttcagcgccggcggcgacagcgacccccccctgaagagaagcctggcccagagactgggcaagaaggtggaggcccccgagaccaacatcgacaagacccccaagaaggcccaggtgagcaagagcctgaaggagagactgggcatgagcgccgaccccgacaacgaggacgccaccgacaaggtgaacaaggtgggcgagatccacgtgaagaccctggaggagatcctgctggagagagccagccagaagagaggcgagctgcagaccaagctgaagaccgagggccccagcaagaccgacgacagcaccagcggcgccagaagcagcagcaccatcagaatcaagaccttcagcgaggtgctggccgagaagaagcacagacagcaggaggccgagagacagaagagcaagaaggacaccacctgcatcaagctgaagatcgacagcgagatcaagaagaccgtggtgctgccccccatcgtggccagcagaggccagagcgaggagcccgccggcaagaccaagagcatgcaggaggtgcacatcaagaccctggaggagatcaagctggagaaggccctgagagtgcagcagagcagcgagagcagcaccagcagccccagccagcacgaggccacccccggcgccagaagactgctgagaatcaccaagagaacctag

SEQ ID NO: 105595 - DNA, 2271 bp, Artificial Sequence
  Description of Artificial Sequence: Synthetic coding sequence
atggagatcgacaagaagagaagcgagatcccctgctactgggagaaccagcccaccggctgccagaagctgaactgcgccttccaccacaacagaggcagatacgtggacggcctgttcctgccccccagcaagaccgtgctgcccaccgtgcccgagagccccgaggaggaggtgaaggccagccagctgagcgtgcagcagaacaagctgagcgtgcagagcaaccccagcccccagctgagaagcgtgatgaaggtggagagcagcgagaacgtgcccagccccacccacccccccgtggtgatcaacgccgccgacgacgacgaggacgacgacgaccagttcagcgaggagggcgacgagaccaagacccccaccctgcagcccacccccgaggtgcacaacggcctgagagtgaccagcgtgagaaagcccgccgtgaacatcaagcagggcgagtgcctgaacttcggcatcaagaccctggaggagatcaagagcaagaagatgaaggagaagagcaagaagcagggcgagggcagcagcggcgtgagcagcctgctgctgcaccccgagcccgtgcccggccccgagaaggagaacgtgagaaccgtggtgagaaccgtgaccctgagcaccaagcagggcgaggagcccctggtgagactgagcctgaccgagagactgggcaagagaaagttcagcgccggcggcgacagcgacccccccctgaagagaagcctggcccagagactgggcaagaaggtggaggcccccgagaccaacatcgacaagacccccaagaaggcccaggtgagcaagagcctgaaggagagactgggcatgagcgccgaccccgacaacgaggacgccaccgacaaggtgaacaaggtgggcgagatccacgtgaagaccctggaggagatcctgctggagagagccagccagaagagaggcgagctgcagaccaagctgaagaccgagggccccagcaagaccgacgacagcaccagcggcgccagaagcagcagcaccatcagaatcaagaccttcagcgaggtgctggccgagaagaagcacagacagcaggaggccgagagacagaagagcaagaaggacaccacctgcatcaagctgaagatcgacagcgagatcaagaagaccgtggtgctgccccccatcgtggccagcagaggccagagcgaggagcccgccggcaagaccaagagcatgcaggaggtgcacatcaagaccctggaggagatcaagctggagaaggccctgagagtgcagcagagcagcgagagcagcaccagcagccccagccagcacgaggccacccccggcgccagaagactgctgagaatcaccaagagaaccggcatgaaggaggagaagaacctgcaggagggcaacgaggtggacagccagagcagcatcagaaccgaggccaaggaggccagcggcgagaccaccggcgtggacatcaccaagatccaggtgaagagatgcgagaccatgagagagaagcacatgcagaagcagcaggagagagagaagagcgtgctgacccccctgagaggcgacgtggccagctgcaacacccaggtggccgagaagcccgtgctgaccgccgtgcccggcatcaccagacacctgaccaagagactgcccaccaagagcagccagaaggtggaggtggagaccagcggcatcggcgacagcctgctgaacgtgaagtgcgccgcccagaccctggagaagagaggcaaggccaagcccaaggtgaacgtgaagcccagcgtggtgaaggtggtgagcagccccaagctggcccccaagagaaaggccgtggagatgcacgccgccgtgatcgccgccgtgaagcccctgagcagcagcagcgtgctgcaggagccccccgccaagaaggccgccgtggccgtggtgcccctggtgagcgaggacaagagcgtgaccgtgcccgaggccgagaaccccagagacagcctggtgctgccccccacccagagcagcagcgacagcagcccccccgaggtgagcggccccagcagcagccagatgagcatgaagaccagaagactgagcagcgccagcaccggcaagccccccctgagcgtggaggacgacttcgagaagctgatctgggagatcagcggcggcaagctggaggccgagatcgacctggaccccggcaaggacgaggacgacctgctgctggagctgagcgagatgatcgacagctag

SEQ ID NO: 105596 - DNA, 2433 bp, Artificial Sequence; identical to SEQ ID NO: 105589
  Description of Artificial Sequence: Synthetic coding sequence

SEQ ID NO: 105597 - DNA, 1584 bp, Artificial Sequence
  Description of Artificial Sequence: Synthetic coding sequence
atggagcaccccagcaagatggagttcttccagaagctgggctacgacagagaggacgtgctgagagtgctgggcaagctgggcgagggcgccctggtgaacgacgtgctgcaggagctgatcagaaccggcagcagacccggcgccctggagcaccccgccgcccccagactggtgcccagaggcagctgcggcgtgcccgacagcgcccagagaggccccggcaccgccctggaggaggacttcagaaccctggccagcagcctgagacccatcgtgatcgacggcagcaacgtggccatgagccacggcaacaaggagaccttcagctgcagaggcatcaagctggccgtggactggttcagagacagaggccacacctacatcaaggtgttcgtgcccagctggagaaaggacccccccagagccgacacccccatcagagagcagcacgtgctggccgagctggagagacaggccgtgctggtgtacacccccagcagaaaggtgcacggcaagagactggtgtgctacgacgacagatacatcgtgaaggtggcctacgagcaggacggcgtgatcgtgagcaacgacaactacagagacctgcagagcgagaaccccgagtggaagtggttcatcgagcagagactgctgatgttcagcttcgtgaacgacagattcatgccccccgacgaccccctgggcagacacggccccagcctgagcaacttcctgagcagaaagcccaagccccccgagcccagctggcagcactgcccctacggcaagaagtgcacctacggcatcaagtgcaagttctaccaccccgagagaccccaccacgcccagctggccgtggccgacgagctgagagccaagaccggcgccagacccggcgccggcgccgaggagcagagaccccccagagcccccggcggcagcgccggcgccagagccgcccccagagagcccttcgcccacagcctgccccccgccagaggcagccccgacctggccgccctgagaggcagcttcagcagactggccttcagcgacgacctgggccccctgggcccccccctgcccgtgcccgcctgcagcctgacccccagactgggcggccccgactgggtgagcgccggcggcagagtgcccggccccctgagcctgcccagccccgagagccagttcagccccggcgacctgccccccccccccggcctgcagctgcagcccagaggcgagcacagacccagagacctgcacggcgacctgctgagccccagaagaccccccgacgacccctgggccagaccccccagaagcgacagattccccggcagaagcgtgtgggccgagcccgcctggggcgacggcgccaccggcggcctgagcgtgtacgccaccgaggacgacgagggcgacgccagagccagagccagaatcgccctgtacagcgtgttccccagagaccaggtggacagagtgatggccgccttccccgagctgagcgacctggccagactgatcctgctggtgcagagatgccagagcgccggcgcccccctgggcaagccctag

SEQ ID NO: 105598 - DNA, 1584 bp, Artificial Sequence; identical to SEQ ID NO: 105597
  Description of Artificial Sequence: Synthetic coding sequence

SEQ ID NO: 105599 - DNA, 966 bp, Artificial Sequence
  Description of Artificial Sequence: Synthetic coding sequence
atggagcaccccagcaagatggagttcttccagaagctgggctacgacagagaggacgtgctgagagtgctgggcaagctgggcgagggcgccctggtgaacgacgtgctgcaggagctgatcagaaccggcagcagacccggcgccctggagcaccccgccgcccccagactggtgcccagaggcagctgcggcgtgcccgacagcgcccagagaggccccggcaccgccctggaggaggacttcagaaccctggccagcagcctgagacccatcgtgatcgacggcagcaacgtggccatgagccacggcaacaaggagaccttcagctgcagaggcatcaagctggccgtggactggttcagagacagaggccacacctacatcaaggtgttcgtgcccagctggagaaaggacccccccagagccgacacccccatcagagagcagcacgtgctggccgagctggagagacaggccgtgctggtgtacacccccagcagaaaggtgcacggcaagagactggtgtgctacgacgacagatacatcgtgaaggtggcctacgagcaggacggcgtgatcgtgagcaacgacaactacagagacctgcagagcgagaaccccgagtggaagtggttcatcgagcagagactgctgatgttcagcttcgtgaacgacagattcatgccccccgacgaccccctgggcagacacggccccagcctgagcaacttcctgagcagaaagcccaagccccccgagcccagctggcagcactgcccctacggcaagaagtgcacctacggcatcaagtgcaagttctaccaccccgagagaccccaccacgcccagctggccgtggccgacgagctgagagccaagaccggcgccagactgggcgtgagaggcagaccccccgccagcgccagacccgccgcccccgccgccggcagaacccccccctag

SEQ ID NO: 105600 - DNA, 966 bp, Artificial Sequence
  Description of Artificial Sequence: Synthetic coding sequence
atggagcaccccagcaagatggagttcttccagaagctgggctacgacagagaggacgtgctgagagtgctgggcaagctgggcgagggcgccctggtgaacgacgtgctgcaggagctgatcagaaccggcagcagacccggcgccctggagcaccccgccgcccccagactggtgcccagaggcagctgcggcgtgcccgacagcgcccagagaggccccggcaccgccctggaggaggacttcagaaccctggccagcagcctgagacccatcgtgatcgacggcagcaacgtggccatgagccacggcaacaaggagaccttcagctgcagaggcatcaagctggccgtggactggttcagagacagaggccacacctacatcaaggtgttcgtgcccagctggagaaaggacccccccagagccgacacccccatcagagagcagcacgtgctggccgagctggagagacaggccgtgctggtgtacacccccagcagaaaggtgcacggcaagagactggtgtgctacgacgacagatacatcgtgaaggtggcctacgagcaggacggcgtgatcgtgagcaacgacaactacagagacctgcagagcgagaaccccgagtggaagtggttcatcgagcagagactgctgatgttcagcttcgtgaacgacagattcatgccccccgacgaccccctgggcagacacggccccagcctgagcaacttcctgagcagaaagcccaagccccccgagcccagctggcagcactgcccctacggcaagaagtgcacctacggcatcaagtgcaagttctaccaccccgagagaccccaccacgcccagctggccgtggccgacgagctgagagccaagaccggcgccagacccgtgctgcccggcagaccccccgccagcgccagacccgccgcccccgccgccggcagaacccccccctag

SEQ ID NO: 105601 - DNA, 2211 bp, Artificial Sequence
  Description of Artificial Sequence: Synthetic coding sequence
atggagatcggcaccgagatcagcagaaagatcagaagcgccatcaagggcaagctgcaggagctgggcgcctacgtggacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaacggcagcttcagcaacgccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105602 - DNA, 1740 bp, Artificial Sequence
  Description of Artificial Sequence: Synthetic coding sequence
atggagatcggcaccgagatcagcagaaagatcagaagcgccatcaagggcaagctgcaggagctgggcgcctacgtggacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccaggccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105603 - DNA, 921 bp, Artificial Sequence
  Description of Artificial Sequence: Synthetic coding sequence
atgagaatgagcagcaagttccccagcccccccctgcccatcttcctgccccccgagcccgtggacctgggcagcatcaccagcagcagctgcagcctgaacgagctggacaacatcagccacctgctgagaaagatcagcgccgacatcaacgagatcaagggcatgaaggccgccatcctgaccgtggaggccaacctgttcgacctgaacgtgagagtgagcaagaacgaggccaagatcagcagcctggaggtgaagatgaacgagtacagcaccacctacgagtgcaacagacagttcgaggaccaggaggaggacaccgagagccagagcagaaccaccgacgtgaagatcatcggcttcctgagaaacgtggagaagggcacccagcagagacagctgctgagcagactgcagatcgaccccgtgatggccgagaccctgcagatgagccaggccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105604 - DNA, 1716 bp, Artificial Sequence
  Description of Artificial Sequence: Synthetic coding sequence
atggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105605 - DNA, 2022 bp, Artificial Sequence
  Description of Artificial Sequence: Synthetic coding sequence
atggagatcggcaccgagatcagcagaaagatcagaagcgccatcaagggcaagctgcaggagctgggcgcctacatcgacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105606 - DNA, 1716 bp, Artificial Sequence; identical to SEQ ID NO: 105604
  Description of Artificial Sequence: Synthetic coding sequence

SEQ ID NO: 105607 - DNA, 1758 bp, Artificial Sequence
  Description of Artificial Sequence: Synthetic coding sequence
atggagatcggcaccgagatcagcagaaagatcagaagcgccatcaagggcaagctgcaggagctgggcgcctacgtggacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105608 - DNA, 2136 bp, Artificial Sequence
  Description of Artificial Sequence: Synthetic coding sequence
atggagatcggcaccgagatcagcagaaagatcagaagcgccatcaagggcaagctgcaggagctgggcgcctacgtggacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaacggcagcttcagcaacgccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105609 - DNA, 2136 bp, Artificial Sequence
  Description of Artificial Sequence: Synthetic coding sequence
atggagatcggcaccgagatcagcagaaagatcagaagcgccatcaagggcaagctgcaggagctgggcgcctacatcgacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaacggcagcttcagcaacgccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105610 - DNA, 849 bp, Artificial Sequence
  Description of Artificial Sequence: Synthetic coding sequence
atgagaatgagcagcaagttccccagcccccccctgcccatcttcctgccccccgagcccgtggacctgggcagcatcaccagcagcagctgcagcctgaacgagctggacaacatcagccacctgctgagaaagatcagcgccgacatcaacgagatcaagggcatgaaggccgccatcctgaccgtggaggccaacctgttcgacctgaacgtgagagtgagcaagaacgaggccaagatcagcagcctggaggtgaagatgaacgagtacagcaccacctacgagtgcaacagacagttcgaggaccaggaggaggacaccgagagccagagcagaaccaccgacgtgaagatcatcggcttcctgagaaacgtggagaaggccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105611 - DNA, 219 bp, Artificial Sequence
  Description of Artificial Sequence: Synthetic coding sequence
atggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgactag

SEQ ID NO: 105612 - DNA, 285 bp, Artificial Sequence
  Description of Artificial Sequence: Synthetic coding sequence
atggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagactag

SEQ ID NO: 105613 - DNA, 648 bp, Artificial Sequence
  Description of Artificial Sequence: Synthetic coding sequence
atggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgtag

SEQ ID NO: 105614 - DNA, 1956 bp, Artificial Sequence
  Description of Artificial Sequence: Synthetic coding sequence
tgaagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaacggcagcttcagcaacgccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105615 - DNA, 402 bp, Artificial Sequence
  Description of Artificial Sequence: Synthetic coding sequence
atggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgccccctag

SEQ ID NO: 105616 - DNA, 2193 bp, Artificial Sequence
  Description of Artificial Sequence: Synthetic coding sequence
atggagatcggcaccgagatcagcagaaagatcagaagcgccatcaagggcaagctgcaggagctgggcgcctacgtggacgaggagctgcccgactacatcatggtgatggtggccaacaagaagagccaggaccagatgaccgaggacctgagcctgttcctgggcaacaacaccatcagattcaccgtgtggctgcacggcgtgctggacaagctgagaagcgtgaccaccgagcccagcagcctgaagagcagcgacaccaacatcttcgacagcaacgtgcccagcaacaagagcaacttcagcagaggcgacgagagaagacacgaggccgccgtgccccccctggccatccccagcgccagacccgagaagagagacagcagagtgagcaccagcagccaggagagcaagaccaccaacgtgagacagacctacgacgacggcgccgccaccagactgatgagcaccgtgaagcccctgagagagcccgcccccagcgaggacgtgatcgacatcaagcccgagcccgacgacctgatcgacgaggacctgaacttcgtgcaggagaaccccctgagccagaagaagcccaccgtgaccctgacctacggcagcagcagacccagcatcgagatctacagaccccccgccagcagaaacgccgacagcggcgtgcacctgaacagactgcagttccagcagcagcagaacagcatccacgccgccaagcagctggacatgcagagcagctgggtgtacgagaccggcagactgtgcgagcccgaggtgctgaacagcctggaggagacctacagccccttcttcagaaacaacagcgagaagatgagcatggaggacgagaacttcagaaagagaaagctgcccgtggtgagcagcgtggtgaaggtgaagaagttcaaccacgacggcgaggaggaggaggaggacgacgactacggcagcagaaccggcagcatcagcagcagcgtgagcgtgcccgccaagcccgagagaagacccagcctgccccccagcaagcaggccaacaagaacctgatcctgaaggccatcagcgaggcccaggagagcgtgaccaagaccaccaactacagcaccgtgccccagaagcagaccctgcccgtggcccccagaaccagaaccagccaggaggagctgctggccgaggtggtgcagggccagagcagaacccccagaatcagcccccccatcaaggaggaggagaccaagggcgacagcgtggagaagaaccagggcacccagcagagacagctgctgagcagactgcagatcgaccccgtgatggccgagaccctgcagatgagccaggactactacgacatggagagcatggtgcacgccgacaccagaagcttcatcctgaagaagcccaagctgagcgaggaggtggtggtggcccccaaccaggagagcggcatgaagaccgccgacagcctgagagtgctgagcggccacctgatgcagaccagagacctggtgcagcccgacaagcccgccagccccaagttcatcgtgaccctggacggcgtgcccagcccccccggctacatgagcgaccaggaggaggacatgtgcttcgagggcatgaagcccgtgaaccagaccgccgccagcaacaagggcctgagaggcctgctgcacccccagcagctgcacctgctgagcagacagctggaggaccccaacgccgagatgagcgagctgagcgtggcccagaagcccgagaagctgctggagagatgcaagtactggcccgcctgcaagaacggcgacgagtgcgcctaccaccaccccatcagcccctgcaaggccttccccaactgcaagttcgccgagaagtgcctgttcgtgcaccccaactgcaagtacgacgccaagtgcaccaagcccgactgccccttcacccacgtgagcagaagaatccccgtgctgagccccaagcccgtggccccccccgccccccccagcagcagccagctgtgcagatacttccccgcctgcaagaagatggagtgccccttctaccaccccaagcactgcagattcaacacccagtgcaccagacccgactgcaccttctaccaccccaccatcaacgtgccccccagacacgccctgaagtggatcagaccccagaccagcgagtag

SEQ ID NO: 105617 - DNA, 2709 bp, Artificial Sequence
  Description of Artificial Sequence: Synthetic coding sequence
atggccgaccccgaggtgtgctgcttcatcaccaagatcctgtgcgcccacggcggcagaatggccctggacgccctgctgcaggagatcgccctgagcgagccccagctgtgcgaggtgctgcaggtggccggccccgacagattcgtggtgctggagaccggcggcgaggccggcatcaccagaagcgtggtggccaccaccagagccagagtgtgcagaagaaagtactgccagagaccctgcgacaacctgcacctgtgcaagctgaacctgctgggcagatgcaactacagccagagcgagagaaacctgtgcaagtacagccacgaggtgctgagcgaggagaacttcaaggtgctgaagaaccacgagctgagcggcctgaacaaggaggagctggccgtgctgctgctgcagagcgaccccttcttcatgcccgagatctgcaagagctacaagggcgagggcagacagcagatctgcaaccagcagcccccctgcagcagactgcacatctgcgaccacttcaccagaggcaactgcagattccccaactgcctgagaagccacaacctgatggacagaaaggtgctggccatcatgagagagcacggcctgaaccccgacgtggtgcagaacatccaggacatctgcaacagcaagcacatgcagaagaacccccccggccccagagcccccagcagccacagaagaaacatggcctacagagccagaagcaagagcagagacagattcttccagggcagccaggagttcctggccagcgccagcgccagcgccgagagaagctgcacccccagccccgaccagatcagccacagagccagcctggaggacgcccccgtggacgacctgaccagaaagttcacctacctgggcagccaggacagagccagaccccccagcggcagcagcaaggccaccgacctgggcggcaccagccaggccggcaccagccagagattcctggagaacggcagccaggaggacctgctgcacggcaaccccggcagcacctacctggccagcaacagcaccagcgcccccaactggaagagcctgaccagctggaccaacgaccagggcgccagaagaaagaccgtgttcagccccaccctgcccgccgccagaagcagcctgggcagcctgcagacccccgaggccgtgaccaccagaaagggcaccggcctgctgagcagcgactacagaatcatcaacggcaagagcggcacccaggacatccagcccggccccctgttcaacaacaacgccgacggcgtggccaccgacatcaccagcaccagaagcctgaactacaagagcaccagcagcggccacagagagatcagcagccccagaatccaggacgccggccccgccagcagagacgtgcaggccaccggcagaatcgccgacgacgccgaccccagagtggccctggtgaacgacagcctgagcgacgtgaccagcaccaccagcagcagagtggacgaccacgacagcgaggagatctgcctggaccacctgtgcaagggctgccccctgaacggcagctgcagcaaggtgcacttccacctgccctacagatggcagatgctgatcggcaagacctggaccgacttcgagcacatggagaccatcgagaagggctactgcaaccccggcatccacctgtgcagcgtgggcagctacaccatcaacttcagagtgatgagctgcgacagcttccccatcagaagactgagcacccccagcagcgtgaccaagcccgccaacagcgtgttcaccaccaagtggatctggtactggaagaacgagagcggcacctggatccagtacggcgaggagaaggacaagagaaagaacagcaacgtggacagcagctacctggagagcctgtaccagagctgccccagaggcgtggtgcccttccaggccggcagcagaaactacgagctgagcttccagggcatgatccagaccaacatcgccagcaagacccagaaggacgtgatcagaagacccaccttcgtgccccagtggtacgtgcagcagatgaagagaggccccgaccaccagcccgccaagaccagcagcgtgagcctgaccgccaccttcagaccccaggaggacttctgcttcctgagcagcaagaagtacaagctgagcgagatccaccacctgcaccccgagtacgtgagagtgagcgagcacttcaaggccagcatgaagaacttcaagatcgagaagatcaagaagatcgagaacagcgagctgctggacaagttcacctggaagaagagccagatgaaggaggagggcaagctgctgttctacgccaccagcagagcctacgtggagagcatctgcagcaacaacttcgacagcttcctgcacgagacccacgagaacaagtacggcaagggcatctacttcgccaaggacgccatctacagccacaagaactgcccctacgacgccaagaacgtggtgatgttcgtggcccaggtgctggtgggcaagttcaccgagggcaacatcacctacaccagcccccccccccagttcgacagctgcgtggacaccagaagcaaccccagcgtgttcgtgatcttccagaaggaccaggtgtacccccagtacgtgatcgagtacaccgaggacaaggcctgcgtgatcagctag
